United States Patent 7,745,391 (HUMAN THROMBOSPONDIN POLYPEPTIDE) - sequence listing, part 26

SEQ ID NO: 61849 - DNA, 8022 bp, Homo sapiens
gcaggccgggggtatcagatctgctaacgtgcgtcgaacagagacgagagaacagagacttgatgaaatgagcatcagctccattcagcagccctggcatcactaaagggagatatagtggaacttaataaacgtctccagcaaacagagagggaacgggaccttctggaaaagaaattggccaaggcacagtgcgagcagtcccacctcatgagagagcatgaggatgtccaggagcgaacgacgcttcgctatgaggaacgcatcacagagctccacagcgtcattgcggagctcaacaagaagatagaccgtctgcaaggcaccaccatcagggaggaagatgagtactcagaactgcgatcagaactcagccagagccaacacgaggtcaacgaggactctcgaagcatggaccaagaccagacctctgtctctatccccgaaaaccagtctaccatggttactgctgacatggacaactgcagtgacctgaactcagaactgcagagggtgctgacagggctggagaatgttgtctgcggcaggaagaagagcagctgcagcctctccgtggccgaggtggacaggcacattgagcagctcaccacagccagcgagcactgtgacctggctattaagacagtcgaggagattgagggggtgcttggccgggacctgtatcccaacctggctgaagagaggtctcggtgggagaaggagctggctgggctgagggaagagaatgagagcctgactgccatgctgtgcagcaaagaggaagaactgaaccggactaaggccaccatgaatgccatccgggaagagcgggaccggctccggaggcgggtcagagagcttcaaactcgactacagagcgtgcaggccacaggtccctccagccctggccgcctcacttccaccaaccgcccgattaaccccagcactggggagctgagcacaagcagcagcagcaatgacattcccatcgccaagattgctgagagggtgaagctatcaaagacaaggtccgaatcgtcatcatctgatcggccagtcctgggctcagaaatcagtagcataggggtatccagcagtgtggctgaacacctggcccactcacttcaggactgctccaatatccaagagattttccaaacactctactcacacggatctgccatctcagaaagcaagattagagagtttgaggtggaaacagaacggctgaatagccggattgagcacctcaaatcccaaaatgacctcctgaccataaccttggaggaatgtaaaagcaatgctgagaggatgagcatgctggtgggaaaatacgaatccaatgccacagcgctgaggctggccttgcagtacagcgagcagtgcatcgaagcctacgaactcctcctggcgctggcagagagtgagcagagcctcatcctggggcagttccgagcggcgggcgtggggtcctcccctggagaccagtcgggggatgaaaacatcactcagatgctcaagcgagctcatgactgccggaagacagctgagaacgctgccaaggccctgctcatgaagctggacggcagctgtgggggagcctttgccgtggccggctgcagcgtgcagccctgggagagcctttcctccaacagccacaccagcacaaccagctccacagccagtagttgcgacaccgagttcactaaagaagacgagcagaggctgaaggattatatccagcagctcaagaatgacagggctgcggtcaagctgaccatgctggagctggaaagcatccacatcgatcctctcagctatgacgtcaagcctcggggagacagccagaggctggatctggaaaacgcagtgcttatgcaggagctcatggccatgaaggaggagatggccgagttgaaggcccagctctacctactggagaaagagaagaaggccctggagctgaagctgagcacgcgggaggcccaggagcaggcctacctggtgcacattgagcacctgaagtccgaggtggaggagcagaaggagcagcggatgcgatccctcagctccaccagcagcggcagcaaagataaacctggcaaggagtgtgctgatgctgcctccccagctctgtccctagctgaactcaggacaacgtgcagcgagaatgagctggctgcggagttcaccaacgccattcgtcgagaaaagaagttgaaggccagagttcaagagctggtgagtgccttggagagactcaccaagagcagtgaaatccgacatcagcaatctgcagagttcgtgaatgatctaaagcgggccaacagcaacctggtggctgcctatgagaaagcaaagaaaaagcatcaaaacaaactgaagaagttagagtcgcagatgatggccatggtggagagacatgagacccaagtgaggatgctcaagcaaagaatagctctgctagaggaggagaactccaggccacacaccaatgaaacttcgctttaatcagcactcacgcaccggagttctgcccatgggaagtaaactgcagcaggccactggggacagaagggcccatgtacttgttgggaggaggaggaaagggaaggctggcaggtaggtcggcacttggacaatggagtgccccaactcaacccttggggtgactggccatggtgacattgtggactgtatccagaggtgcccgctcttccctcctgggcccacaacagcgtgtaaacacatgttctgtgcctgctcagcagagcctcgtttctgctttcagcactcactctccccctcctcttctggtctggcggctgtgcatcagtgggatcccagacatttgtttctgtaagattttccattgtatcctctttttggtagatgctgggctcatcttctagaatctcgtttctcctctttcctcctgcttcatgggaaaacagacctgtgtgtgcctccagcatttaaaaggactgctgatttgtttactacagcaaggctttggtttccaagtcccgggtctcaactttaagatagaggcggccataagaggtgatctctgggagttataggtcatgggaagagcgtagacaggtgttacttacagtcccagatacactaaagttacaaacagaccaccaccaggactgtgcctgaacaattttgtattgagagaataaaaacttccttcaatcttcattttggaggcagggctgggaagggagcgctctcttgattctgggatttctccctctcagtggagccttattaatatccaagacttagagctgggaatctttttgatacctgtagtggaactaaaattctgtcaggggtttcttcaagagctgagaaacattattagcacttcccgccccagggcactacataattgctgttctgctgaatcaaatctcttccacatgggtgcatttgtagctctggacctgtctctacctaaggacaagacactgaggagatactgaacattttgcaaaacttatcacgcctacttaagagtgctgtgtaacccccagttcaagacttagctcctgttgtcatgacggggacagagtgagggaatggtagttaaggcttcttttttgcccccagatacatggtgatggttagcatatggtgcttaaaaggttaaatttcaagcaaaatgcttacagggctaggcagtaccaaagtaactgaattatttcaggaaggtcttcaatcttaaaacaaattcattattctttttcagttttacctcttctctctcagttctacactgatacacttgaaggaccatttactgtttttttctgtagcaccagagaatccatccaaagttccctatgaaaaatgtgttccattgccatagctgactacaaattaaagttgaggaggtttctgcatagagtctttatgtccataagctacgggtaggtctattttcagagcatgatacaaattccacagccttctgttcgctggaggatactccagccaccagttcggagggcagacagctgtatcctaaaagcaaccactgagaggccagcagtgaggctgcccatctccaaaacgaaacaacagatcaactggtatcagtctagaaggaccagctttggggtgctttgatcactatgaaaatgttcactggtttctgtcaatcacttggtcaaagttagttcctgtgattttttttttttttttttgagatggagttttgctcttgtcaccaggctgaagtgcagtggcgtgatcttggctcactgcaacctctgcctcctgagtagctggaattacaggtgcccgccaccatacccagctagtttttttgtatttttagtagagacagggtttcaccatgttggccaggctggtctcgaactcctgaccactgatccacccacctcggcctcccaaagtgctgggattacaggcatgagccaatgtgcctggccattcctgtgattttttagaatttttcacttttcatataaagttgcattttatcatgaggaaaatgttttggctgaaaaacatatgccccaaaaaaaaaaaaatcagttttcactatttttccagcttgcctagggaaacgtcctcccctgagcaaagtgggatgtgcatggctcttttttgtgattaagcaggcatcaaatgggcagttttcattttcactgacacagaaacatgtggctgaagcaggaataaaatcctgcctactgacttctgtctccattcttgctccaggtaaaatcagagaacctccccttcttggccctttaattcccccaggcagaggcggctccagctcctgttaagggccccagttttactcatgctacctgaccttagttttagtactttcaaatgtgatttgggtaaaaactattttgcaggcaaaagtgttaattttttataaatatgtataataaaaaagctataaaagtttttccttttcttgtatttttcaaatactccccaagacacaatccttgaaggtgaactaggtggcacttgattatgctaattgtgggagctactgaactatactgattaaattaaatgcttgcaggttcctgggtaattttcctttgtgaataacctggcgctacctgaatttttctctaacaaacatctccaatgagggtaaacaatgatcttgattctaatttatatgaggttaaaaaccttcagatttcgtattttgaattgttctccctagtttcctcagtggttacccccttttagtcagtaaccatctctgttcagaattcagtcttggcttttgaagaaatgggcacagagccaaaggacccatttcacagttcccttggaatatatttcccattgttggactgaggcaaacaaaaccaactgtgcaaatcacaagcaaaagagacttctgtccgtagttgcgagtgccatcagtgtgagcttaccagctacaaaaatctgtcatggactggggaacagtatgattccttattgaaactttcatcctcatcggctggcttgtcagcgttctgaagttaatatccatgctgcctgaaacaaatgttatgtttaactagcacttaacttttaaaattgcttaattctcctttcagatgcatgcactaagtcttctctgagcctgcagcaatattttagagggacctcttctaagtcagagccttgacattctactccaaaaggaagtccaaattagagcccataggctttttcttaaaagctgttaaggagtagtaagaaagttaccactctaaggaaaacatgaaactatctgaaagtcttctggttcctaactggatacagattagattattttaaatgagaaaaaagtgcaccgtagttacccgatcaagattggactgcctgtgtccctggcatgaattaaagaacctccatagttgcttgttcccttctgaaggtgtttcctatggcccacgagaattataaagcaatcactttttaagtctatcagtcaaccttaatagctctcaagagtttcgattatcaagctttaaagtgataacatatcaagatgactattaaaaaataaacatctctgaaagtgtcctttcctccataaggctttaaacaatttgcaaattcttaattgggagtatgtcccaatcattctattaaactatttacagctctacctacttctagattcagcaaacagagctactagttagagtattttgagagccaaaatagtaagagacttctgtaatggttgagatttctgcactgaccttaattagggtaccgccatagggctaccaaagtttttagtgagggctggggaggtggagcataagtaacattttttttctgcagaaggtgatggctttgtagaacactataaaatttttcaggaaaacatacagcaaattttcttatccagtgggaacagcctatttgacaaggaatgatatacaagtttgattcacctttgagcactcttatagagtttacagaagaggcgtaactggttacaaaacaaaagttacgccttcactatccagttcttaaagtttatccacatcctacaaatcttatgttcatgtaggtcaggttaaagtaagctccaaacttgtggccttcagaagcatctcctgtttaacacacctgaaattactctaacttaatacatttgtattctctaagaaataatgctgactgctgtcaccacagcatcactgatctctcagtggctgttaaaatataaacaagtggaaaaaaagtatacaagttgatagcagctgttcatgtattcttgttttgctaatacctgtgtagagaaagacagtttcacatgcagatcaccatacatttttgcttaaaggttacactgggtaaactgtttgtttatcacattacatctgggtgagattttgcatgtgaccaagaggaagaaatcattcagtcccggaaatagcaactgctatgtaaaaccacatccttgactagtacttcatctttccacagtcattcatctgctaatcaggtgaaatatcagctcagcagaacaaagcaagttatacacaaatttcccccacattcacactgatgccgtacttagtaattctggttctaccattcccttttgcactttttgcaagtcaaattcatgtggaaaaatgttctgtttgtagaactcatagtattcacttatagtgctcatgtcaggaatggcaagtgagtaagagcccctgataatctgcttttgttagaacgtaatgcaaagataataaaacatgtccacttcttttctagttctaatcagtttttagacatcaagatttatttactttgcatgagatttgtttcctattatttgaatatgtgctatacacttgaattagaaaaacctgcttgaatgtattgtcagttattaaagcacatgtgactaagtttgcatttgtcagtattgttctactgtttgtactgaaagtctcattttaaaattgctacttaacactgtactataccttgtaattttttagattctccacttgtattctttaaatgtttccagatgcctttagttttagctgctgtaagatagctactttgcgttatttgatatagaattgttttttaaaaactccatttatttatacagagacatttataatattttacaaacattcttatattctgaataaatatttctaattccacagtgtaccttaactgtgttatttaaagggtaaggctatccttctgtagaactgtgatatacatgcaggcaaatatcaaatccatgatgcttacatgaaatcaagagccctagtcaaagcaggggtctagaagtaagactattattagatcaaaatggccaaagaaccctcatttatagcccatttttagttggctttttaaaatttggcataaataggaagttatctattgaagagagtcttttcccctcttaaagaaagatcattaaaatggaatgtaatcaaggactggaaatgcaaggaagtcatataggac

SEQ ID NO: 61850 - DNA, 6139 bp, Homo sapiens
ccccaccgcactggccagtctgcaaaaggagccagcggtctgggagcagaggggcctctttggcttgctgccaggctttcccctttggcgtgacctgagggcgccacccggtgcccacactgctgccatcactgcacgagccacctaccgcgctctgctgcaggcttccagggtgctgccggcttggattcaggcctaactggaatgtgtttgctgttgtcaggagtgtgctgatgctgcctccccagctctgtccctagctgaactcaggacaacgtgcagcgagaatgagctggctgcggagttcaccaacgccattcgtcgagaaaagaagttgaaggccagagttcaagagctggtgagtgccttggagagactcaccaagagcagtgaaatccgacatcagcaatctgcagagttcgtgaatgatctaaagcgggccaacagcaacctggtggctgcctatgagaaagcaaagaaaaagcatcaaaacaaactgaagaagttagagtcgcagatgatggccatggtggagagacatgagacccaagtgaggatgctcaagcaaagaatagctctgctagaggaggagaactccaggccacacaccaatgaaacttcgctttaatcagcactcacgcaccggagttctgcccatgggaagtaaactgcagcaggccactggggacagaagggcccatgtacttgttgggaggaggaggaaagggaaggctggcaggtaggtcggcacttggacaatggagtgccccaactcaacccttggggtgactggccatggtgacattgtggactgtatccagaggtgcccgctcttccctcctgggcccacaacagcgtgtaaacacatgttctgtgcctgctcagcagagcctcgtttctgctttcagcactcactctccccctcctcttctggtctggcggctgtgcatcagtgggatcccagacatttgtttctgtaagattttccattgtatcctctttttggtagatgctgggctcatcttctagaatctcgtttctcctctttcctcctgcttcatgggaaaacagacctgtgtgtgcctccagcatttaaaaggactgctgatttgtttactacagcaaggctttggtttccaagtcccgggtctcaactttaagatagaggcggccataagaggtgatctctgggagttataggtcatgggaagagcgtagacaggtgttacttacagtcccagatacactaaagttacaaacagaccaccaccaggactgtgcctgaacaattttgtattgagagaataaaaacttccttcaatcttcattttggaggcagggctgggaagggagcgctctcttgattctgggatttctccctctcagtggagccttattaatatccaagacttagagctgggaatctttttgatacctgtagtggaactaaaattctgtcaggggtttcttcaagagctgagaaacattattagcacttcccgccccagggcactacataattgctgttctgctgaatcaaatctcttccacatgggtgcatttgtagctctggacctgtctctacctaaggacaagacactgaggagatactgaacattttgcaaaacttatcacgcctacttaagagtgctgtgtaacccccagttcaagacttagctcctgttgtcatgacggggacagagtgagggaatggtagttaaggcttcttttttgcccccagatacatggtgatggttagcatatggtgcttaaaaggttaaatttcaagcaaaatgcttacagggctaggcagtaccaaagtaactgaattatttcaggaaggtcttcaatcttaaaacaaattcattattctttttcagttttacctcttctctctcagttctacactgatacacttgaaggaccatttactgtttttttctgtagcaccagagaatccatccaaagttccctatgaaaaatgtgttccattgccatagctgactacaaattaaagttgaggaggtttctgcatagagtctttatgtccataagctacgggtaggtctattttcagagcatgatacaaattccacagccttctgttcgctggaggatactccagccaccagttcggagggcagacagctgtatcctaaaagcaaccactgagaggccagcagtgaggctgcccatctccaaaacgaaacaacagatcaactggtatcagtctagaaggaccagctttggggtgctttgatcactatgaaaatgttcactggtttctgtcaatcacttggtcaaagttagttcctgtgattttttttttttttttttgagatggagttttgctcttgtcaccaggctgaagtgcagtggcgtgatcttggctcactgcaacctctgcctcctgagtagctggaattacaggtgcccgccaccatacccagctagtttttttgtatttttagtagagacagggtttcaccatgttggccaggctggtctcgaactcctgaccactgatccacccacctcggcctcccaaagtgctgggattacaggcatgagccaatgtgcctggccattcctgtgattttttagaatttttcacttttcatataaagttgcattttatcatgaggaaaatgttttggctgaaaaacatatgccccaaaaaaaaaaaaatcagttttcactatttttccagcttgcctagggaaacgtcctcccctgagcaaagtgggatgtgcatggctcttttttgtgattaagcaggcatcaaatgggcagttttcattttcactgacacagaaacatgtggctgaagcaggaataaaatcctgcctactgacttctgtctccattcttgctccaggtaaaatcagagaacctccccttcttggccctttaattcccccaggcagaggcggctccagctcctgttaagggccccagttttactcatgctacctgaccttagttttagtactttcaaatgtgatttgggtaaaaactattttgcaggcaaaagtgttaattttttataaatatgtataataaaaaagctataaaagtttttccttttcttgtatttttcaaatactccccaagacacaatccttgaaggtgaactaggtggcacttgattatgctaattgtgggagctactgaactatactgattaaattaaatgcttgcaggttcctgggtaattttcctttgtgaataacctggcgctacctgaatttttctctaacaaacatctccaatgagggtaaacaatgatcttgattctaatttatatgaggttaaaaaccttcagatttcgtattttgaattgttctccctagtttcctcagtggttacccccttttagtcagtaaccatctctgttcagaattcagtcttggcttttgaagaaatgggcacagagccaaaggacccatttcacagttcccttggaatatatttcccattgttggactgaggcaaacaaaaccaactgtgcaaatcacaagcaaaagagacttctgtccgtagttgcgagtgccatcagtgtgagcttaccagctacaaaaatctgtcatggactggggaacagtatgattccttattgaaactttcatcctcatcggctggcttgtcagcgttctgaagttaatatccatgctgcctgaaacaaatgttatgtttaactagcacttaacttttaaaattgcttaattctcctttcagatgcatgcactaagtcttctctgagcctgcagcaatattttagagggacctcttctaagtcagagccttgacattctactccaaaaggaagtccaaattagagcccataggctttttcttaaaagctgttaaggagtagtaagaaagttaccactctaaggaaaacatgaaactatctgaaagtcttctggttcctaactggatacagattagattattttaaatgagaaaaaagtgcaccgtagttacccgatcaagattggactgcctgtgtccctggcatgaattaaagaacctccatagttgcttgttcccttctgaaggtgtttcctatggcccacgagaattataaagcaatcactttttaagtctatcagtcaaccttaatagctctcaagagtttcgattatcaagctttaaagtgataacatatcaagatgactattaaaaaataaacatctctgaaagtgtcctttcctccataaggctttaaacaatttgcaaattcttaattgggagtatgtcccaatcattctattaaactatttacagctctacctacttctagattcagcaaacagagctactagttagagtattttgagagccaaaatagtaagagacttctgtaatggttgagatttctgcactgaccttaattagggtaccgccatagggctaccaaagtttttagtgagggctggggaggtggagcataagtaacattttttttctgcagaaggtgatggctttgtagaacactataaaatttttcaggaaaacatacagcaaattttcttatccagtgggaacagcctatttgacaaggaatgatatacaagtttgattcacctttgagcactcttatagagtttacagaagaggcgtaactggttacaaaacaaaagttacgccttcactatccagttcttaaagtttatccacatcctacaaatcttatgttcatgtaggtcaggttaaagtaagctccaaacttgtggccttcagaagcatctcctgtttaacacacctgaaattactctaacttaatacatttgtattctctaagaaataatgctgactgctgtcaccacagcatcactgatctctcagtggctgttaaaatataaacaagtggaaaaaaagtatacaagttgatagcagctgttcatgtattcttgttttgctaatacctgtgtagagaaagacagtttcacatgcagatcaccatacatttttgcttaaaggttacactgggtaaactgtttgtttatcacattacatctgggtgagattttgcatgtgaccaagaggaagaaatcattcagtcccggaaatagcaactgctatgtaaaaccacatccttgactagtacttcatctttccacagtcattcatctgctaatcaggtgaaatatcagctcagcagaacaaagcaagttatacacaaatttcccccacattcacactgatgccgtacttagtaattctggttctaccattcccttttgcactttttgcaagtcaaattcatgtggaaaaatgttctgtttgtagaactcatagtattcacttatagtgctcatgtcaggaatggcaagtgagtaagagcccctgataatctgcttttgttagaacgtaatgcaaagataataaaacatgtccacttcttttctagttctaatcagtttttagacatcaagatttatttactttgcatgagatttgtttcctattatttgaatatgtgctatacacttgaattagaaaaacctgcttgaatgtattgtcagttattaaagcacatgtgactaagtttgcatttgtcagtattgttctactgtttgtactgaaagtctcattttaaaattgctacttaacactgtactataccttgtaattttttagattctccacttgtattctttaaatgtttccagatgcctttagttttagctgctgtaagatagctactttgcgttatttgatatagaattgttttttaaaaactccatttatttatacagagacatttataatattttacaaacattcttatattctgaataaatatttctaattccacagtgtaccttaactgtgttatttaaagggtaaggctatccttctgtagaactgtgatatacatgcaggcaaatatcaaatccatgatgcttacatgaaatcaagagccctagtcaaagcaggggtctagaagtaagactattattagatcaaaatggccaaagaaccctcatttatagcccatttttagttggctttttaaaatttggcataaataggaagttatctattgaagagagtcttttcccctcttaaagaaagatcattaaaatggaatgtaatcaaggactggaaatgcaaggaagtcatataggac

SEQ ID NO: 61851 - DNA, 2261 bp, Homo sapiens
ctagttacaataagtctgtcatgcactgcagaactaaattaacttcctttttggtaacggtcatcctcactacatctgagtcgtaatcgtagctgaagcttctatacacgctctctaacactaatgttatgtactcgtagcacttaacttttaaaattgcttaattctcctttcagatgcatgcactaagtcttctctgagcctgcagcaatattttagagggacctcttctaagtcagagccttgacattctactccaaaaggaagtccaaattagagcccataggctttttcttaaaagctgttaaggagtagtaagaaagttaccactctaaggaaaacatgaaactatctgaaagtcttctggttcctaactggatacagattagattattttaaatgagaaaaaagtgcaccgtagttacccgatcaagattggactgcctgtgtccctggcatgaattaaagaacctccatagttgcttgttcccttctgaaggtgtttcctatggcccacgagaattataaagcaatcactttttaagtctatcagtcaaccttaatagctctcaagagtttcgattatcaagctttaaagtgataacatatcaagatgactattaaaaaataaacatctctgaaagtgtcctttcctccataaggctttaaacaatttgcaaattcttaattgggagtatgtcccaatcattctattaaactatttacagctctacctacttctagattcagcaaacagagctactagttagagtattttgagagccaaaatagtaagagacttctgtaatggttgagatttctgcactgaccttaattagggtaccgccatagggctaccaaagtttttagtgagggctggggaggtggagcataagtaacattttttttctgcagaaggtgatggctttgtagaacactataaaatttttcaggaaaacatacagcaaattttcttatccagtgggaacagcctatttgacaaggaatgatatacaagtttgattcacctttgagcactcttatagagtttacagaagaggcgtaactggttacaaaacaaaagttacgccttcactatccagttcttaaagtttatccacatcctacaaatcttatgttcatgtaggtcaggttaaagtaagctccaaacttgtggccttcagaagcatctcctgtttaacacacctgaaattactctaacttaatacatttgtattctctaagaaataatgctgactgctgtcaccacagcatcactgatctctcagtggctgttaaaatataaacaagtggaaaaaaagtatacaagttgatagcagctgttcatgtattcttgttttgctaatacctgtgtagagaaagacagtttcacatgcagatcaccatacatttttgcttaaaggttacactgggtaaactgtttgtttatcacattacatctgggtgagattttgcatgtgaccaagaggaagaaatcattcagtcccggaaatagcaactgctatgtaaaaccacatccttgactagtacttcatctttccacagtcattcatctgctaatcaggtgaaatatcagctcagcagaacaaagcaagttatacacaaatttcccccacattcacactgatgccgtacttagtaattctggttctaccattcccttttgcactttttgcaagtcaaattcatgtggaaaaatgttctgtttgtagaactcatagtattcacttatagtgctcatgtcaggaatggcaagtgagtaagagcccctgataatctgcttttgttagaacgtaatgcaaagataataaaacatgtccacttcttttctagttctaatcagtttttagacatcaagatttatttactttgcatgagatttgtttcctattatttgaatatgtgctatacacttgaattagaaaaacctgcttgaatgtattgtcagttattaaagcacatgtgactaagtttgcatttgtcagtattgttctactgtttgtactgaaagtctcattttaaaattgctacttaacactgtactataccttgtaattttttagattctccacttgtattctttaaatgtttccagatgcctttagttttagctgctgtaagatagctactttgcgttatttgatatagaattgttttttaaaaactccatttatttatacagagacatttataatattttacaaacattcttatattctgaataaatatttctaattcca

SEQ ID NO: 61852 - DNA, 585 bp, Homo sapiens
aaagaagtggacatgttttattatctttgcattacgttctaacaaaagcagattatcaggggctcgtattcacttatagtgctcatgtcaggaatggcaagtgagtaagagcccctgataatctgcttttgttagaacgtaatgcaaagataataaaacatgtccacttcttttctagttctaatcagtttttagacatcaagatttatttactttgcatgagatttgtttcctattatttgaatatgtgctatacacttgaattagaaaaacctgcttgaatgtattgtcagttattaaagcacatgtgactaagtttgcatttgtcagtattgttctactgtttgtactgaaagtctcattttaaaattgctacttaacactgtactataccttgtaattttttagattctccacttgtattctttaaatgtttccagatgcctttagttttagctgctgtaagatagctactttgcgttatttgatatagaattgttttttaaaaactccatttatttatacagagacatttataatattttacaaacattcttatattctgaataaatatttctaattcca

SEQ ID NO: 61853 - DNA, 8168 bp, Homo sapiens
  misc_feature (1)..(1): n is a, c, g, or t
  misc_feature (4)..(4): n is a, c, g, or t
nganggggaaacttcggcgtgaagtgcagctccgctccggctccctctagctttctttccttctctggaatccgaggcgcggatcttcctcgccccaccgccctagttttttcgggagctcgccggtgccctctagggtgtcggctcgtgctgggaagtgccctccatcctggtaatggggggcggcgaggcaccgtaggagtggcgaggcggcgcccagggtggcactgccccggaacggggcgctgggtgcgcgcgggagggtccccgcgcgggctccgccgctgccgcagctgcgagcgcgccgcgccaccgagcctcctgcagcaatggctcgtccgtgaaacgcgagccacggctgctctttttaagagtgcctgcatcctccgtttgcgcttcgcaactgtcctgggtgaaaatggctgtctagactaaaatgtggcagaagggaccaagcagtggatattgagcctgtgaagtccaactcttaagctccgagacctgggggactgagagcccagctctgaaaagtgcatcatgaattccggagttgccatgaaatatggaaacgactcctcggccgagctgagtgagctccattcagcagccctggcatcactaaagggagatatagtggaacttaataaacgtctccagcaaacagagagggaacgggaccttctggaaaagaaattggccaaggcacagtgcgagcagtcccacctcatgagagagcatgaggatgtccaggagcgaacgacgcttcgctatgaggaacgcatcacagagctccacagcgtcattgcggagctcaacaagaagatagaccgtctgcaaggcaccaccatcagggaggaagatgagtactcagaactgcgatcagaactcagccagagccaacacgaggtcaacgaggactctcgaagcatggaccaagaccagacctctgtctctatccccgaaaaccagtctaccatggttactgctgacatggacaactgcagtgacctgaactcagaactgcagagggtgctgacagggctggagaatgttgtctgcggcaggaagaagagcagctgcagcctctccgtggccgaggtggacaggcacattgagcagctcaccacagccagcgagcactgtgacctggctattaagacagtcgaggagattgagggggtgcttggccgggacctgtatcccaacctggctgaagagaggtctcggtgggagaaggagctggctgggctgagggaagagaatgagagcctgactgccatgctgtgcagcaaagaggaagaactgaaccggactaaggccaccatgaatgccatccgggaagagcgggaccggctccggaggcgggtcagagagcttcaaactcgactacagagcgtgcaggccacaggtccctccagccctggccgcctcacttccaccaaccgcccgattaaccccagcactggggagctgagcacaagcagcagcagcaatgacattcccatcgccaagattgctgagagggtgaagctatcaaagacaaggtccgaatcgtcatcatctgatcggccagtcctgggctcagaaatcagtagcataggggtatccagcagtgtggctgaacacctggcccactcacttcaggactgctccaatatccaagagattttccaaacactctactcacacggatctgccatctcagaaagcaagattagagagtttgaggtggaaacagaacggctgaatagccggattgagcacctcaaatcccaaaatgacctcctgaccataaccttggaggaatgtaaaagcaatgctgagaggatgagcatgctggtgggaaaatacgaatccaatgccacagcgctgaggctggccttgcagtacagcgagcagtgcatcgaagcctacgaactcctcctggcgctggcagagagtgagcagagcctcatcctggggcagttccgagcggcgggcgtggggtcctcccctggagaccagtcgggggatgaaaacatcactcagatgctcaagcgagctcatgactgccggaagacagctgagaacgctgccaaggccctgctcatgaagctggacggcagctgtgggggagcctttgccgtggccggctgcagcgtgcagccctgggagagcctttcctccaacagccacaccagcacaaccagctccacagccagtagttgcgacaccgagttcactaaagaagacgagcagaggctgaaggattatatccagcagctcaagaatgacagggctgcggtcaagctgaccatgctggagctggaaagcatccacatcgatcctctcagctatgacgtcaagcctcggggagacagccagaggctggatctggaaaacgcagtgcttatgcaggagctcatggccatgaaggaggagatggccgagttgaaggcccagctctacctactggagaaagagaagaaggccctggagctgaagctgagcacgcgggaggcccaggagcaggcctacctggtgcacattgagcacctgaagtccgaggtggaggagcagaaggagcagcggatgcgatccctcagctccaccagcagcggcagcaaagataaacctggcaaggagtgtgctgatgctgcctccccagctctgtccctagctgaactcaggacaacgtgcagcgagaatgagctggctgcggagttcaccaacgccattcgtcgagaaaagaagttgaaggccagagttcaagagctggtgagtgccttggagagactcaccaagagcagtgaaatccgacatcagcaatctgcagagttcgtgaatgatctaaagcgggccaacagcaacctggtggctgcctatgagaaagcaaagaaaaagcatcaaaacaaactgaagaagttagagtcgcagatgatggccatggtggagagacatgagacccaagtgaggatgctcaagcaaagaatagctctgctagaggaggagaactccaggccacacaccaatgaaacttcgctttaatcagcactcacgcaccggagttctgcccatgggaagtaaactgcagcaggccactggggacagaagggcccatgtacttgttgggaggaggaggaaagggaaggctggcaggtaggtcggcacttggacaatggagtgccccaactcaacccttggggtgactggccatggtgacattgtggactgtatccagaggtgcccgctcttccctcctgggcccacaacagcgtgtaaacacatgttctgtgcctgctcagcagagcctcgtttctgctttcagcactcactctccccctcctcttctggtctggcggctgtgcatcagtgggatcccagacatttgtttctgtaagattttccattgtatcctctttttggtagatgctgggctcatcttctagaatctcgtttctcctctttcctcctgcttcatgggaaaacagacctgtgtgtgcctccagcatttaaaaggactgctgatttgtttactacagcaaggctttggtttccaagtcccgggtctcaactttaagatagaggcggccataagaggtgatctctgggagttataggtcatgggaagagcgtagacaggtgttacttacagtcccagatacactaaagttacaaacagaccaccaccaggactgtgcctgaacaattttgtattgagagaataaaaacttccttcaatcttcattttggaggcagggctgggaagggagcgctctcttgattctgggatttctccctctcagtggagccttattaatatccaagacttagagctgggaatctttttgatacctgtagtggaactaaaattctgtcaggggtttcttcaagagctgagaaacattattagcacttcccgccccagggcactacataattgctgttctgctgaatcaaatctcttccacatgggtgcatttgtagctctggacctgtctctacctaaggacaagacactgaggagatactgaacattttgcaaaacttatcacgcctacttaagagtgctgtgtaacccccagttcaagacttagctcctgttgtcatgacggggacagagtgagggaatggtagttaaggcttcttttttgcccccagatacatggtgatggttagcatatggtgcttaaaaggttaaatttcaagcaaaatgcttacagggctaggcagtaccaaagtaactgaattatttcaggaaggtcttcaatcttaaaacaaattcattattctttttcagttttacctcttctctctcagttctacactgatacacttgaaggaccatttactgtttttttctgtagcaccagagaatccatccaaagttccctatgaaaaatgtgttccattgccatagctgactacaaattaaagttgaggaggtttctgcatagagtctttatgtccataagctacgggtaggtctattttcagagcatgatacaaattccacagccttctgttcgctggaggatactccagccaccagttcggagggcagacagctgtatcctaaaagcaaccactgagaggccagcagtgaggctgcccatctccaaaacgaaacaacagatcaactggtatcagtctagaaggaccagctttggggtgctttgatcactatgaaaatgttcactggtttctgtcaatcacttggtcaaagttagttcctgtgattttttttttttttttttgagatggagttttgctcttgtcaccaggctgaagtgcagtggcgtgatcttggctcactgcaacctctgcctcctgagtagctggaattacaggtgcccgccaccatacccagctagtttttttgtatttttagtagagacagggtttcaccatgttggccaggctggtctcgaactcctgaccactgatccacccacctcggcctcccaaagtgctgggattacaggcatgagccaatgtgcctggccattcctgtgattttttagaatttttcacttttcatataaagttgcattttatcatgaggaaaatgttttggctgaaaaacatatgccccaaaaaaaaaaaaatcagttttcactatttttccagcttgcctagggaaacgtcctcccctgagcaaagtgggatgtgcatggctcttttttgtgattaagcaggcatcaaatgggcagttttcattttcactgacacagaaacatgtggctgaagcaggaataaaatcctgcctactgacttctgtctccattcttgctccaggtaaaatcagagaacctccccttcttggccctttaattcccccaggcagaggcggctccagctcctgttaagggccccagttttactcatgctacctgaccttagttttagtactttcaaatgtgatttgggtaaaaactattttgcaggcaaaagtgttaattttttataaatatgtataataaaaaagctataaaagtttttccttttcttgtatttttcaaatactccccaagacacaatccttgaaggtgaactaggtggcacttgattatgctaattgtgggagctactgaactatactgattaaattaaatgcttgcaggttcctgggtaattttcctttgtgaataacctggcgctacctgaatttttctctaacaaacatctccaatgagggtaaacaatgatcttgattctaatttatatgaggttaaaaaccttcagatttcgtattttgaattgttctccctagtttcctcagtggttacccccttttagtcagtaaccatctctgttcagaattcagtcttggcttttgaagaaatgggcacagagccaaaggacccatttcacagttcccttggaatatatttcccattgttggactgaggcaaacaaaaccaactgtgcaaatcacaagcaaaagagacttctgtccgtagttgcgagtgccatcagtgtgagcttaccagctacaaaaatctgtcatggactggggaacagtatgattccttattgaaactttcatcctcatcggctggcttgtcagcgttctgaagttaatatccatgctgcctgaaacaaatgttatgtttaactagcacttaacttttaaaattgcttaattctcctttcagatgcatgcactaagtcttctctgagcctgcagcaatattttagagggacctcttctaagtcagagccttgacattctactccaaaaggaagtccaaattagagcccataggctttttcttaaaagctgttaaggagtagtaagaaagttaccactctaaggaaaacatgaaactatctgaaagtcttctggttcctaactggatacagattagattattttaaatgagaaaaaagtgcaccgtagttacccgatcaagattggactgcctgtgtccctggcatgaattaaagaacctccatagttgcttgttcccttctgaaggtgtttcctatggcccacgagaattataaagcaatcactttttaagtctatcagtcaaccttaatagctctcaagagtttcgattatcaagctttaaagtgataacatatcaagatgactattaaaaaataaacatctctgaaagtgtcctttcctccataaggctttaaacaatttgcaaattcttaattgggagtatgtcccaatcattctattaaactatttacagctctacctacttctagattcagcaaacagagctactagttagagtattttgagagccaaaatagtaagagacttctgtaatggttgagatttctgcactgaccttaattagggtaccgccatagggctaccaaagtttttagtgagggctggggaggtggagcataagtaacattttttttctgcagaaggtgatggctttgtagaacactataaaatttttcagggatatacaagtttgattcacctttgagcactcttatagagtttacagaagaggcgtaactggttacaaaacaaaagttacgccttcactatccagttcttaaagtttatccacatcctacaaatcttatgttcatgtaggtcaggttaaagtaagctccaaacttgtggccttcagaagcatctcctgtttaacacacctgaaattactctaacttaatacatttgtattctctaagaaataatgctgactgctgtcaccacagcatcactgatctctcagtggctgttaaaatataaacaagtggaaaaaaagtatacaagttgatagcagctgttcatgtattcttgttttgctaatacctgtgtagagaaagacagtttcacatgcagatcaccatacatttttgcttaaaggttacactgggtaaactgtttgtttatcacattacatctgggtgagattttgcatgtgaccaagaggaagaaatcattcagtcccggaaatagcaactgctatgtaaaaccacatccttgactagtacttcatctttccacagtcattcatctgctaatcaggtgaaatatcagctcagcagaacaaagcaagttatacacaaatttcccccacattcacactgatgccgtacttagtaattctggttctaccattcccttttgcactttttgcaagtcaaattcatgtggaaaaatgttctgtttgtagaactcatagtattcacttatagtgctcatgtcaggaatggcaagtgagtaagagcccctgataatctgcttttgttagaacgtaatgcaaagataataaaacatgtccacttcttttctagttctaatcagtttttagacatcaagatttatttactttgcatgagatttgtttcctattatttgaatatgtgctatacacttgaattagaaaaacctgcttgaatgtattgtcagttattaaagcacatgtgactaagtttgcatttgtcagtattgttctactgtttgtactgaaagtctcattttaaaattgctacttaacactgtactataccttgtaattttttagattctccacttgtattctttaaatgtttccagatgcctttagttttagctgctgtaagatagctactttgcgttatttgatatagaattgttttttaaaaactccatttatttatacagagacatttataatattttacaaacattcttatattctgaataaatatttctaattcca

SEQ ID NO: 61854 - DNA, 6810 bp, Homo sapiens
  misc_feature (1)..(1): n is a, c, g, or t
  misc_feature (4)..(4): n is a, c, g, or t
nganggggaaacttcggcgtgaagtgcagctccgctccggctccctctagctttctttccttctctggaatccgaggcgcggatcttcctcgccccaccgccctagttttttcgggagctcgccggtgccctctagggtgtcggctcgtgctgggaagtgccctccatcctggtaatggggggcggcgaggcaccgtaggagtggcgaggcggcgcccagggtggcactgccccggaacggggcgctgggtgcgcgcgggagggtccccgcgcgggctccgccgctgccgcagctgcgagcgcgccgcgccaccgagcctcctgcagcaatggctcgtccgtgaaacgcgagccacggctgctctttttaagagtgcctgcatcctccgtttgcgcttcgcaactgtcctgggtgaaaatggctgtctagactaaaatgtggcagaagggaccaagcagtggatattgagcctgtgaagtccaactcttaagctccgagacctgggggactgagagcccagctctgaaaagtgcatcatgaattccggagttgccatgaaatatggaaacgactcctcggccgagctgagtgagctccattcagcagccctggcatcactaaagggagatatagtggaacttaataaacgtctccagcaaacagagagggaacgggaccttctggaaaagaaattggccaaggcacagtgcgagcagtcccacctcatgagagagcatgaggatgtccaggagcgaacgacgcttcgctatgaggaacgcatcacagagctccacagcgtcattgcggagctcaacaagaagatagaccgtctgcaaggcaccaccatcagggaggaagatgagtactcagaactgcgatcagaactcagccagagccaacacgaggtcaacgaggactctcgaagcatggaccaagaccagacctctgtctctatccccgaaaaccagtctaccatggttactgctgacatggacaactgcagtgacctgaactcagaactgcagagggtgctgacagggctggagaatgttgtctgcggcaggaagaagagcagctgcagcctctccgtggccgaggtggacaggcacattgagcagctcaccacagccagcgagcactgtgacctggctattaagacagtcgaggagattgagggggtgcttggccgggacctgtatcccaacctggctgaagagaggtctcggtgggagaaggagctggctgggctgagggaagagaatgagagcctgactgccatgctgtgcagcaaagaggaagaactgaaccggactaaggccaccatgaatgccatccgggaagagcgggaccggctccggaggcgggtcagagagcttcaaactcgactacagagcgtgcaggccacaggtccctccagccctggccgcctcacttccaccaaccgcccgattaaccccagcactggggagctgagcacaagcagcagcagcaatgacattcccatcgccaagattgctgagagggtgaagctatcaaagacaaggtccgaatcgtcatcatctgatcggccagtcctgggctcagaaatcagtagcataggggtatccagcagtgtggctgaacacctggcccactcacttcaggactgctccaatatccaagagattttccaaacactctactcacacggatctgccatctcagaaagcaagattagagagtttgaggtggaaacagaacggctgaatagccggattgagcacctcaaatcccaaaatgacctcctgaccataaccttggaggaatgtaaaagcaatgctgagaggatgagcatgctggtgggaaaatacgaatccaatgccacagcgctgaggctggccttgcagtacagcgagcagtgcatcgaagcctacgaactcctcctggcgctggcagagagtgagcagagcctcatcctggggcagttccgagcggcgggcgtggggtcctcccctggagaccagtcgggggatgaaaacatcactcagatgctcaagcgagctcatgactgccggaagacagctgagaacgctgccaaggccctgctcatgaagctggacggcagctgtgggggagcctttgccgtggccggctgcagcgtgcagccctgggagagcctttcctccaacagccacaccagcacaaccagctccacagccagtagttgcgacaccgagttcactaaagaagacgagcagaggctgaaggattatatccagcagctcaagaatgacagggctgcggtcaagctgaccatgctggagctggaaagcatccacatcgatcctctcagctatgacgtcaagcctcggggagacagccagaggctggatctggaaaacgcagtgcttatgcaggagctcatggccatgaaggaggagatggccgagttgaaggcccagctctacctactggagaaagagaagaaggccctggagctgaagctgagcacgcgggaggcccaggagcaggcctacctggtgcacattgagcacctgaagtccgaggtggaggagcagaaggagcagcggatgcgatccctcagctccaccagcagcggcagcaaagataaacctggcaaggagtgtgctgatgctgcctccccagctctgtccctagctgaactcaggacaacgtgcagcgagaatgagctggctgcggagttcaccaacgccattcgtcgagaaaagaagttgaaggccagagttcaagagctggtgagtgccttggagagactcaccaagagcagtgaaatccgacatcagcaatctgcagagttcgtgaatgatctaaagcgggccaacagcaacctggtggctgcctatgagaaagcaaagaaaaagcatcaaaacaaactgaagaagttagagtcgcagatgatggccatggtggagagacatgagacccaagtgaggatgctcaagcaaagaatagctctgctagaggaggagaactccaggccacacaccaatgaaacttcgctttaatcagcactcacgcaccggagttctgcccatgggaagtaaactgcagcaggccactggggacagaagggcccatgtacttgttgggaggaggaggaaagggaaggctggcaggtaggtcggcacttggacaatggagtgccccaactcaacccttggggtgactggccatggtgacattgtggactgtatccagaggtgcccgctcttccctcctgggcccacaacagcgtgtaaacacatgttctgtgcctgctcagcagagcctcgtttctgctttcagcactcactctccccctcctcttctggtctggcggctgtgcatcagtgggatcccagacatttgtttctgtaagattttccattgtatcctctttttggtagatgctgggctcatcttctagaatctcgtttctcctctttcctcctgcttcatgggaaaacagacctgtgtgtgcctccagcatttaaaaggactgctgatttgtttactacagcaaggctttggtttccaagtcccgggtctcaactttaagatagaggcggccataagaggtgatctctgggagttataggtcatgggaagagcgtagacaggtgttacttacagtcccagatacactaaagttacaaacagaccaccaccaggactgtgcctgaacaattttgtattgagagaataaaaacttccttcaatcttcattttggaggcagggctgggaagggagcgctctcttgattctgggatttctccctctcagtggagccttattaatatccaagacttagagctgggaatctttttgatacctgtagtggaactaaaattctgtcaggggtttcttcaagagctgagaaacattattagcacttcccgccccagggcactacataattgctgttctgctgaatcaaatctcttccacatgggtgcatttgtagctctggacctgtctctacctaaggacaagacactgaggagatactgaacattttgcaaaacttatcacgcctacttaagagtgctgtgtaacccccagttcaagacttagctcctgttgtcatgacggggacagagtgagggaatggtagttaaggcttcttttttgcccccagatacatggtgatggttagcatatggtgcttaaaaggttaaatttcaagcaaaatgcttacagggctaggcagtaccaaagtaactgaattatttcaggaaggtcttcaatcttaaaacaaattcattattctttttcagttttacctcttctctctcagttctacactgatacacttgaaggaccatttactgtttttttctgtagcaccagagaatccatccaaagttccctatgaaaaatgtgttccattgccatagctgactacaaattaaagttgaggaggtttctgcatagagtctttatgtccataagctacgggtaggtctattttcagagcatgatacaaattccacagccttctgttcgctggaggatactccagccaccagttcggagggcagacagctgtatcctaaaagcaaccactgagaggccagcagtgaggctgcccatctccaaaacgaaacaacagatcaactggtatcagtctagaaggaccagctttggggtgctttgatcactatgaaaatgttcactggtttctgtcaatcacttggtcaaagttagttcctgtgattttttttttttttttttgagatggagttttgctcttgtcaccaggctgaagtgcagtggcgtgatcttggctcactgcaacctctgcctcctgagtagctggaattacaggtgcccgccaccatacccagctagtttttttgtatttttagtagagacagggtttcaccatgttggccaggctggtctcgaactcctgaccactgatccacccacctcggcctcccaaagtgctgggattacaggcatgagccaatgtgcctggccattcctgtgattttttagaatttttcacttttcatataaagttgcattttatcatgaggaaaatgttttggctgaaaaacatatgccccaaaaaaaaaaaaatcagttttcactatttttccagcttgcctagggaaacgtcctcccctgagcaaagtgggatgtgcatggctcttttttgtgattaagcaggcatcaaatgggcagttttcattttcactgacacagaaacatgtggctgaagcaggaataaaatcctgcctactgacttctgtctccattcttgctccaggtaaaatcagagaacctccccttcttggccctttaattcccccaggcagaggcggctccagctcctgttaagggccccagttttactcatgctacctgaccttagttttagtactttcaaatgtgatttgggtaaaaactattttgcaggcaaaagtgttaattttttataaatatgtataataaaaaagctataaaagtttttccttttcttgtatttttcaaatactccccaagacacaatccttgaaggtgaactaggtggcacttgattatgctaattgtgggagctactgaactatactgattaaattaaatgcttgcaggttcctgggtaattttcctttgtgaataacctggcgctacctgaatttttctctaacaaacatctccaatgagggtaaacaatgatcttgattctaatttatatgaggttaaaaaccttcagatttcgtattttgaattgttctccctagtttcctcagtggttacccccttttagtcagtaaccatctctgttcagaattcagtcttggcttttgaagaaatgggcacagagccaaaggacccatttcacagttcccttggaatatatttcccattgttggactgaggcaaacaaaaccaactgtgcaaatcacaagcaaaagagacttctgtccgtagttgcgagtgccatcagtgtgagcttaccagctacaaaaatctgtcatggactggggaacagtatgattccttattgaaactttcatcctcatcggctggcttgtcagcgttctgaagttaatatccatgctgcctgaaacaaatgttatgtttaactagcacttaacttttaaaattgcttaattctcctttcagatgcatgcactaagtcttctctgagcctgcagcaatattttagagggacctcttctaagtcagagccttgacattctactccaaaaggaagtccaaattagagcccataggctttttcttaaaagctgttaaggagtagtaagaaagttaccactctaaggaaaacatgaaactatctgaaagtcttctggttcctaactggatacagattagattattttaaatgagaaaaaagtgcaccgtagttacccgatcaagattggactgcctgtgtccctggcatgaattaaagaacctccatagttgcttgttcccttctgaaggtgtttcctatggcccacgagaattataaagcaatcactttttaagtctatcagtcaaccttaatagctctcaagagtttcgattatcaagctttaaagtgataacatatcaagatgactattaaaaaataaacatctctgaaagtgtcctttcctccataaggctttaaacaatttgcaaattcttaattgggagtatgtcccaatcattctattaaactatttacagctctacctaattaaggtcagtgcagaaatctcaaccattacagaagtctcttactattttggctctcaaaatactctaactagtagctctgtttgctgaatctagaagtaggtcgacgcgg

SEQ ID NO: 61855 - DNA, 7846 bp, Homo sapiens
  misc_feature (1)..(1): n is a, c, g, or t
  misc_feature (4)..(4): n is a, c, g, or t
nganggggaaacttcggcgtgaagtgcagctccgctccggctccctctagctttctttccttctctggaatccgaggcgcggatcttcctcgccccaccgccctagttttttcgggagctcgccggtgccctctagggtgtcggctcgtgctgggaagtgccctccatcctggtaatggggggcggcgaggcaccgtaggagtggcgaggcggcgcccagggtggcactgccccggaacggggcgctgggtgcgcgcgggagggtccccgcgcgggctccgccgctgccgcagctgcgagcgcgccgcgccaccgagcctcctgcagcaatggctcgtccgtgaaacgcgagccacggctgctctttttaagagtgcctgcatcctccgtttgcgcttcgcaactgtcctgggtgaaaatggctgtctagactaaaatgtggcagaagggaccaagcagtggatattgagcctgtgaagtccaactcttaagctccgagacctgggggactgagagcccagctctgaaaagtgcatcatgaattccggagttgccatgaaatatggaaacgactcctcggccgagctgagtgagctccattcagcagccctggcatcactaaagggagatatagtggaacttaataaacgtctccagcaaacagagagggaacgggaccttctggaaaagaaattggccaaggcacagtgcgagcagtcccacctcatgagagagcatgaggatgtccaggagcgaacgacgcttcgctatgaggaacgcatcacagagctccacagcgtcattgcggagctcaacaagaagatagaccgtctgcaaggcaccaccatcagggaggaagatgagtactcagaactgcgatcagaactcagccagagccaacacgaggtcaacgaggactctcgaagcatggaccaagaccagacctctgtctctatccccgaaaaccagtctaccatggttactgctgacatggacaactgcagtgacctgaactcagaactgcagagggtgctgacagggctggagaatgttgtctgcggcaggaagaagagcagctgcagcctctccgtggccgaggtggacaggcacattgagcagctcaccacagccagcgagcactgtgacctggctattaagacagtcgaggagattgagggggtgcttggccgggacctgtatcccaacctggctgaagagaggtctcggtgggagaaggagctggctgggctgagggaagagaatgagagcctgactgccatgctgtgcagcaaagaggaagaactgaaccggactaaggccaccatgaatgccatccgggaagagcgggaccggctccggaggcgggtcagagagcttcaaactcgactacagagcgtgcaggccacaggtccctccagccctggccgcctcacttccaccaaccgcccgattaaccccagcactggggagctgagcacaagcagcagcagcaatgacattcccatcgccaagattgctgagagggtgaagctatcaaagacaaggtccgaatcgtcatcatctgatcggccagtcctgggctcagaaatcagtagcataggggtatccagcagtgtggctgaacacctggcccactcacttcaggactgctccaatatccaagagattttccaaacactctactcacacggatctgccatctcagaaagcaagattagagagtttgaggtggaaacagaacggctgaatagccggattgagcacctcaaatcccaaaatgacctcctgaccataaccttggaggaatgtaaaagcaatgctgagaggatgagcatgctggtgggaaaatacgaatccaatgccacagcgctgaggctggccttgcagtacagcgagcagtgcatcgaagcctacgaactcctcctggcgctggcagagagtgagcagagcctcatcctggggcagttccgagcggcgggcgtggggtcctcccctggagaccagtcgggggatgaaaacatcactcagatgctcaagcgagctcatgactgccggaagacagctgagaacgctgccaaggccctgctcatgaagctggacggcagctgtgggggagcctttgccgtggccggctgcagcgtgcagccctgggagagcctttcctccaacagccacaccagcacaaccagctccacagccagtagttgcgacaccgagttcactaaagaagacgagcagaggctgaaggattatatccagcagctcaagaatgacagggctgcggtcaagctgaccatgctggagctggaaagcatccacatcgatcctctcagctatgacgtcaagcctcggggagacagccagaggctggatctggaaaacgcagtgcttatgcaggagctcatggccatgaaggaggagatggccgagttgaaggcccagctctacctactggagaaagagaagaaggccctggagctgaagctgagcacgcgggaggcccaggagcaggcctacctggtgcacattgagcacctgaagtccgaggtggaggagcagaaggagcagcggatgcgatccctcagctccaccagcagcggcagcaaagataaacctggcaaggagtgtgctgatgctgcctccccagctctgtccctagctgaactcaggacaacgtgcagcgagaatgagctggctgcggagttcaccaacgccattcgtcgagaaaagaagttgaaggccagagttcaagagctggtgagtgccttggagagactcaccaagagcagtgaaatccgacatcagcaattgctgatttgtttactacagcaaggctttggtttccaagtcccgggtctcaactttaagatagaggcggccataagaggtgatctctgggagttataggtcatgggaagagcgtagacaggtgttacttacagtcccagatacactaaagttacaaacagaccaccaccaggactgtgcctgaacaattttgtattgagagaataaaaacttccttcaatcttcattttggaggcagggctgggaagggagcgctctcttgattctgggatttctccctctcagtggagccttattaatatccaagacttagagctgggaatctttttgatacctgtagtggaactaaaattctgtcaggggtttcttcaagagctgagaaacattattagcacttcccgccccagggcactacataattgctgttctgctgaatcaaatctcttccacatgggtgcatttgtagctctggacctgtctctacctaaggacaagacactgaggagatactgaacattttgcaaaacttatcacgcctacttaagagtgctgtgtaacccccagttcaagacttagctcctgttgtcatgacggggacagagtgagggaatggtagttaaggcttcttttttgcccccagatacatggtgatggttagcatatggtgcttaaaaggttaaatttcaagcaaaatgcttacagggctaggcagtaccaaagtaactgaattatttcaggaaggtcttcaatcttaaaacaaattcattattctttttcagttttacctcttctctctcagttctacactgatacacttgaaggaccatttactgtttttttctgtagcaccagagaatccatccaaagttccctatgaaaaatgtgttccattgccatagctgactacaaattaaagttgaggaggtttctgcatagagtctttatgtccataagctacgggtaggtctattttcagagcatgatacaaattccacagccttctgttcgctggaggatactccagccaccagttcggagggcagacagctgtatcctaaaagcaaccactgagaggccagcagtgaggctgcccatctccaaaacgaaacaacagatcaactggtatcagtctagaaggaccagctttggggtgctttgatcactatgaaaatgttcactggtttctgtcaatcacttggtcaaagttagttcctgtgattttttttttttttttttgagatggagttttgctcttgtcaccaggctgaagtgcagtggcgtgatcttggctcactgcaacctctgcctcctgagtagctggaattacaggtgcccgccaccatacccagctagtttttttgtatttttagtagagacagggtttcaccatgttggccaggctggtctcgaactcctgaccactgatccacccacctcggcctcccaaagtgctgggattacaggcatgagccaatgtgcctggccattcctgtgattttttagaatttttcacttttcatataaagttgcattttatcatgaggaaaatgttttggctgaaaaacatatgccccaaaaaaaaaaaaatcagttttcactatttttccagcttgcctagggaaacgtcctcccctgagcaaagtgggatgtgcatggctcttttttgtgattaagcaggcatcaaatgggcagttttcattttcactgacacagaaacatgtggctgaagcaggaataaaatcctgcctactgacttctgtctccattcttgctccaggtaaaatcagagaacctccccttcttggccctttaattcccccaggcagaggcggctccagctcctgttaagggccccagttttactcatgctacctgaccttagttttagtactttcaaatgtgatttgggtaaaaactattttgcaggcaaaagtgttaattttttataaatatgtataataaaaaagctataaaagtttttccttttcttgtatttttcaaatactccccaagacacaatccttgaaggtgaactaggtggcacttgattatgctaattgtgggagctactgaactatactgattaaattaaatgcttgcaggttcctgggtaattttcctttgtgaataacctggcgctacctgaatttttctctaacaaacatctccaatgagggtaaacaatgatcttgattctaatttatatgaggttaaaaaccttcagatttcgtattttgaattgttctccctagtttcctcagtggttacccccttttagtcagtaaccatctctgttcagaattcagtcttggcttttgaagaaatgggcacagagccaaaggacccatttcacagttcccttggaatatatttcccattgttggactgaggcaaacaaaaccaactgtgcaaatcacaagcaaaagagacttctgtccgtagttgcgagtgccatcagtgtgagcttaccagctacaaaaatctgtcatggactggggaacagtatgattccttattgaaactttcatcctcatcggctggcttgtcagcgttctgaagttaatatccatgctgcctgaaacaaatgttatgtttaactagcacttaacttttaaaattgcttaattctcctttcagatgcatgcactaagtcttctctgagcctgcagcaatattttagagggacctcttctaagtcagagccttgacattctactccaaaaggaagtccaaattagagcccataggctttttcttaaaagctgttaaggagtagtaagaaagttaccactctaaggaaaacatgaaactatctgaaagtcttctggttcctaactggatacagattagattattttaaatgagaaaaaagtgcaccgtagttacccgatcaagattggactgcctgtgtccctggcatgaattaaagaacctccatagttgcttgttcccttctgaaggtgtttcctatggcccacgagaattataaagcaatcactttttaagtctatcagtcaaccttaatagctctcaagagtttcgattatcaagctttaaagtgataacatatcaagatgactattaaaaaataaacatctctgaaagtgtcctttcctccataaggctttaaacaatttgcaaattcttaattgggagtatgtcccaatcattctattaaactatttacagctctacctacttctagattcagcaaacagagctactagttagagtattttgagagccaaaatagtaagagacttctgtaatggttgagatttctgcactgaccttaattagggtaccgccatagggctaccaaagtttttagtgagggctggggaggtggagcataagtaacattttttttctgcagaaggtgatggctttgtagaacactataaaatttttcaggaaaacatacagcaaattttcttatccagtgggaacagcctatttgacaaggaatgatatacaagtttgattcacctttgagcactcttatagagtttacagaagaggcgtaactggttacaaaacaaaagttacgccttcactatccagttcttaaagtttatccacatcctacaaatcttatgttcatgtaggtcaggttaaagtaagctccaaacttgtggccttcagaagcatctcctgtttaacacacctgaaattactctaacttaatacatttgtattctctaagaaataatgctgactgctgtcaccacagcatcactgatctctcagtggctgttaaaatataaacaagtggaaaaaaagtatacaagttgatagcagctgttcatgtattcttgttttgctaatacctgtgtagagaaagacagtttcacatgcagatcaccatacatttttgcttaaaggttacactgggtaaactgtttgtttatcacattacatctgggtgagattttgcatgtgaccaagaggaagaaatcattcagtcccggaaatagcaactgctatgtaaaaccacatccttgactagtacttcatctttccacagtcattcatctgctaatcaggtgaaatatcagctcagcagaacaaagcaagttatacacaaatttcccccacattcacactgatgccgtacttagtaattctggttctaccattcccttttgcactttttgcaagtcaaattcatgtggaaaaatgttctgtttgtagaactcatagtattcacttatagtgctcatgtcaggaatggcaagtgagtaagagcccctgataatctgcttttgttagaacgtaatgcaaagataataaaacatgtccacttcttttctagttctaatcagtttttagacatcaagatttatttactttgcatgagatttgtttcctattatttgaatatgtgctatacacttgaattagaaaaacctgcttgaatgtattgtcagttattaaagcacatgtgactaagtttgcatttgtcagtattgttctactgtttgtactgaaagtctcattttaaaattgctacttaacactgtactataccttgtaattttttagattctccacttgtattctttaaatgtttccagatgcctttagttttagctgctgtaagatagctactttgcgttatttgatatagaattgttttttaaaaactccatttatttatacagagacatttataatattttacaaacattcttatattctgaataaatatttctaattccacagtgtaccttaactgtgttatttaaagggtaaggctatccttctgtagaactgtgatatacatgcaggcaaatatcaaatccatgatgcttacatgaaatcaagagccctagtcaaagcaggggtctagaagtaagactattattagatcaaaatggccaaagaaccctcatttatagcccatttttagttggctttttaaaatttggcataaataggaagttatctattgaagagagtcttttcccctcttaaagaaagatcattaaaatggaatgtaatcaaggactggaaatgcaaggaagtcatataggac

SEQ ID NO: 61856 - DNA, 1786 bp, Homo sapiens
ctttgggctgtagtcagtattggattatgatcaatattatcaccatttattttgttgctccagttcttccagctgtggccaatccttcagttggattcttgtgccccatcaacattctccatcctggctttttgttttgagcacttccttccttcctagcaccaccaggctcttgtattatccctgtccctgccctggaatcgactcctcctccagagagccctggtttcttttgttagaggatggtatatagaatccaacatgcagacacttggtggacttattgttactggggttttgttatactagggtttcagtggtcagtgctagtatttatgtatgttaacccacgctgtgctttggattcaggctatttcaaattttagataatatggtacatatattattaataccactagttactacattggtacttttcagcaaaatatatctaagtgggatcaaatgagactgtaaatagctttacatcagttcaggtcagttatgttgctaaattacttttggcattaagtttagggaaaaaaaattgggtttgggattttttggtttcaacatttgtgattgagagactatggacctgtaataagtccaagaacagcagttgcagtgtaacaggactgttaatggaatcgggtcatttagaaacagtcaagacttcgctgttgtgcatgtggttaggagccagtgcacacgtcagttcttaggaaatgtacagtctgagcaatagcatttgaaatccaagactcttcccattgtgttgctgttgagtgtagaaaataaaatgtgtgaatttctttatcttgagtattgagattctccccttagaataaaacaagaatttttctctcagtgtaaaaatgtcaagttttattcttgaaatgaatagcaaagttaagcttaaaaacgtgaacagcttcagaactataaatgggtatgtatacctttctgctgtctaagggcagagaagggaaagaaagtgtggtgcttatcagaggagacagcagcaagacacattgtgacagaaaaccaagggtatcctgtgtcacagtgaaatgtaatgagggcacctctcctttcaagagacgaagattgaatacatgggaagcacactctccgctgtgtgttgtctaggagaggtgcaccctgtatggaaatatttgggaaggttaagattaagacagggtaaaataaagcaaaggcaaatcacaaagcaagggctaatgttaatatgaaaagtgcagaattcaaggaaaaagcatggggacaaagaagatttttcctctttttggttgctgttcatgtgtagcctacaacagaactataagacctatagacatttatatgaatatttatttgaaaacgtataatatcaaacaatgtaaaagccaatagaaatctcagataattgaatgtatagaaactagcagtttgaaagtgattagttcattatttgctgatcaagcagaaaaataagcatatgaaagatatttaaaatgggattaataaagttgatttaacagatcctattccatgtcctttgaatatttatagaaattaaatggaacaaattagggcatcaggaaaactatacaaaagtctttaccaaaaaaaaaaatatatatatatatgtgtagtactacctatatatatacataatatatagtactgcttatatatatatatgcctatatgtacacatatatatatacatgtataggcagtactatgttttctgatcataatatgttaaattagtaaaaattac

SEQ ID NO: 61857 - DNA, 1543 bp, Homo sapiens
ctttgggctgtagtcagtattggattatgatcaatattatcaccatttattttgttgctccagttcttccagctgtggccaatccttcagttggattcttgtgccccatcaacattctccatcctggctttttgttttgagcacttccttccttcctagcaccaccaggctcttgtattatccctgtccctgccctggaatcgactcctcctccagagagccctggtttcttttgttagaggatggtatatagaatccaacatgcagacacttggtggacttattgttactggggttttgttatactagggtttcagtggtcagtgctagtatttatgtatgttaacccacgctgtgctttggattcaggctatttcaaattttagataatatggtacatatattattaataccactagttactacattggtacttttcagcaaaatatatctaagtgggatcaaatgagactgtaaatagctttacatcagttcaggtcagttatgttgctaaattacttttggcattaagtttagggaaaaaaaattgggtttgggattttttggtttcaacatttgtgattgagagactatggacctgtaataagtccaagaacagcagttgcagtgtaacaggactgttaatggaatcgggtcatttagaaacagtcaagacttcgctgttgtgcatgtggttaggagccagtgcacacgtcagttcttaggaaatgtacagtctgagcaatagcatttgaaatccaagactcttcccattgtgttgctgttgagtgtagaaaataaaatgtgtgaatttctttatcttgagtattgagattctccccttagaataaaacaagaatttttctctcagtgtaaaaatgtcaagttttattcttgaaatgaatagcaaagttaagcttaaaaacgtgaacagcttcagaactataaatgggtatgtatacctttctgctgtctaagggcagagaagggaaagaaagtgtggtgcttatcagaggagacagcagcaagacacattgtgacagaaaaccaagggtatcctgtgtcacagtgaaatgtaatgagggcacctctcctttcaagagacgaagattgaatacatgggaagcacactctccgctgtgtgttgtctaggagaggtgcaccctgtatggaaatatttgggaaggttaagattaagacagggtaaaataaagcaaaggcaaatcacaaagcaagggctaatgttaatatgaaaagtgcagaattcaaggaaaaagcatggggacaaagaagatttttcctctttttggttgctgttcatgtgtagcctacaacagaactataagacctatagacatttatatgaatatttatttgaaaacgtataatatcaaacaatgtaaaagccaatagaaatctcagataattgaatgtatagaaactagcagtttgaaagtgattagttcattatttgctgatcaagcagaaaaataagcatatgaaagatatttaaaatgggattaataaagttgatttaacagat

SEQ ID NO: 61858 - DNA, 848 bp, Homo sapiens
  misc_feature (4)..(4): n is a, c, g, or t
gacnctgaggatcccctgatcttccgtgcccctgtctaagggcagagaagggaaagaaagtgtggtgcttatcagaggagacagcagcaagacacattgtgacagaaaaccaagggtatcctgtgtcacagtgaaatgtaatgagggcacctctcctttcaagagacgaagattgaatacatgggaagcacactctccgctgtgtgttgtctaggagaggtgcaccctgtatggaaatatttgggaaggttaagattaagacagggtaaaataaagcaaaggcaaatcacaaagcaagggctaatgttaatatgaaaagtgcagaattcaaggaaaaagcatggggacaaagaagatttttcctctttttggttgctgttcatgtgtagcctacaacagaactataagacctatagacatttatatgaatatttatttgaaaacgtataatatcaaacaatgtaaaagccaatagaaatctcagataattgaatgtatagaaactagcagtttgaaagtgattagttcattatttgctgatcaagcagaaaaataagcatatgaaagatatttaaaatgggattaataaagttgatttaacagatcctattccatgtcctttgaatatttatagaaattaaatggaacaaattagggcatcaggaaaactatacaaaagtctttaccaaaaaaaaaaatatatatatatatgtgtagtactacctatatatatacataatatatagtactgcttatatatatatatgcctatatgtacacatatatatatacatgtataggcagtactatgttttctgatcataatatgttaaattagtaaaaattac

SEQ ID NO: 61859 - DNA, 274 bp, Homo sapiens
accgttgcactccagcctgggtgacaagagtgaaactccatcttaaaaaaaatgtgtaaaatgaagattatcatactacctacatcatagaattgtttttagtgtaaaatgtgtgtgtgtacatttatgtaatagttaacatttaaagagcacctactttgtgtaaacatactttgtatgagatactgttcaaatatatattctaatatatgcaacatattaaatatgttagaataggatcttatatatcttagaagtagagcgttggggctga

SEQ ID NO: 61860 - DNA, 2917 bp, Homo sapiens
tgtttttttgttttggccaaactctcatggcttttttctccttccctcatgttttctccttccctcttaagacttggcacttctccagaaggaggaggacaaaatgacgaagtctaaggaggcagtgacattcaaggacgtggctgtggtcttctctgaggaggagctgcaactgctggaccttgcccagaggaagctgtaccgagatgtgatgctggagaacttcaggaatgtggtctcagtggggcatcagtccacaccagatggcctaccacagttagagagagaagaaaagctgtggatgatgaagatggcaacccagagagataactcctcaggagccaagaatctaaaagagatggagactcttcaagaagtaggattaaggtacctgcctcatgaagagcttttctgctcccagatctggcaacagattacaagagagttaatcaagtatcaagattctgtggtaaatattcaaagaacaggctgccagttggaaaaacgagatgatttgcactataaagatgagggattcagtaatcagagttcccatcttcaagttcacagagtccacactggtgaaaaaccctacaaaggagaacattgtgtgaaaagtttcagctggagctctcatcttcaaattaaccaaagggctcacgcaggagagaagccctacaaatgtgaaaaatgtgataatgccttccgtcggttttcaagtcttcaagcccatcagagagtccacagtagagcaaaatcatacacaaatgatgcaagttacaggagttttagtcagaggtcacatcttccccatcatcagagagttcccactggagagaatccatacaaatatgaagagtgtgggaggaatgttgggaaaagctcacattgtcaagctcctctgatagttcatacgggagagaaaccctataaatgtgaggagtgtggggtgggcttcagtcagagatcatatcttcaagttcatctgaaagttcacactggaaagaaaccatataagtgtgaagagtgtgggaagagcttcagttggcgttcacgactgcaggctcatgagcgaatccacactggcgagaaaccatacaaatgcaatgcatgtggcaagagctttagttacagctcacaccttaatattcattgtagaatccacacaggagagaaaccctataagtgtgaggagtgtgggaaaggtttcagtgtgggttcacaccttcaggcccatcagataagccacactggagagaagccatacaaatgtgaggagtgtgggaaaggcttctgccgggcctcaaatctgctggaccatcaaagaggccatactggagagaaaccgtatcagtgtgatgcatgtggtaagggcttcagtcgtagctcagattttaacattcattttagagtccatacaggggaaaaaccctataaatgtgaggagtgtggcaagggcttcagccaggcctcaaatcttctggcccatcaaagaggccacactggagagaaaccctacaaatgtggtacatgtgggaagggcttcagtcggagctcagatcttaatgtacactgtagaatccacacaggagagaaaccctataaatgcgagaggtgtggtaaggccttcagtcagttctccagccttcaggtgcatcagagagttcacactggagagaaaccatatcagtgtgcagagtgtgggaagggcttcagtgtaggttcacagcttcaagcccatcagaggtgccacactggagagaaaccctatcaatgtgaggagtgtgggaagggcttctgtcgggcctccaattttctggcacatcgtggagtccacacaggagaaaaaccataccgatgtgatgtgtgtggtaagcgcttcagacagagatcctaccttcaagcccaccagagggtccacacaggagagagaccatacaaatgtgaggaatgtgggaaagtcttcagctggagctcataccttcaagcccatcaaagagttcacaccggagaaaaaccatacaaatgtgaggagtgtgggaagggcttcagttggagctcaagtcttatcattcatcagcgagtccatgctgatgatgagggtgacaaggactttccttcatcagaggattcacacaggaaaactcgataaaatatgttttactatctcagatgggtgctgaaatattttaataatcagagctatcatagacaaaacatttgttttatagagtcagtagttcagccaagtgattgggagaccacacagcagagaagcctcacaagagtggagacatatggactgcattcagaacattgaccattagctgatacatgcagacaagaggatcaggaaggatgagtctgatctggagtaaatcagaagtactaagatagaaatgctgaattctgttccactagaatataagatccaagagggcagggactttgttgactgccaaatctactctgccttttcagtgcctaatacgttgtaatttttcagtagtatttgaaattactgtcatatttgaaattcagtaatatttgacatttttatttatctctagaagtttctctaaaattgtactcagaagaattctgcaaggcttggaggatatataagttagtcatatggcctgattttcccatttttgcagatctcgtggacaagtgtttatcaaactgaaggttgcagcttgttagtgggttcagaaatcagtttctggctagcaactagaagttttgtatgttaacagtactttattgaggtgtaatctgcatgcagtaacatgcacaagtctcaagttcatggctttctgaattttgacaaatgtaatcatcaccaagatcaatgtatacaatatgtctattaaaccaaaaagttttcttgtgcccatttccagtcaatcccacc

SEQ ID NO: 61861 - DNA, 6843 bp, Homo sapiens
  misc_feature (22)..(22): n is a, c, g, or t
  misc_feature (47)..(47): n is a, c, g, or t
  misc_feature (62)..(62): n is a, c, g, or t
  misc_feature (163)..(164): n is a, c, g, or t
  misc_feature (168)..(168): n is a, c, g, or t
  misc_feature (224)..(225): n is a, c, g, or t
  misc_feature (238)..(238): n is a, c, g, or t
  misc_feature (244)..(244): n is a, c, g, or t
  misc_feature (262)..(262): n is a, c, g, or t
  misc_feature (274)..(274): n is a, c, g, or t
  misc_feature (294)..(294): n is a, c, g, or t
  misc_feature (334)..(334): n is a, c, g, or t
  misc_feature (342)..(342): n is a, c, g, or t
  misc_feature (396)..(396): n is a, c, g, or t
  misc_feature (418)..(418): n is a, c, g, or t
  misc_feature (973)..(973): n is a, c, g, or t
gttgcagtgagccgagatcgcnccactgcactccagcctgggcgacngagcgagactttgtntcaagattactctaaacagaaacaagagtgaaataaatttgtggagttaataataaaaatgttattctctgtggtatgttttcttttcttttgtttttttnngacngggtcttgctctgttgcccaggctggagtgcagtggcgccatcttggctcactgcnncctctgcctcccnggttcnagcgattctcctgcctcnggcccctgagtngctgggattacaggcacgtnccaccacgcctagctaatttttatatttttagtagagacngggtttcnccatgttggtcatgttggtctcgaactcctgacctcatgatctgccccctgccngcctcccacagtgctgggattncaggcgtgagccaccgcgcccggcctgtattttttcatttcatagaatttccagataaaagtcagagtcaactagttttataatactgaaaagttttgcaaatacaagcatgtcacttaatgatggggatgtgttctgagaaatgtgtcattaggtgattccgtcattgtgcaaatgtcatagagtatacttacataaacctaggtggtatgtagcctatatgatatatgtggcttatatgatataccctattgctcctaggctgcaaacctgtatagcatgttactatcctgaagtcaatgggcaattgtaacacaatggcaagtatttgtgtattgaaacataagggtatagtaaaaatatggtactattaatacaactgtatgggactaccattgtatatgcggtccatcattggccaaactttctttatggtggcacaagactacataataaatggtaaagtaaccagacttggagatggggaggagggagaagaatgccaaatgtatgtttcctcccacagactagcaggcatctagtatcaggcaacanacttatacaatcatttcctactcctgtctcacacttgccagaatctggatttaattttttttttttattgttagaccagtaatgcagttttcatattttgtataacaaaaaagttgtaggacttttccttcttactgtgaaaatatgactcattaaatacataacttttagtattggccatttgtattcttatactcttagtcacaaagataactacgttttacaaagtcgaaaggttaataatagcagctagcatgaattcagagcttgctatgtattgagcactgggtttaaacacatatgctctattttattaagtccttatagtaggaaagtgaagaatacactagtcactgaagttccttcagtgctcaagactcaagtgcactatagcaagacaaacaccaggaaacatgtaactctgcttcgaatactttagcaagtgaatggcccagtttgggaaagcaagacaaacactggatccataatggctttttacacctgattggaatgcagaaaaaatggaaccactaactactaatattatctttgccagcaggtgagcagtacatacctgacttcagaggattttattgaaactcaatagatgatggttaataaaaacaaatatcctcagctttccttcttttacttgtcatctgacaaccactatttagctaaaactaaaatggattagagatacaagatgatgaataacaattattaacttttgtgagcatataatgtgagtcagctactacactaagaactttacatagattcccttaattttctcaataatcctatgagaactgtccttgtatgagcaaccccattttatagctgaagatacttgaggcttcaagaggttatataaacatgttcatggtcaacagttattaagcagtgagtgacattctcacgagattaatgagatcatctgtgtgagatacaaatacatctattgtgtatgtttgtgtttttaatggagaccaatggtatgacagaatgaagtccttttatcagtcagtcaagatctgatgtggctattcaaatataggcaaaactgatgttttccttttttagttaagttaaatgtactatttaaataactgtgaatatttagaatattcacagaattgtgcaaccatcaccacaatctttagaatattttcatcatctcaaaaagatactttgtagcctttagcacccttcccactgtacccccccccatacccctggccataggcaactactaaattactttctgtccctgcaggttgtcctattctggatactttgtatatgtggaatcataaaataggtgatcttttatgactggcatctttcaagcatgtttttgatattttcatccatgttgtaggatattaaattaactttttgcataggaataactgagctagaaaagcatgggctgaatatgtctgcagaatgtagcatttagaaaagaaagacttccaggagacaaatgaggtagtaactaaaatgtaaataactaaaaattagctttgagtctttaataaactacctttcatgttttgctttcactaggaatgaacttttaattttttggagctataaatacatgtagtttctaaagacatctttgtttttaaagaaaagacatctgcaggctttttcttagtgttcctattaagtatgtatgagtgtgtgcatttgtgtgtgtgtgtgtgcatgtttagtgactttacatgtgtatacatacaaatgtacacagtcatatatgactagtggtacatggaatctcaatttaattgtaaaagtgaaggagttctaaaactagttttagtatagtaagtgggatatagtaagaatgtcctacaatttaaaagcttatttggttatcttcaatggattttgaatgtattcaatactagatttgcgagtgactatgcctttttagtaaacaaaagaaaggctataatgtagaaagtatatggaataagcataacatctgtcctaatctaattttcaggcacatctccagacttcaatttggctgaaataattcatgccacggacctgtgcacatgcctggaattgagagacacagttaaaagactccaagttgctttctgccttttgaaaactcctgaaaaccatccctctggactctggaattctacacagctcaaccaagactttgcttgaatgtttacattttctgctcgctgtcctacatatcacaatatagtgttcacgttttgttaaaactttggggtgtcaggagttgagcttgctcagcaagccagcatggctaggatgagctttgttatagcagcttgccaattggtgctgggcctactaatgacttcattaaccgagtcttccatacagaatagtgagtgtccacaactttgcgtatgtgaaattcgtccctggtttaccccacagtcaacttacagagaagccaccactgttgattgcaatgacctccgcttaacaaggattcccagtaacctctctagtgacacacaagtgcttctcttacagagcaataacatcgcgaagactgtggatgagctgcagcagcttttcaacttgactgaactagatttctcccaaaacaactttactaacattaaggaggtcgggctggcaaacctaacccagctcacaacgctgcatttggaggaaaatcagattaccgagatgactgattactgtctacaagacctcagcaaccttcaagaactctacatcaaccacaaccaaattagcactatttctgctcatgcttttgcaggcttaaaaaatctattaaggctccacctgaactccaacaaattgaaagttattgatagtcgctggtttgattctacacccaacctggaaattctcatgatcggagaaaaccctgtgattggaattctggatatgaacttcaaacccctcgcaaatttgagaagcttagttttggcaggaatgtatctcactgatattcctggaaatgctttggtgggtctggatagccttgagagcctgtctttttatgataacaaactggttaaagtccctcaacttgccctgcaaaaagttccaaatttgaaattcttagacctcaacaaaaaccccattcacaaaatccaagaaggggacttcaaaaatatgcttcggttaaaagaactgggaatcaacaatatgggcgagctcgtttctgtcgaccgctatgccctggataacttgcctgaactcacaaagctggaagccaccaataaccctaaactctcttacatccaccgcttggctttccgaagtgtccctgctctggaaagcttgatgctgaacaacaatgccttgaatgccatttaccaaaagacagtcgaatccctccccaatctgcgtgagatcagtatccatagcaatcccctcaggtgtgactgtgtgatccactggattaactccaacaaaaccaacatccgcttcatggagcccctgtccatgttctgtgccatgccgcccgaatataaagggcaccaggtgaaggaagttttaatccaggattcgagtgaacagtgcctcccaatgatatctcacgacagcttcccaaatcgtttaaacgtggatatcggcacgacggttttcctagactgtcgagccatggctgagccagaacctgaaatttactgggtcactcccattggaaataagataactgtggaaaccctttcagataaatacaagctaagtagcgaaggtaccttggaaatatctaacatacaaattgaagactcaggaagatacacatgtgttgcccagaatgtccaaggggcagacactcgggtggcaacaattaaggttaacgggacccttctggatggtacccaggtgctaaaaatatacgtcaagcagacagaatcccattccatcttagtgtcctggaaagttaattccaatgtcatgacgtcaaacttaaaatggtcgtctgccaccatgaagattgataaccctcacataacatatactgccagggtcccagtcgatgtccatgaatacaacctaacgcatctgcagccttccacagattatgaagtgtgtctcacagtgtccaatattcatcagcagactcaaaagtcatgcgtaaatgtcacaaccaaaaatgccgccttcgcagtggacatctctgatcaagaaaccagtacagcccttgctgcagtaatggggtctatgtttgccgtcattagccttgcgtccattgctgtgtactttgccaaaagatttaagagaaaaaactaccaccactcattaaaaaagtatatgcaaaaaacctcttcaatcccactaaatgagctgtacccaccactcattaacctctgggaaggtgacagcgagaaagacaaagatggttctgcagacaccaagccaacccaggtcgacacatccagaagctattacatgtggtaactcagaggatattttgcttctggtagtaaggagcacaaagacgtttttgctttattctgcaaaagtgaacaagttgaagacttttgtatttttgactttgctagtttgtggcagagtggagaggacgggtggatatttcaaatttttttagtatagcgtatcgcaagggtttgacacggctgccagcgactctaggcttccagtctgtgtttggtttttattcttatcattattatgattgttattatattattattttattttagttgttgtgctaaactcaataatgctgttctaactacagtgctcaataaaatgattaatgacaggatggggttcccctgtgcttttaccagtagcatgaccccttctgaagccatccgtagaaagtactttgtcctccaaaaagctaacatacggttttgaagcagcattgaaacttttgtagcaatctggtctatagacttttaactcaagaagctaaggctagacttgttaccttcgttgaatgatgttagttgactgtactgtaatgttgtatcaactgaattgaatgtttgcctttaaacaatgaattttctttttctttcctttttttttttttgttgtaatagttaaagaggcttagaacaagctaacaggcaatagaaatatgtatatcagattttttaatgtaacaaactacatgttaattgttatcttattctttttatctttagtagacacttttaaaagaaaagacaattttgttgtgtttaactcaccaacacgtggtgtataatgaagacagaactataataaattagttttgttctgattttttagaacacttgcaataatgtatcatttatagttcttgctagttgcagtggtaatatttttcacatccataaaaacaactaccaaaataaatcagctgtagcatgttgctttttaaagctaggccctaaaaggttttaattctttttctaagggaagaaatgtctattttaattaagatattttaatgaacaggatttctgtattttaaatagtactgactagcacctaatgggcagtgggagggtggttcatatgaagaaaaaaaaggtgtattgttgtatcccatgcataaataaaggtaaatatatatatacaccaatatattcatatatactcacacacatcccaacctgtcacacacaatgcgtgtgtatatatatatgaatatattggatatgtcatttctgtaagagttttgttaaaacctgattttcttttgtagtatccacattcttcatcaaagtacaaaaacgtctgtggagtgtcacaaactgtatgacatgttatttctttttaacagttgtctatatgcttagacccgtgttagtctctatatctgtgtggcaatatctgctgagacaagtaaatgattaatagaaaac

SEQ ID NO: 61862 - DNA, 6243 bp, Homo sapiens
  misc_feature (22)..(22): n is a, c, g, or t
  misc_feature (47)..(47): n is a, c, g, or t
  misc_feature (62)..(62): n is a, c, g, or t
  misc_feature (163)..(164): n is a, c, g, or t
  misc_feature (168)..(168): n is a, c, g, or t
  misc_feature (224)..(225): n is a, c, g, or t
  misc_feature (238)..(238): n is a, c, g, or t
  misc_feature (244)..(244): n is a, c, g, or t
  misc_feature (262)..(262): n is a, c, g, or t
  misc_feature (274)..(274): n is a, c, g, or t
  misc_feature (294)..(294): n is a, c, g, or t
  misc_feature (334)..(334): n is a, c, g, or t
  misc_feature (342)..(342): n is a, c, g, or t
  misc_feature (396)..(396): n is a, c, g, or t
  misc_feature (418)..(418): n is a, c, g, or t
  misc_feature (973)..(973): n is a, c, g, or t
gttgcagtgagccgagatcgcnccactgcactccagcctgggcgacngagcgagactttgtntcaagattactctaaacagaaacaagagtgaaataaatttgtggagttaataataaaaatgttattctctgtggtatgttttcttttcttttgtttttttnngacngggtcttgctctgttgcccaggctggagtgcagtggcgccatcttggctcactgcnncctctgcctcccnggttcnagcgattctcctgcctcnggcccctgagtngctgggattacaggcacgtnccaccacgcctagctaatttttatatttttagtagagacngggtttcnccatgttggtcatgttggtctcgaactcctgacctcatgatctgccccctgccngcctcccacagtgctgggattncaggcgtgagccaccgcgcccggcctgtattttttcatttcatagaatttccagataaaagtcagagtcaactagttttataatactgaaaagttttgcaaatacaagcatgtcacttaatgatggggatgtgttctgagaaatgtgtcattaggtgattccgtcattgtgcaaatgtcatagagtatacttacataaacctaggtggtatgtagcctatatgatatatgtggcttatatgatataccctattgctcctaggctgcaaacctgtatagcatgttactatcctgaagtcaatgggcaattgtaacacaatggcaagtatttgtgtattgaaacataagggtatagtaaaaatatggtactattaatacaactgtatgggactaccattgtatatgcggtccatcattggccaaactttctttatggtggcacaagactacataataaatggtaaagtaaccagacttggagatggggaggagggagaagaatgccaaatgtatgtttcctcccacagactagcaggcatctagtatcaggcaacanacttatacaatcatttcctactcctgtctcacacttgccagaatctggatttaattttttttttttattgttagaccagtaatgcagttttcatattttgtataacaaaaaagttgtaggacttttccttcttactgtgaaaatatgactcattaaatacataacttttagtattggccatttgtattcttatactcttagtcacaaagataactacgttttacaaagtcgaaaggttaataatagcagctagcatgaattcagagcttgctatgtattgagcactgggtttaaacacatatgctctattttattaagtccttatagtaggaaagtgaagaatacactagtcactgaagttccttcagtgctcaagactcaagtgcactatagcaagacaaacaccaggaaacatgtaactctgcttcgaatactttagcaagtgaatggcccagtttgggaaagcaagacaaacactggatccataatggctttttacacctgattggaatgcagaaaaaatggaaccactaactactaatattatctttgccagcaggtgagcagtacatacctgacttcagaggattttattgaaactcaatagatgatggttaataaaaacaaatatcctcagctttccttcttttacttgtcatctgacaaccactatttagctaaaactaaaatggattagagatacaagatgatgaataacaattattaacttttgtgagcatataatgtgagtcagctactacactaagaactttacatagattcccttaattttctcaataatcctatgagaactgtccttgtatgagcaaccccattttatagctgaagatacttgaggcttcaagaggttatataaacatgttcatggtcaacagttattaagcagtgagtgacattctcacgagattaatgagatcatctgtgtgagatacaaatacatctattgtgtatgtttgtgtttttaatggagaccaatggtatgacagaatgaagtccttttatcagtcagtcaagatctgatgtggctattcaaatataggcaaaactgatgttttccttttttagttaagttaaatgtactatttaaataactgtgaatatttagaatattcacagaattgtgcaaccatcaccacaatctttagaatattttcatcatctcaaaaagatactttgtagcctttagcacccttcccactgtacccccccccatacccctggccataggcaactactaaattactttctgtccctgcaggttgtcctattctggatactttgtatatgtggaatcataaaataggtgatcttttatgactggcatctttcaagcatgtttttgatattttcatccatgttgtaggatattaaattaactttttgcataggaataactgagctagaaaagcatgggctgaatatgtctgcagaatgtagcatttagaaaagaaagacttccaggagacaaatgaggtagtaactaaaatgtaaataactaaaaattagctttgagtctttaataaactacctttcatgttttgctttcactaggaatgaacttttaattttttggagctataaatacatgtagtttctaaagacatctttgtttttaaagaaaagacatctgcaggctttttcttagtgttcctattaagtatgtatgagtgtgtgcatttgtgtgtgtgtgtgtgcatgtttagtgactttacatgtgtatacatacaaatgtacacagtcatatatgactagtggtacatggaatctcaatttaattgtaaaagtgaaggagttctaaaactagttttagtatagtaagtgggatatagtaagaatgtcctacaatttaaaagcttatttggttatcttcaatggattttgaatgtattcaatactagatttgcgagtgactatgcctttttagtaaacaaaagaaaggctataatgtagaaagtatatggaataagcataacatctgtcctaatctaattttcaggcacatctccagacttcaatttggctgaaataattcatgccacggacctgtgcacatgcctggaattgagagacacagttaaaagactccaagttgctttctgccttttgaaaactcctgaaaaccatccctctggactctggaattctacacagctcaaccaagactttgcttgaatgtttacattttctgctcgctgtcctacatatcacaatatagtgttcacgttttgttaaaactttggggtgtcaggagttgagcttgctcagcaagccagcatggctaggatgagctttgttatagcagcttgccaattggtgctgggcctactaatgacttcattaaccgagtcttccatacagaatagtgagtgtccacaactttgcgtatgtgaaattcgtccctggtttaccccacagtcaacttacagagaagccaccactgttgattgcaatgacctccgcttaacaaggattcccagtaacctctctagtgacacacaagtgcttctcttacagagcaataacatcgcgaagactgtggatgagctgcagcagcttttcaacttgactgaactagatttctcccaaaacaactttactaacattaaggaggtcgggctggcaaacctaacccagctcacaacgctgcatttggaggaaaatcagattaccgagatgactgattactgtctacaagacctcagcaaccttcaagaactctacatcaaccacaaccaaattagcactatttctgctcatgcttttgcaggcttaaaaaatctattaaggctccacctgaactccaacaaattgaaagttattgatagtcgctggtttgattctacacccaacctggaaattctcatgatcggagaaaaccctgtgattggaattctggatatgaacttcaaacccctcgcaaatttgagaagcttagttttggcaggaatgtatctcactgatattcctggaaatgctttggtgggtctggatagccttgagagcctgtctttttatgataacaaactggttaaagtccctcaacttgccctgcaaaaagttccaaatttgaaattcttagacctcaacaaaaaccccattcacaaaatccaagaaggggacttcaaaaatatgcttcggttaaaagaactgggaatcaacaatatgggcgagctcgtttctgtcgaccgctatgccctggataacttgcctgaactcacaaagctggaagccaccaataaccctaaactctcttacatccaccgcttggctttccgaagtgtccctgctctggaaagcttgatgctgaacaacaatgccttgaatgccatttaccaaaagacagtcgaatccctccccaatctgcgtgagatcagtatccatagcaatcccctcaggtgtgactgtgtgatccactggattaactccaacaaaaccaacatccgcttcatggagcccctgtccatgttctgtgccatgccgcccgaatataaagggcaccaggtgaaggaagttttaatccaggattcgagtgaacagtgcctcccaatgatatctcacgacagcttcccaaatcgtttaaacgtggatatcggcacgacggttttcctagactgtcgagccatggctgagccagaacctgaaatttactgggtcactcccattggaaataagataactgtggaaaccctttcagataaatacaagctaagtagcgaaggtaccttggaaatatctaacatacaaattgaagactcaggaagatacacatgtgttgcccagaatgtccaaggggcagacactcgggtggcaacaattaaggttaacgggacccttctggatggtacccaggtgctaaaaatatacgtcaagcagacagaatcccattccatcttagtgtcctggaaagttaattccaatgtcatgacgtcaaacttaaaatggtcgtctgccaccatgaagattgataaccctcacataacatatactgccagggtcccagtcgatgtccatgaatacaacctaacgcatctgcagccttccacagattatgaagtgtgtctcacagtgtccaatattcatcagcagactcaaaagtcatgcgtaaatgtcacaaccaaaaatgccgccttcgcagtggacatctctgatcaagaaaccagtacagcccttgctgcagtaatggggtctatgtttgccgtcattagccttgcgtccattgctgtgtactttgccaaaagatttaagagaaaaaactaccaccactcattaaaaaagtatatgcaaaaaacctcttcaatcccactaaatgagctgtacccaccactcattaacctctgggaaggtgacagcgagaaagacaaagatggttctgcagacaccaagccaacccaggtcgacacatccagaagctattacatgtggtaactcagaggatattttgcttctggtagtaaggagcacaaagacgtttttgctttattctgcaaaagtgaacaagttgaagacttttgtatttttgactttgctagtttgtggcagagtggagaggacgggtggatatttcaaatttttttagtatagcgtatcgcaagggtttgacacggctgccagcgactctaggcttccagtctgtgtttggtttttattcttatcattattatgattgttattatattattattttattttagttgttgtgctaaactcaataatgctgttctaactacagtgctcaataaaatgattaatgacaggatggggttcccctgtgcttttaccagtagcatgaccccttctgaagccatccgtagaaagtactttgtcctccaaaaagctaacatacggttttgaagcagcattgaaacttttgtagcaatctggtctatagacttttaactcaagaagctaaggctagacttgttaccttcgttgaatgatgttagttgactgtactgtaatgttgtatcaactgaattgaatgtttgcctttaaacaatgaattttctttttctttcctttttttttttttgttgtaatagttaaagaggcttagaacaagctaacaggcaatagaaatatgtatatcagattttttaatgtaacaaactacatgttaattgttatcttattctttttatctttagtagacacttttaaaagaaaagacaattttgttgtgtttaactcaccaacacgtggtgtataatgaagacagaactataataaattagttttgttctgatttttta

SEQ ID NO: 61863 - DNA, 4173 bp, Homo sapiens
gcggccgccgactcggcgcttccccgccgcccgcccagggagtccctgcctggcaagctggggctcggggaaaagtccagcagcgagagggccgcgtgtcccgggacggttccaggggagcccgcgcggaaacgcggaccaggcgcttcggcccggatgccggatccaggagaaggggacctcgcttgccgtgtccaccgccgcggccccggcgccaagaacagagcctggccgtgagtgaacgactggccggggtacaaatggttctgaagcacttgaagctcacaggcaaaggctaagagtctaaatcccatcccgccgcacatctccagacttcaatttggctgaaataattcatgccacggacctgtgcacatgcctggaattgagagacacagttaaaagactccaagttgctttctgccttttgaaaactcctgaaaaccatccctctggactctggaattctacacagctcaaccaagactttgcttgaatgtttacattttctgctcgctgtcctacatatcacaatatagtgttcacgttttgttaaaactttggggtgtcaggagttgagcttgctcagcaagccagcatggctaggatgagctttgttatagcagcttgccaattggtgctgggcctactaatgacttcattaaccgagtcttccatacagaatagtgagtgtccacaactttgcgtatgtgaaattcgtccctggtttaccccacagtcaacttacagagaagccaccactgttgattgcaatgacctccgcttaacaaggattcccagtaacctctctagtgacacacaagtgcttctcttacagagcaataacatcgcgaagactgtggatgagctgcagcagcttttcaacttgactgaactagatttctcccaaaacaactttactaacattaaggaggtcgggctggcaaacctaacccagctcacaacgctgcatttggaggaaaatcagattaccgagatgactgattactgtctacaagacctcagcaaccttcaagaactctacatcaaccacaaccaaattagcactatttctgctcatgcttttgcaggcttaaaaaatctattaaggctccacctgaactccaacaaattgaaagttattgatagtcgctggtttgattctacacccaacctggaaattctcatgatcggagaaaaccctgtgattggaattctggatatgaacttcaaacccctcgcaaatttgagaagcttagttttggcaggaatgtatctcactgatattcctggaaatgctttggtgggtctggatagccttgagagcctgtctttttatgataacaaactggttaaagtccctcaacttgccctgcaaaaagttccaaatttgaaattcttagacctcaacaaaaaccccattcacaaaatccaagaaggggacttcaaaaatatgcttcggttaaaagaactgggaatcaacaatatgggcgagctcgtttctgtcgaccgctatgccctggataacttgcctgaactcacaaagctggaagccaccaataaccctaaactctcttacatccaccgcttggctttccgaagtgtccctgctctggaaagcttgatgctgaacaacaatgccttgaatgccatttaccaaaagacagtcgaatccctccccaatctgcgtgagatcagtatccatagcaatcccctcaggtgtgactgtgtgatccactggattaactccaacaaaaccaacatccgcttcatggagcccctgtccatgttctgtgccatgccgcccgaatataaagggcaccaggtgaaggaagttttaatccaggattcgagtgaacagtgcctcccaatgatatctcacgacagcttcccaaatcgtttaaacgtggatatcggcacgacggttttcctagactgtcgagccatggctgagccagaacctgaaatttactgggtcactcccattggaaataagataactgtggaaaccctttcagataaatacaagctaagtagcgaaggtaccttggaaatatctaacatacaaattgaagactcaggaagatacacatgtgttgcccagaatgtccaaggggcagacactcgggtggcaacaattaaggttaacgggacccttctggatggtacccaggtgctaaaaatatacgtcaagcagacagaatcccattccatcttagtgtcctggaaagttaattccaatgtcatgacgtcaaacttaaaatggtcgtctgccaccatgaagattgataaccctcacataacatatactgccagggtcccagtcgatgtccatgaatacaacctaacgcatctgcagccttccacagattatgaagtgtgtctcacagtgtccaatattcatcagcagactcaaaagtcatgcgtaaatgtcacaaccaaaaatgccgccttcgcagtggacatctctgatcaagaaaccagtacagcccttgctgcagtaatggggtctatgtttgccgtcattagccttgcgtccattgctgtgtactttgccaaaagatttaagagaaaaaactaccaccactcattaaaaaagtatatgcaaaaaacctcttcaatcccactaaatgagctgtacccaccactcattaacctctgggaaggtgacagcgagaaagacaaagatggttctgcagacaccaagccaacccaggtcgacacatccagaagctattacatgtggtaactcagaggatattttgcttctggtagtaaggagcacaaagacgtttttgctttattctgcaaaagtgaacaagttgaagacttttgtatttttgactttgctagtttgtggcagagtggagaggacgggtggatatttcaaatttttttagtatagcgtatcgcaagggtttgacacggctgccagcgactctaggcttccagtctgtgtttggtttttattcttatcattattatgattgttattatattattattttattttagttgttgtgctaaactcaataatgctgttctaactacagtgctcaataaaatgattaatgacaggatggggttcccctgtgcttttaccagtagcatgaccccttctgaagccatccgtagaaagtactttgtcctccaaaaagctaacatacggttttgaagcagcattgaaacttttgtagcaatctggtctatagacttttaactcaagaagctaaggctagacttgttaccttcgttgaatgatgttagttgactgtactgtaatgttgtatcaactgaattgaatgtttgcctttaaacaatgaattttctttttctttcctttttttttttttgttgtaatagttaaagaggcttagaacaagctaacaggcaatagaaatatgtatatcagattttttaatgtaacaaactacatgttaattgttatcttattctttttatctttagtagacacttttaaaagaaaagacaattttgttgtgtttaactcaccaacacgtggtgtataatgaagacagaactataataaattagttttgttctgattttttagaacacttgcaataatgtatcatttatagttcttgctagttgcagtggtaatatttttcacatccataaaaacaactaccaaaataaatcagctgtagcatgttgctttttaaagctaggccctaaaaggttttaattctttttctaagggaagaaatgtctattttaattaagatattttaatgaacaggatttctgtattttaaatagtactgactagcacctaatgggcagtgggagggtggttcatatgaagaaaaaaaaggtgtattgttgtatcccatgcataaataaaggtaaatatatatatacaccaatatattcatatatactcacacacatcccaacctgtcacacacaatgcgtgtgtatatatatatgaatatattggatatgtcatttctgtaagagttttgttaaaacctgattttcttttgtagtatccacattcttcatcaaagtacaaaaacgtctgtggagtgtcacaaactgtatgacatgttatttctttttaacagttgtctatatgcttagacccgtgttagtctctatatctgtgtggcaatatctgctgagacaagtaaatgattaatagaaaac

SEQ ID NO: 61864 - DNA, 3912 bp, Homo sapiens
cgccgccgtgggtgccgggtccgcgcgcaccccaacacccccaccagctgggcctcggggcacatctccagacttcaatttggctgaaataattcatgccacggacctgtgcacatgcctggaattgagagacacagttaaaagactccaagttgctttctgccttttgaaaactcctgaaaaccatccctctggactctggaattctacacagctcaaccaagactttgcttgaatgtttacattttctgctcgctgtcctacatatcacaatatagtgttcacgttttgttaaaactttggggtgtcaggagttgagcttgctcagcaagccagcatggctaggatgagctttgttatagcagcttgccaattggtgctgggcctactaatgacttcattaaccgagtcttccatacagaatagtgagtgtccacaactttgcgtatgtgaaattcgtccctggtttaccccacagtcaacttacagagaagccaccactgttgattgcaatgacctccgcttaacaaggattcccagtaacctctctagtgacacacaagtgcttctcttacagagcaataacatcgcgaagactgtggatgagctgcagcagcttttcaacttgactgaactagatttctcccaaaacaactttactaacattaaggaggtcgggctggcaaacctaacccagctcacaacgctgcatttggaggaaaatcagattaccgagatgactgattactgtctacaagacctcagcaaccttcaagaactctacatcaaccacaaccaaattagcactatttctgctcatgcttttgcaggcttaaaaaatctattaaggctccacctgaactccaacaaattgaaagttattgatagtcgctggtttgattctacacccaacctggaaattctcatgatcggagaaaaccctgtgattggaattctggatatgaacttcaaacccctcgcaaatttgagaagcttagttttggcaggaatgtatctcactgatattcctggaaatgctttggtgggtctggatagccttgagagcctgtctttttatgataacaaactggttaaagtccctcaacttgccctgcaaaaagttccaaatttgaaattcttagacctcaacaaaaaccccattcacaaaatccaagaaggggacttcaaaaatatgcttcggttaaaagaactgggaatcaacaatatgggcgagctcgtttctgtcgaccgctatgccctggataacttgcctgaactcacaaagctggaagccaccaataaccctaaactctcttacatccaccgcttggctttccgaagtgtccctgctctggaaagcttgatgctgaacaacaatgccttgaatgccatttaccaaaagacagtcgaatccctccccaatctgcgtgagatcagtatccatagcaatcccctcaggtgtgactgtgtgatccactggattaactccaacaaaaccaacatccgcttcatggagcccctgtccatgttctgtgccatgccgcccgaatataaagggcaccaggtgaaggaagttttaatccaggattcgagtgaacagtgcctcccaatgatatctcacgacagcttcccaaatcgtttaaacgtggatatcggcacgacggttttcctagactgtcgagccatggctgagccagaacctgaaatttactgggtcactcccattggaaataagataactgtggaaaccctttcagataaatacaagctaagtagcgaaggtaccttggaaatatctaacatacaaattgaagactcaggaagatacacatgtgttgcccagaatgtccaaggggcagacactcgggtggcaacaattaaggttaacgggacccttctggatggtacccaggtgctaaaaatatacgtcaagcagacagaatcccattccatcttagtgtcctggaaagttaattccaatgtcatgacgtcaaacttaaaatggtcgtctgccaccatgaagattgataaccctcacataacatatactgccagggtcccagtcgatgtccatgaatacaacctaacgcatctgcagccttccacagattatgaagtgtgtctcacagtgtccaatattcatcagcagactcaaaagtcatgcgtaaatgtcacaaccaaaaatgccgccttcgcagtggacatctctgatcaagaaaccagtacagcccttgctgcagtaatggggtctatgtttgccgtcattagccttgcgtccattgctgtgtactttgccaaaagatttaagagaaaaaactaccaccactcattaaaaaagtatatgcaaaaaacctcttcaatcccactaaatgagctgtacccaccactcattaacctctgggaaggtgacagcgagaaagacaaagatggttctgcagacaccaagccaacccaggtcgacacatccagaagctattacatgtggtaactcagaggatattttgcttctggtagtaaggagcacaaagacgtttttgctttattctgcaaaagtgaacaagttgaagacttttgtatttttgactttgctagtttgtggcagagtggagaggacgggtggatatttcaaatttttttagtatagcgtatcgcaagggtttgacacggctgccagcgactctaggcttccagtctgtgtttggtttttattcttatcattattatgattgttattatattattattttattttagttgttgtgctaaactcaataatgctgttctaactacagtgctcaataaaatgattaatgacaggatggggttcccctgtgcttttaccagtagcatgaccccttctgaagccatccgtagaaagtactttgtcctccaaaaagctaacatacggttttgaagcagcattgaaacttttgtagcaatctggtctatagacttttaactcaagaagctaaggctagacttgttaccttcgttgaatgatgttagttgactgtactgtaatgttgtatcaactgaattgaatgtttgcctttaaacaatgaattttctttttctttcctttttttttttttgttgtaatagttaaagaggcttagaacaagctaacaggcaatagaaatatgtatatcagattttttaatgtaacaaactacatgttaattgttatcttattctttttatctttagtagacacttttaaaagaaaagacaattttgttgtgtttaactcaccaacacgtggtgtataatgaagacagaactataataaattagttttgttctgattttttagaacacttgcaataatgtatcatttatagttcttgctagttgcagtggtaatatttttcacatccataaaaacaactaccaaaataaatcagctgtagcatgttgctttttaaagctaggccctaaaaggttttaattctttttctaagggaagaaatgtctattttaattaagatattttaatgaacaggatttctgtattttaaatagtactgactagcacctaatgggcagtgggagggtggttcatatgaagaaaaaaaaggtgtattgttgtatcccatgcataaataaaggtaaatatatatatacaccaatatattcatatatactcacacacatcccaacctgtcacacacaatgcgtgtgtatatatatatgaatatattggatatgtcatttctgtaagagttttgttaaaacctgattttcttttgtagtatccacattcttcatcaaagtacaaaaacgtctgtggagtgtcacaaactgtatgacatgttatttctttttaacagttgtctatatgcttagacccgtgttagtctctatatctgtgtggcaatatctgctgagacaagtaaatgattaatagaaaac

SEQ ID NO: 61865 - DNA, 490 bp, Homo sapiens
gcaaggctggcctcgaactcctgacctcaagtgatccaaccgcctcaacctcctaaaatgctgggattacaagagtgaggcacagtgcctggccgcaaaaatgttttttttaaatattcaaaaatagccatggcttgcagttgctataaagctatatagtaactccttcactgggcacaacagaagaaataggaaagagagaaagtgctgctccagaggttcaaaggtgaagatagagcagtgtagtggtggggatttatgtttcctaatctcccttgtcagcccagcatgtcttcagtataaatacacacgtggcagtggcctatgcactcattcacacttcagggaagcccatggtttccttttctcctccattttagcagtgggcagcctgcaaccttttgatcaagctgactttgtatgttacatgactgaactcagctatgccagacatccttaaggaagttgacatttgtgtactttgaaagaa

SEQ ID NO: 61866 - DNA, 268 bp, Homo sapiens
tttgaaagtaaaggaggatcctgtttaagtagattagggtctggcaggccatttaactttatcaggcatctaaagccgaggatgtacactgtagccggctgtgagttgccaattagctgggctttccccactgtttctggtttggcagggatgaggtggttcaccctgccgcactactgcctgccaaggacacatggccagctcccggcttcctgtcttcctctttgtgtcctggccttgccttccagggagctgccagaacacaatt

SEQ ID NO: 61867 - DNA, 316 bp, Homo sapiens
acaccacacttaaggaatgggagttatatttcacttccctgaggccagaatatatatatgtatatatgtatatgtgtgtgtgtgtctatatatatatatatatagacacacacgcacattatacacacatatatatacacacacatatatatatgtgtgtgtacaatatataaataatttagggagaaaagacaaatctcccatgcagaaggattccaaataatttttttgtgtgtaacatatatgtgtgtgtatatatatatgcacacatatttatgtgtatatatgtatatatatatctgtatatacaagtata

SEQ ID NO: 61868 - DNA, 504 bp, Homo sapiens
cattttgagttgattttttataaaaggagagacttaggttgtggttctttttctgttggcatcgttatcaatgtccaattgcacctgcaccatttgttgttggttgaaaaggctgccctttgttaacttgcttttgcacttttgtcaaaaacaattggacatatttgtgttggtctttctttaatttttgatatttatatttaatgaaaatataaaaccttgcaatttctcattctctatgaatagatgatagatatcaatttagttaagctctttatttcaaggagagcatcagccatggtacgagctcttttttcaaaaaggcaatgggaagagttactttcccgtgagcgccttctcactaggtagagctggataaaggtggtaacaatttattcaccctcaaaagacttgggttgtgggaggcagagcttgcagtgagccgagatcgcgccactgcactccagtctaggcaacagagcaagactccatttcaaaagaaaa

SEQ ID NO: 61869 - DNA, 5181 bp, Homo sapiens
gtgtgtgcgcgcgtgaggggggcagcagagaggagtctcccggtgccgccgcggcgtcagagacactgcgagcggcgagcgcggtggggccgcatctgcatcagccgccgcagccgctgcggggccgcgaacaaagaggaggagccgaggcgcgagagcaaagtctgaaatggatgttacatgagtcattttaagggatgcacacaactatgaacatttctgaagattttttctcagtaaagtagataaagatggatgaatcagccttgttggatcttttggagtgtccggtgtgtctagagcgccttgatgcttctgcgaaggtcttgccttgccagcatacgttttgcaagcgatgtttgctggggatcgtaggttctcgaaatgaactcagatgtcccgagtgcaggactcttgttggctcgggtgtcgaggagcttcccagtaacatcttgctggtcagacttctggatggcatcaaacagaggccttggaaacctggtcctggtgggggaagtgggaccaactgcacaaatgcattaaggtctcagagcagcactgtggctaattgtagctcaaaagatctgcagagctcccagggcggacagcagcctcgggtgcaatcctggagccccccagtgaggggtatacctcagttaccatgtgccaaagcattatacaactatgaaggaaaagagcctggagaccttaaattcagcaaaggtgacatcatcattttgcgaagacaagtggatgaaaattggtaccatggggaagtcaatggaatccatggctttttccccaccaactttgtgcagattattaaaccgttacctcagcccccacctcagtgcaaagcactttatgactttgaagtgaaagacaaggaagcagacaaagattgccttccatttgcaaaggatgatgttctgactgtgatccgaagagtggatgaaaactgggctgaaggaatgctggcagacaaaataggaatatttccaatttcatatgttgagtttaactcggctgctaagcagctgatagaatgggataagcctcctgtgccaggagttgatgctggagaatgttcctcggcagcagcccagagcagcactgccccaaagcactccgacaccaagaagaacaccaaaaagcggcactccttcacttccctcactatggccaacaagtcctcccaggcatcccagaaccgccactccatggagatcagcccccctgtcctcatcagctccagcaaccccactgctgctgcacggatcagcgagctgtctgggctctcctgcagtgccccttctcaggttcatataagtaccaccgggttaattgtgaccccgcccccaagcagcccagtgacaactggcccctcgtttactttcccatcagatgttccctaccaagctgcccttggaactttgaatcctcctcttccaccaccccctctcctggctgccactgtccttgcctccacaccaccaggcgccaccgccgctgctgctgctgctggaatgggaccgaggcccatggcaggatccactgaccagattgcacatttacggccgcagactcgccccagtgtgtatgttgctatatatccatacactcctcggaaagaggatgaactagagctgagaaaaggggagatgtttttagtgtttgagcgctgccaggatggctggttcaaagggacatccatgcataccagcaagataggggttttccctggcaattatgtggcaccagtcacaagggcggtgacaaatgcttcccaagctaaagtccctatgtctacagctggccagacaagtcggggagtgaccatggtcagtccttccacggcaggagggcctgcccagaagctccagggaaatggcgtggctgggagtcccagtgttgtccccgcagctgtggtatcagcagctcacatccagacaagtcctcaggctaaggtcttgttgcacatgacggggcaaatgacagtcaaccaggcccgcaatgctgtgaggacagttgcagcgcacaaccaggaacgccccacggcagcagtgacacccatccaggtacagaatgccgccggcctcagccctgcatctgtgggcctgtcccatcactcgctggcctccccacaacctgcgcctctgatgccaggctcagccacgcacactgctgccatcagtatcagtcgagccagtgcccctctggcctgtgcagcagctgctccactgacttccccaagcatcaccagtgcttctctggaggctgagcccagtggccggatagtgaccgttctccctggactccccacatctcctgacagtgcttcatcagcttgtgggaacagttcagcaaccaaaccagacaaggatagcaaaaaagaaaaaaagggtttgttgaagttgctttctggcgcctccactaaacggaagccccgcgtgtctcctccagcatcgcccaccctagaagtggagctgggcagtgcagagcttcctctccagggagcggtggggcccgaactgccaccaggaggtggccatggcagggcaggctcctgccctgtggacggggacggaccggtcacgactgcagtggcaggagcagccctggcccaggatgcttttcataggaaggcaagttccctggactccgcagttcccatcgctccacctcctcgccaggcctgttcctccctgggtcctgtcttgaatgagtctagacctgtcgtttgtgaaaggcacagggtggtggtttcctatcctcctcagagtgaggcagaacttgaacttaaagaaggagatattgtgtttgttcataaaaaacgagaggatggctggttcaaaggcacattacaacgtaatgggaaaactggccttttcccaggaagctttgtggaaaacatatgaggagactgacactgaagaagcttaaaatcacttcacacaacaaagtagcacaaagcagtttaacagaaagagcacatttgtggacttccagatggtcaggagatgagcaaaggattggtatgtgactctgatgccccagcacagttaccccagcgagcagagtgaagaagatgtttgtgtgggttttgttagtctggattcggatgtataaggtgtgccttgtactgtctgatttactacacagagaaacttttttttttttttaagatatatgactaaaatggacaattgtttacaaggcttaactaatttatttgcttttttaaacttgaacttttcgtataatagatacgttctttggattatgattttaagaaattattaatttatgaaatgataggtaaggagaagctggattatctcctgttgagagcaagagattcgttttgacatagagtgaatgcattttcccctctcctcctccctgctaccattatattttggggttatgttttgcttctttaagatagaaatcccagttctctaatttggttttcttctttgggaaaccaaacatacaaatgaatcagtatcaattagggcctggggtagagagacagaaacttgagagaagagaagttagtgattccctctctttctagtttggtaggaatcaccctgaagacctagtcctcaatttaattgtgtgggtttttaattttcctagaatgaagtgactgaaacaatgagaaagaatacagcacaacccttgaacaaaatgtatttagaaatatatttagttttatagcagaagcagctcaattgtttggttggaaagtaggggaaattgaagttgtagtcactgtctgagaatggctatgaagcgtcatttcacattttaccccaactgacctgcatgcccaggacacaagtaaaacatttgtgagatagtggtggtaagtgatgcactcgtgttaagtcaaaggctataagaaacactgtgaaaagttcatattcatccattgtgattctttccccacgtcttgcatgtattactggattcccacagtaatatagactgtgcatggtgtgtatatttcattgcgatttcctgttaagatgagtttgtactcagaattgaccaattcaggaggtgtaaaaataaacagtgttctcttctctaccccaaagccactactgaccaaggtctcttcagtgcactcgctccctctctggctaaggcatgcattagccactacacaagtcattagtgaaagtggtcttttatgtcctcccagcagacagacatcaaggatgagttaaccaggagactactcctgtgactgtggagctctggaaggcttggtgggagtgaatttgcccacaccttacaattgtggcaggatccagaagagcctgtctttttatatccattccttgatgtcattggcctctcccaccgatttcattacggtgccacgcagtcatggatctgggtagtccggaaaacaaaaggagggaagacagcctggtaatgaataagatccttaccacagttttctcatgggaaatacataataaaccctttcatctttttttttttcctttaagaattaaaactgggaaatagaaacatgaactgaaaagtcttgcaatgacaagaggtttcatggtcttaaaaagatactttatgtggttgaagatgaaatcattcctaaattaacctttttttaaaaaaaaaacaatgtatattatgttcctgtgtgttgaatttaaaaaaaaaaatactttacttggatattcatgtaatatataaaggtttggtgaaatgaactttagttaggaaaaagctggcatcagctttcatctgtgtaagttgacaccaatgtgtcataatattctttattttgggaaattagtgtattttataaaaattttaaaaagaaaaaagactactacaggttaagataatttttttacctgtcttttctccatattttaagctatgtgatttgaagtacctctgttcatagtttcctggtataaagttggttaaaatttcatctgttaatagatcattaggtaatataatgtatgggttttctattggttttttgcagacagtagagggagattttgtaacaagggcttgttacacagtgatatggtaatgataaaattgcaatttatcactccttttcatgttaataatttgaggactggataaaaggtttcaagattaaaatttgatgttcaaaccttt

SEQ ID NO: 61870 - DNA, 3936 bp, Homo sapiens
ataggctagtacgaggccgggttgaatcggccgagggcgagctgtctgggttctcctgcagtgccccttctcaggttcatataagtaccaccgggttaattgtgaccccgcccccaagcagcccagtgacaactggcccctcgtttactttcccatcagatgttccctaccaagctgcccttggaactttgaatcctcctcttccaccaccccctctcctggctgccactgtccttgcctccacaccaccaggcgccaccgccgctgctgctgctgctggaatgggaccgaggcccatggcaggatccactgaccagattgcacatttacggccgcagactcgccccagtgtgtatgttgctatatatccatacactcctcggaaagaggatgaactagagctgagaaaaggggagatgtttttagtgtttgagcgctgccaggatggctggttcaaagggacatccatgcataccagcaagataggggttttccctggcaattatgtggcaccagtcacaagggcggtgacaaatgcttcccaagctaaagtccctatgtctacagctggccagacaagtcggggagtgaccatggtcagtccttccacggcaggagggcctgcccagaagctccagggaaatggcgtggctgggagtcccagtgttgtccccgcagctgtggtatcagcagctcacatccagacaagtcctcaggctaaggtcttgttgcacatgacggggcaaatgacagtcaaccaggcccgcaatgctgtgaggacagttgcagcgcacaaccaggaacgccccacggcagcagtgacacccatccaggtacagaatgccgccggcctcagccctgcatctgtgggcctgtcccatcactcgctggcctccccacaacctgcgcctctgatgccaggctcagccacgcacactgctgccatcagtatcagtcgagccagtgcccctctggcctgtgcagcagctgctccactgacttccccaagcatcaccagtgcttctctggaggctgagcccagtggccggatagtgaccgttctccctggactccccacatctcctgacagtgcttcatcagcttgtgggaacagttcagcaaccaaaccagacaaggatagcaaaaaagaaaaaaagggtttgttgaagttgctttctggcgcctccactaaacggaagccccgcgtgtctcctccagcatcgcccaccctagaagtggagctgggcagtgcagagcttcctctccagggagcggtggggcccgaactgccaccaggaggtggccatggcagggcaggctcctgccctgtggacggggacggaccggtcacgactgcagtggcaggagcagccctggcccaggatgcttttcataggaaggcaagttccctggactccgcagttcccatcgctccacctcctcgccaggcctgttcctccctgggtcctgtcttgaatgagtctagacctgtcgtttgtgaaaggcacagggtggtggtttcctatcctcctcagagtgaggcagaacttgaacttaaagaaggagatattgtgtttgttcataaaaaacgagaggatggctggttcaaaggcacattacaacgtaatgggaaaactggccttttcccaggaagctttgtggaaaacatatgaggagactgacactgaagaagcttaaaatcacttcacacaacaaagtagcacaaagcagtttaacagaaagagcacatttgtggacttccagatggtcaggagatgagcaaaggattggtatgtgactctgatgccccagcacagttaccccagcgagcagagtgaagaagatgtttgtgtgggttttgttagtctggattcggatgtataaggtgtgccttgtactgtctgatttactacacagagaaacttttttttttttttaagatatatgactaaaatggacaattgtttacaaggcttaactaatttatttgcttttttaaacttgaacttttcgtataatagatacgttctttggattatgattttaagaaattattaatttatgaaatgataggtaaggagaagctggattatctcctgttgagagcaagagattcgttttgacatagagtgaatgcattttcccctctcctcctccctgctaccattatattttggggttatgttttgcttctttaagatagaaatcccagttctctaatttggttttcttctttgggaaaccaaacatacaaatgaatcagtatcaattagggcctggggtagagagacagaaacttgagagaagagaagttagtgattccctctctttctagtttggtaggaatcaccctgaagacctagtcctcaatttaattgtgtgggtttttaattttcctagaatgaagtgactgaaacaatgagaaagaatacagcacaacccttgaacaaaatgtatttagaaatatatttagttttatagcagaagcagctcaattgtttggttggaaagtaggggaaattgaagttgtagtcactgtctgagaatggctatgaagcgtcatttcacattttaccccaactgacctgcatgcccaggacacaagtaaaacatttgtgagatagtggtggtaagtgatgcactcgtgttaagtcaaaggctataagaaacactgtgaaaagttcatattcatccattgtgattctttccccacgtcttgcatgtattactggattcccacagtaatatagactgtgcatggtgtgtatatttcattgcgatttcctgttaagatgagtttgtactcagaattgaccaattcaggaggtgtaaaaataaacagtgttctcttctctaccccaaagccactactgaccaaggtctcttcagtgcactcgctccctctctggctaaggcatgcattagccactacacaagtcattagtgaaagtggtcttttatgtcctcccagcagacagacatcaaggatgagttaaccaggagactactcctgtgactgtggagctctggaaggcttggtgggagtgaatttgcccacaccttacaattgtggcaggatccagaagagcctgtctttttatatccattccttgatgtcattggcctctcccaccgatttcattacggtgccacgcagtcatggatctgggtagtccggaaaacaaaaggagggaagacagcctggtaatgaataagatccttaccacagttttctcatgggaaatacataataaaccctttcatctttttttttttcctttaagaattaaaactgggaaatagaaacatgaactgaaaagtcttgcaatgacaagaggtttcatggtcttaaaaagatactttatgtggttgaagatgaaatcattcctaaattaacctttttttaaaaaaaaaacaatgtatattatgttcctgtgtgttgaatttaaaaaaaaaaatactttacttggatattcatgtaatatataaaggtttggtgaaatgaactttagttaggaaaaagctggcatcagctttcatctgtgtaagttgacaccaatgtgtcataatattctttattttgggaaattagtgtattttataaaaattttaaaaagaaaaaagactactacaggttaagataatttttttacctgtcttttctccatattttaagctatgtgatttgaagtacctctgttcatagtttcctggtataaagttggttaaaatttcatctgttaatagatcattaggtaatataatgtatgggttttctattggttttttgcagacagtagagggagattttgtaacaagggcttgttacacagtgatatggtaatgataaaattgcaatttatcactccttttcatgttaataatttgaggactggataaaaggtttcaagattaaaatttgatgttcaaaccttt

SEQ ID NO: 61871 - DNA, 4235 bp, Homo sapiens
gtgtgtgcgcgcgtgaggggggcagcagagaggagtctcccggtgccgccgcggcgtcagagacactgcgagcggcgagcgcggtggggccgcatctgcatcagccgccgcagccgctgcggggccgcgaacaaagaggaggagccgaggcgcgagagcaaagtctgaaatggatgttacatgagtcattttaagggatgcacacaactatgaacatttctgaagattttttctcagtaaagtagataaagatggatgaatcagccttgttggatcttttggagtgtccggtgtgtctagagcgccttgatgcttctgcgaaggtcttgccttgccagcatacgttttgcaagcgatgtttgctggggatcgtaggttctcgaaatgaactcagatgtcccgagtgcaggactcttgttggctcgggtgtcgaggagcttcccagtaacatcttgctggtcagacttctggatggcatcaaacagaggccttggaaacctggtcctggtgggggaagtgggaccaactgcacaaatgcattaaggtctcagagcagcactgtggctaattgtagctcaaaagatctgcagagctcccagggcggacagcagcctcgggtgcaatcctggagccccccagtgaggggtatacctcagttaccatgtgccaaagcattatacaactatgaaggaaaagagcctggagaccttaaattcagcaaaggtgacatcatcattttgcgaagacaagtggatgaaaattggtaccatggggaagtcaatggaatccatggctttttccccaccaactttgtgcagattattaaaccgttacctcagcccccacctcagtgcaaagcactttatgactttgaagtgaaagacaaggaagcagacaaagattgccttccatttgcaaaggatgatgttctgactgtgatccgaagagtggatgaaaactgggctgaaggaatgctggcagacaaaataggaatatttccaatttcatatgttgagtttaactcggctgctaagcagctgatagaatgggataagcctcctgtgccaggagttgatgctggagaatgttcctcggcagcagcccagagcagcactgccccaaagcactccgacaccaagaagaacaccaaaaagcggcactccttcacttccctcactatggccaacaagtcctcccaggcatcccagaaccgccactccatggagatcagcccccctgtcctcatcatatcagtcgagccagtgcccctctggcctgtgcagcagctgctccactgacttccccaagcatcaccagtgcttctctggaggctgagcccagtggccggatagtgaccgttctccctggactccccacatctcctgacagtgcttcatcagcttgtgggaacagttcagcaaccaaaccagacaaggatagcaaaaaagaaaaaaagggtttgttgaagttgctttctggcgcctccactaaacggaagccccgcgtgtctcctccagcatcgcccaccctagaagtggagctgggcagtgcagagcttcctctccagggagcggtggggcccgaactgccaccaggaggtggccatggcagggcaggctcctgccctgtggacggggacggaccggtcacgactgcagtggcaggagcagccctggcccaggatgcttttcataggaaggcaagttccctggactccgcagttcccatcgctccacctcctcgccaggcctgttcctccctgggtcctgtcttgaatgagtctagacctgtcgtttgtgaaaggcacagggtggtggtttcctatcctcctcagagtgaggcagaacttgaacttaaagaaggagatattgtgtttgttcataaaaaacgagaggatggctggttcaaaggcacattacaacgtaatgggaaaactggccttttcccaggaagctttgtggaaaacatatgaggagactgacactgaagaagcttaaaatcacttcacacaacaaagtagcacaaagcagtttaacagaaagagcacatttgtggacttccagatggtcaggagatgagcaaaggattggtatgtgactctgatgccccagcacagttaccccagcgagcagagtgaagaagatgtttgtgtgggttttgttagtctggattcggatgtataaggtgtgccttgtactgtctgatttactacacagagaaacttttttttttttttaagatatatgactaaaatggacaattgtttacaaggcttaactaatttatttgcttttttaaacttgaacttttcgtataatagatacgttctttggattatgattttaagaaattattaatttatgaaatgataggtaaggagaagctggattatctcctgttgagagcaagagattcgttttgacatagagtgaatgcattttcccctctcctcctccctgctaccattatattttggggttatgttttgcttctttaagatagaaatcccagttctctaatttggttttcttctttgggaaaccaaacatacaaatgaatcagtatcaattagggcctggggtagagagacagaaacttgagagaagagaagttagtgattccctctctttctagtttggtaggaatcaccctgaagacctagtcctcaatttaattgtgtgggtttttaattttcctagaatgaagtgactgaaacaatgagaaagaatacagcacaacccttgaacaaaatgtatttagaaatatatttagttttatagcagaagcagctcaattgtttggttggaaagtaggggaaattgaagttgtagtcactgtctgagaatggctatgaagcgtcatttcacattttaccccaactgacctgcatgcccaggacacaagtaaaacatttgtgagatagtggtggtaagtgatgcactcgtgttaagtcaaaggctataagaaacactgtgaaaagttcatattcatccattgtgattctttccccacgtcttgcatgtattactggattcccacagtaatatagactgtgcatggtgtgtatatttcattgcgatttcctgttaagatgagtttgtactcagaattgaccaattcaggaggtgtaaaaataaacagtgttctcttctctaccccaaagccactactgaccaaggtctcttcagtgcactcgctccctctctggctaaggcatgcattagccactacacaagtcattagtgaaagtggtcttttatgtcctcccagcagacagacatcaaggatgagttaaccaggagactactcctgtgactgtggagctctggaaggcttggtgggagtgaatttgcccacaccttacaattgtggcaggatccagaagagcctgtctttttatatccattccttgatgtcattggcctctcccaccgatttcattacggtgccacgcagtcatggatctgggtagtccggaaaacaaaaggagggaagacagcctggtaatgaataagatccttaccacagttttctcatgggaaatacataataaaccctttcatctttttttttttcctttaagaattaaaactgggaaatagaaacatgaactgaaaagtcttgcaatgacaagaggtttcatggtcttaaaaagatactttatgtggttgaagatgaaatcattcctaaattaacctttttttaaaaaaaaaacaatgtatattatgttcctgtgtgttgaatttaaaaaaaaaaatactttacttggatattcatgtaatatataaaggtttggtgaaatgaactttagttaggaaaaagctggcatcagctttcatctgtgtaagttgacaccaatgtgtcataatattctttattttgggaaattagtgtattttataaaaattttaaaaagaaaaaagactactacaggttaagataatttttttacctgtcttttctccatattttaagctatgtgatttgaagtacctctgttcatagtttcctggtataaagttggttaaaatttcatctgttaatagatcattaggtaatataatgtatgggttttctattggttttttgcagacagtagagggagattttgtaacaagggcttgttacacagtgatatggtaatgataaaattgcaatttatcactccttttcatgttaataatttgaggactggataaaaggtttcaagattaaaatttgatgttcaaaccttt

SEQ ID NO: 61872 - DNA, 1184 bp, Homo sapiens
ttctagacctgtcgttaggagtgcgtactcagaatggaactgaacatggatctttgctgttacctagtgtactcctgctcttgcctagtgcttgtatttgtccacggatattacattaaaggcgccggtcgctccctatctggtctgaacaatgtcctgatgcagtactgaggtcattagtgaatctgttcatattagagtagtcctcccggagctcgagatctcatgtgaactgcacgctgacctgggagactactcctgtgactgtggagctctggaaggcttggtgggagtgaatttgcccacaccttacaattgtggcaggatccagaagagcctgtctttttatatccattccttgatgtcattggcctctcccaccgatttcattacggtgccacgcagtcatggatctgggtagtccggaaaacaaaaggagggaagacagcctggtaatgaataagatccttaccacagttttctcatgggaaatacataataaaccctttcatctttttttttttcctttaagaattaaaactgggaaatagaaacatgaactgaaaagtcttgcaatgacaagaggtttcatggtcttaaaaagatactttatgtggttgaagatgaaatcattcctaaattaacctttttttaaaaaaaaaacaatgtatattatgttcctgtgtgttgaatttaaaaaaaaaaatactttacttggatattcatgtaatatataaaggtttggtgaaatgaactttagttaggaaaaagctggcatcagctttcatctgtgtaagttgacaccaatgtgtcataatattctttattttgggaaattagtgtattttataaaaattttaaaaagaaaaaagactactacaggttaagataatttttttacctgtcttttctccatattttaagctatgtgatttgaagtacctctgttcatagtttcctggtataaagttggttaaaatttcatctgttaatagatcattaggtaatataatgtatgggttttctattggttttttgcagacagtagagggagattttgtaacaagggcttgttacacagtgatatggtaatgataaaattgcaatttatcactccttttcatgttaataatttgaggactggataaaaggtttcaagattaaaatttgatgttcaaaccttt

SEQ ID NO: 61873 - DNA, 272 bp, Homo sapiens
taagtgcttttaggccaccgtccatcccatctttattgtaataaatacaatagcagcctttcatcatggtctgatgcagtgaaatgactcatgttttggtgagcagcatctattagatagttgaattttgctgtgttccctcttcccatctactagttgcagcgcacaaccaggaacgccccacggcagcagtgacacccatccaggtacagaatgccgccggcctcagccctgcatctgtgggcctgtcccatcactcgctggcctcccca

SEQ ID NO: 61874 - DNA, 4167 bp, Homo sapiens
tggggtgatctagaggatcccacagaggtgaatgggataagcctcctgtgccaggagttgatgctggagaatgttcctcggcagcagcccagagcagcactgccccaaagcactccgacaccaagaagaacaccaaaaagcggcactccttcacttccctcactatggccaacaagtcctcccaggcatcccagaaccgccactccatggagatcagcccccctgtcctcatcagctccagcaaccccactgctgctgcacggatcagcgagctgtctgggctctcctgcagtgccccttctcaggttcatataagtaccaccgggttaattgtgaccccgcccccaagcagcccagtgacaactggcccctcgtttactttcccatcagatgttccctaccaagctgcccttggaactttgaatcctcctcttccaccaccccctctcctggctgccactgtccttgcctccacaccaccaggcgccaccgccgctgctgctgctgctggaatgggaccgaggcccatggcaggatccactgaccagattgcacatttacggccgcagactcgccccagtgtgtatgttgctatatatccatacactcctcggaaagaggatgaactagagctgagaaaaggggagatgtttttagtgtttgagcgctgccaggatggctggttcaaagggacatccatgcataccagcaagataggggttttccctggcaattatgtggcaccagtcacaagggcggtgacaaatgcttcccaagctaaagtccctatgtctacagctggccagacaagtcggggagtgaccatggtcagtccttccacggcaggagggcctgcccagaagctccagggaaatggcgtggctgggagtcccagtgttgtccccgcagctgtggtatcagcagctcacatccagacaagtcctcaggctaaggtcttgttgcacatgacggggcaaatgacagtcaaccaggcccgcaatgctgtgaggacagttgcagcgcacaaccaggaacgccccacggcagcagtgacacccatccaggtacagaatgccgccggcctcagccctgcatctgtgggcctgtcccatcactcgctggcctccccacaacctgcgcctctgatgccaggctcagccacgcacactgctgccatcagtatcagtcgagccagtgcccctctggcctgtgcagcagctgctccactgacttccccaagcatcaccagtgcttctctggaggctgagcccagtggccggatagtgaccgttctccctggactccccacatctcctgacagtgcttcatcagcttgtgggaacagttcagcaaccaaaccagacaaggatagcaaaaaagaaaaaaagggtttgttgaagttgctttctggcgcctccactaaacggaagccccgcgtgtctcctccagcatcgcccaccctagaagtggagctgggcagtgcagagcttcctctccagggagcggtggggcccgaactgccaccaggaggtggccatggcagggcaggctcctgccctgtggacggggacggaccggtcacgactgcagtggcaggagcagccctggcccaggatgcttttcataggaaggcaagttccctggactccgcagttcccatcgctccacctcctcgccaggcctgttcctccctgggtcctgtcttgaatgagtctagacctgtcgtttgtgaaaggcacagggtggtggtttcctatcctcctcagagtgaggcagaacttgaacttaaagaaggagatattgtgtttgttcataaaaaacgagaggatggctggttcaaaggcacattacaacgtaatgggaaaactggccttttcccaggaagctttgtggaaaacatatgaggagactgacactgaagaagcttaaaatcacttcacacaacaaagtagcacaaagcagtttaacagaaagagcacatttgtggacttccagatggtcaggagatgagcaaaggattggtatgtgactctgatgccccagcacagttaccccagcgagcagagtgaagaagatgtttgtgtgggttttgttagtctggattcggatgtataaggtgtgccttgtactgtctgatttactacacagagaaacttttttttttttttaagatatatgactaaaatggacaattgtttacaaggcttaactaatttatttgcttttttaaacttgaacttttcgtataatagatacgttctttggattatgattttaagaaattattaatttatgaaatgataggtaaggagaagctggattatctcctgttgagagcaagagattcgttttgacatagagtgaatgcattttcccctctcctcctccctgctaccattatattttggggttatgttttgcttctttaagatagaaatcccagttctctaatttggttttcttctttgggaaaccaaacatacaaatgaatcagtatcaattagggcctggggtagagagacagaaacttgagagaagagaagttagtgattccctctctttctagtttggtaggaatcaccctgaagacctagtcctcaatttaattgtgtgggtttttaattttcctagaatgaagtgactgaaacaatgagaaagaatacagcacaacccttgaacaaaatgtatttagaaatatatttagttttatagcagaagcagctcaattgtttggttggaaagtaggggaaattgaagttgtagtcactgtctgagaatggctatgaagcgtcatttcacattttaccccaactgacctgcatgcccaggacacaagtaaaacatttgtgagatagtggtggtaagtgatgcactcgtgttaagtcaaaggctataagaaacactgtgaaaagttcatattcatccattgtgattctttccccacgtcttgcatgtattactggattcccacagtaatatagactgtgcatggtgtgtatatttcattgcgatttcctgttaagatgagtttgtactcagaattgaccaattcaggaggtgtaaaaataaacagtgttctcttctctaccccaaagccactactgaccaaggtctcttcagtgcactcgctccctctctggctaaggcatgcattagccactacacaagtcattagtgaaagtggtcttttatgtcctcccagcagacagacatcaaggatgagttaaccaggagactactcctgtgactgtggagctctggaaggcttggtgggagtgaatttgcccacaccttacaattgtggcaggatccagaagagcctgtctttttatatccattccttgatgtcattggcctctcccaccgatttcattacggtgccacgcagtcatggatctgggtagtccggaaaacaaaaggagggaagacagcctggtaatgaataagatccttaccacagttttctcatgggaaatacataataaaccctttcatctttttttttttcctttaagaattaaaactgggaaatagaaacatgaactgaaaagtcttgcaatgacaagaggtttcatggtcttaaaaagatactttatgtggttgaagatgaaatcattcctaaattaacctttttttaaaaaaaaaacaatgtatattatgttcctgtgtgttgaatttaaaaaaaaaaatactttacttggatattcatgtaatatataaaggtttggtgaaatgaactttagttaggaaaaagctggcatcagctttcatctgtgtaagttgacaccaatgtgtcataatattctttattttgggaaattagtgtattttataaaaattttaaaaagaaaaaagactactacaggttaagataatttttttacctgtcttttctccatattttaagctatgtgatttgaagtacctctgttcatagtttcctggtataaagttggttaaaatttcatctgttaatagatcattaggtaatataatgtatgggttttctattggttttttgcagacagtagagggagattttgtaacaagggcttgttacacagtgatatggtaatgataaaattgcaatttatcactccttttcatgttaataatttgaggactggataaaaggtttcaagattaaaatttgatgttcaaaccttt

SEQ ID NO: 61875 - DNA, 3214 bp, Homo sapiens
gtgtgtgcgcgcgtgaggggggcagcagagaggagtctcccggtgccgccgcggcgtcagagacactgcgagcggcgagcgcggtggggccgcatctgcatcagccgccgcagccgctgcggggccgcgaacaaagaggaggagccgaggcgcgagagcaaagtctgaaatggatgttacatgagtcattttaagggatgcacacaactatgaacatttctgaagattttttctcagtaaagtagataaagatggatgaatcagccttgttggatcttttggagtgtccggtgtgtctagagcgccttgatgcttctgcgaaggtcttgccttgccagcatacgttttgcaagcgatgtttgctggggatcgtaggttctcgaaatgaactcagatgtcccgagtgcaggactcttgttggctcgggtgtcgaggagcttcccagtaacatcttgctggtcagacttctggatggcatcaaacagaggccttggaaacctggtcctggtgggggaagtgggaccaactgcacaaatgcattaaggtctcagagcagcactgtggctaattgtagctcaaaagatctgcagagctcccagggcggacagcagcctcgggtgcaatcctggagccccccagtgaggggtatacctcagttaccatgtgccaaagcattatacaactatgaaggaaaagagcctggagaccttaaattcagcaaaggtgacatcatcattttgcgaagacaagtggatgaaaattggtaccatggggaagtcaatggaatccatggctttttccccaccaactttgtgcagattattaaaccgttacctcagcccccacctcagtgcaaagcactttatgactttgaagtgaaagacaaggaagcagacaaagattgccttccatttgcaaaggatgatgttctgactgtgatccgaagagtggatgaaaactgggctgaaggaatgctggcagacaaaataggaatatttccaatttcatatgttgagtttaactcggctgctaagcagctgatagaatgggataagcctcctgtgccaggagttgatgctggagaatgttcctcggcagcagcccagagcagcactgccccaaagcactccgacaccaagaagaacaccaaaaagcggcactccttcacttccctcactatggccaacaagtcctcccaggcatcccagaaccgccactccatggagatcagcccccctgtcctcatcagctccagcaaccccactgctgctgcacggatcagcgagctgtctgggctctcctgcagtgccccttctcaggttcatataagtaccaccgggttaattgtgaccccgcccccaagcagcccagtgacaactggcccctcgtttactttcccatcagatgttccctaccaagctgcccttggaactttgaatcctcctcttccaccaccccctctcctggctgccactgtccttgcctccacaccaccaggcgccaccgccgctgctgctgctgctggaatgggaccgaggcccatggcaggatccactgaccagattgcacatttacggccgcagactcgccccagtgtgtatgttgctatatatccatacactcctcggaaagaggatgaactagagctgagaaaaggggagatgtttttagtgtttgagcgctgccaggatggctggttcaaagggacatccatgcataccagcaagataggggttttccctggcaattatgtggcaccagtcacaagggcggtgacaaatgcttcccaagctaaagtccctatgtctacagctggccagacaagtcggggagtgaccatggtcagtccttccacggcaggagggcctgcccagaagctccagggaaatggcgtggctgggagtcccagtgttgtccccgcagctgtggtatcagcagctcacatccagacaagtcctcaggctaaggtcttgttgcacatgacggggcaaatgacagtcaaccaggcccgcaatgctgtgaggacagttgcagcgcacaaccaggaacgccccacggcagcagtgacacccatccaggtacagaatgccgccggcctcagccctgcatctgtgggcctgtcccatcactcgctggcctccccacaacctgcgcctctgatgccaggctcagccacgcacactgctgccatcagtatcagtcgagccagtgcccctctggcctgtgcagcagctgctccactgacttccccaagcatcaccagtgcttctctggaggctgagcccagtggccggatagtgaccgttctccctggactccccacatctcctgacagtgcttcatcagcttgtgggaacagttcagcaaccaaaccagacaaggatagcaaaaaagaaaaaaagggtttgttgaagttgctttctggcgcctccactaaacggaagccccgcgtgtctcctccagcatcgcccaccctagaagtggagctgggcagtgcagagcttcctctccagggagcggtggggcccgaactgccaccaggaggtggccatggcagggcaggctcctgccctgtggacggggacggaccggtcacgactgcagtggcaggagcagccctggcccaggatgcttttcataggaaggcaagttccctggactccgcagttcccatcgctccacctcctcgccaggcctgttcctccctgggtcctgtcttgaatgagtctagacctgtcgtttgtgaaaggcacagggtggtggtttcctatcctcctcagagtgaggcagaacttgaacttaaagaaggagatattgtgtttgttcataaaaaacgagaggatggctggttcaaaggcacattacaacgtaatgggaaaactggccttttcccaggaagctttgtggaaaacatatgaggagactgacactgaagaagcttaaaatcacttcacacaacaaagtagcacaaagcagtttaacagaaagagcacatttgtggacttccagatggtcaggagatgagcaaaggattggtatgtgactctgatgccccagcacagttaccccagcgagcagagtgaagaagatgtttgtgtgggttttgttagtctggattcggatgtataaggtgtgccttgtactgtctgatttactacacagagaaacttttttttttttttaagatatatgactaaaatggacaattgtttac

SEQ ID NO: 61876 - DNA, 850 bp, Homo sapiens
gtgtgtgcgcgcgtgaggggggcagcagagaggagtctcccggtgccgccgcggcgtcagagacactgcgagcggcgagcgcggtggggccgcatctgcatcagccgccgcagccgctgcggggccgcgaacaaagaggaggagccgaggcgcgagagcaaagtctgaaatggatgttacatgagtcattttaagggatgcacacaactatgaacatttctgaagattttttctcagtaaagtagataaagatggatgaatcagccttgttggatcttttggagtgtccggtgtgtctagagcgccttgatgcttctgcgaaggtcttgccttgccagcatacgttttgcaagcgatgtttgctggggatcgtaggttctcgaaatgaactcagatgtcccgagtgcaggactcttgttggctcgggtgtcgaggagcttcccagtaacatcttgctggtcagacttctggatggcatcaaacagaggccttggaaacctggtcctggtgggggaagtgggaccaactgcacaaatgcattaaggtctcagagcagcactgtggctaattgtagctcaaaagatctgcagagctcccagggcggacagcagcctcgggtgcaatcctggagccccccagtgagggtaagtagcctacagaggtagtttggtgaataaaggtggtaatgtccacattttttctttattctttagcttggtgttttcgaagtcaactcattgcttaggaaaccatacatactggaacagatagattatacctctgaatatttttttcccccatcttggaatgagattggatataaataataaattttattgttttgaaaatt

SEQ ID NO: 61877 - DNA, 285 bp, Homo sapiens
ctgctgcagccactgcacacggagcccctgctggctacctgggcctctgccacagcttcccatgctatgctggatgttctggtcccacttcacactaaggaaactgaggctcagggatgctaaacaacctgcatacttccacattggacagtgcccaccagggggagatggaatcagaccctttcagctgcacagcagcgtctcaatcggctccagctgctgcccaaggaagcagcaaagcccctcacccagctcaggctggagcagggacggggtggaggaggc

SEQ ID NO: 61878 - DNA, 189 bp, Homo sapiens
tctcctctctgacctcatctcctagtccttttccgcctcattcccaccagagcactctgcttcagccacagtggccttcttgccattcctcaaatacaccaagcacacttgagccttagggctccaccttaaggcctttaaactggctgtttcctctgcctgaaatgcccttcccccaatatccacgtg

SEQ ID NO: 61879 - DNA, 314 bp, Homo sapiens
ccagtaaggtagataatgatggccatccctattttacagataaaaaatctgaatcacagaagggttaagttactggtctaggtcaccagctaggaaatgagaggactgaggcttgaacccaggtggcttgttgctgaagctcattctttttctaccttgggctgccactcgaagccatggaatgcagctgagatgcctgggtgtggaacttggtgggaacagagggaacattgaaccttaaatgggtcacaaacctagataagtgagatcgggcctggtctggtacagcagttgtagaagttgcagggttcttg

SEQ ID NO: 61880 - DNA, 132 bp, Homo sapiens
tctgggcggaaggtggtgcggtgaaaggtgcagggacagactgggttagaggccactcttggtcttatcctccatggccacaacagaggtgacaaatacatgggtcactcagttatgtttagccaacagcct

SEQ ID NO: 61881 - DNA, 704 bp, Homo sapiens
tgcaataaatcttgctgctgcttgctctttaggtccacactgcctttatgagctataacagtccccgtgaaggtctgcagcttcactcctgaagccagcaagaccatgaacccaccagaaggaagaaactctgaacacgtctgaacatcagaaggaacaaactccggacacaccatctttaagaactgtaacaccgcgagggtgcgcggcttcattcttaaagtcagtgagaccaagaacccaccaattccggacacacttgcatgactccagaatgttgctacccaagtgtggggatgaacaatcaacctctgactaatgtcctattacagctctcttctttaccaaagaattaagggatgtgtctttgaagaagggttagagaaaaagagaccaggagcttcatatcatgtgcctctcacatttcttccacggattctatcgtgctgcagataaaataaaatccctatattcataatatttccattctatttctactgtaatctttcagaaagttactgttttcctgtgacatcagcgatgtgctgtaataaaattatttttatttattcaacaaatacatgttacgtgccagaaccgtttcagaaagtgtaaagaaaaagagggcattgtatctgctctcaaaaagctagtcaggaatcagaatttttactattaaaaagtcattaaatattatttattac

SEQ ID NO: 61882 - DNA, 219 bp, Homo sapiens
aagaaagactccaggtagacttagacataattctaaccttagatatattatagacccagcttggttattagtattgaaaatgctcttaaaaccaccgtgtcatatatatttcacacaagaagaaataaattgagtaaacatgtggaaaaatgttatgttcacctgttaataagcaaaaataaaaaataaaacaactcattaaattagcagactttgaaa

SEQ ID NO: 61883 - DNA, 235 bp, Homo sapiens
aaaaaaaaagaactcagcaccttccagagggagggctacatgaaatcccctctaggccacctgaagctccacttctgatatggagggaaagggcctggggaggcctcgtcccctcctcattttagagacagtgcacaggacaagatgctttagaagaatgctttaacttaaaggaatataattggatttcatcctttaacatcaaagggagtctggagaaacagctaaggccatt

SEQ ID NO: 61884 - DNA, 430 bp, Homo sapiens
agtgtatgctacacttttcctttgcaaccaaggaggaacaagctgcaagattaagttggtgctaaatcaatacagtaacacacttgaaaagggtagctacagaagcaagacttcaaagctagaagcatctggttttcagaagaattgctgtaaggacttttgataaggcaggtgtgaatccttcaagtttatataaaactgagaaggtagttttcttgtttttgttttatttttatttcaagttgaagtttagaatgagtcagtatggtgcataagacgggataaattaagtagtatttgatagtcttgaaaagcattatagagttgtagtaaggtgtatattttaagagcgtgttctattgctgttaactcatcatctgtaggaatgttttgtcaattgctttttcaaataagatggcattttattgat

SEQ ID NO: 61885 - DNA, 438 bp, Homo sapiens
ccatactggtctcgaactcctgagctcaagtgatctgcccaccttggcctcccagagtgctgggatcataggtgtgagcctgtaagtgtgggcccgccagcctctttcattcaacatgtactttcatccagattcctcgggatctgaattcctgcaggctttctatcctagaagcactggcttttccagaatctaggcctgagggcaagaacttgcttgtcatagtagtggccaagtcataaaaccatattctcttccgactagggtaggctttagggttcagcttacttcccttcttggaacttaggttgcagtatcaggctttcaacagagctaggatatgctgagtctccttgagtagaggcggcagtgggaacaacgtggtttcaggagacataaattgcacgaaaccaattaggttatttaggggaaagaaat

SEQ ID NO: 61886 - DNA, 629 bp, Homo sapiens
ggcaggatcaaaagcagctcctgcatggggacgccgtgtcctcctgctgttatcatagtatgccctgtgctcccaggaggaggctgagtcataaagggcattgtggcacctaccttgatttctcttggatcactcattctgagggaagatagctgccatgttgggaggacgtgcaagcagccctgtgaagaggtcaacacaggggggaactgaagccccttccgaacagctagcaccaacttgccagccatgtaaagtgattcaccttggaaacagatcctccagcctcagccaagccttcagatgcaacctcatgacagactctgaaccagaaacacacagccaagctgctgacccacagactttgtgagagatcataaacatttactgttgttctaagacactgttttagggtgctttgttgtacaacaatagcttactgaaaatacagagagcctagcacagtgcctgcatgtggtcatcactcaatggttgagcgagtgaatcttgcttagtattgaacactcccactgacagctaactgtaccatctctcaaaacaattcattctatctttgggcaattctgttaaagattattagaattaaattggatctttctcaatacagc

SEQ ID NO: 61887 - DNA, 430 bp, Homo sapiens
tcgaggcttggtgcagtaaggatgaaaacctggagctgctgacagctgtctgactggtggtcacatgcaggggcctatctgagggcagtggcagcacagagggaggcttggaagagagaagaaagtagggagagagtcaggaccttgtggcactctttaaccagtgaatgctagttgaaggcaatacaaccctctaggaggagtttggaaagttgtcaaggttttcaattgtctggaggatgtggttccgactggaactctttggaaaacagttggcattttctgttaaagccaaacacatacacctacccaatgtccagcaattccattccattcttaggtatatatccaacagagatgctatgaatagatgtgttcacaaaagagttgcaaaagaatgttcatagcagcctttttctctaataacaaa

SEQ ID NO: 61888 - DNA, 487 bp, Homo sapiens
gtgtctcagactctgaaacaactgaaattacgggtgcgcgctaccacgcccggctaatttttgtatttttagtagggacagggttttgccctgttgtccaggttggtcctgaactcctgacttcaagtgatctgcctgcctcagcctcccaaagtgctgggattataggcatgagccaccacacccagcctgaatcatttttgtaatttaaaaatttaacgcaaaaagaataaaacttagcaataacaaaaatgcacaaaagatggaaagaaatccacccctgacctttgtggagagatgacctctgataacagtctcagggtgaacgggcacctctgataacagtctcagggtgaacgggcatcccgagacactgttagcagaggtggtccatgtccatgctgtccgcgttacaataattacactatgtttattcttaaggttttaaaaacatttatttttaacaaattttctttgaaaagctacc

SEQ ID NO: 61889 - DNA, 3726 bp, Homo sapiens
  misc_feature (62)..(62): n is a, c, g, or t
ggcgcagtgcagagcatccaggcgagctgagcaagctgggcaaggcgcacgccacacgaganaatacggtgagcaagctgctggagaaggtgcgcaaggtcagcgtcaacgtgaagaccgtgcgcggcagcctggagcgccaggcggggcagatcaagaagctggaggtcaacgaggccgagctgctgcggcgccgcaactttaaagtcatgatctaccaggatgaagtgaagctgccggccaaactgagcatcagcaaatcgctgaaagagtcggaggccccacccggccggtcccgcacggctccgggtagccatggaggaccccacgctctatattgtcgagcggccgcttcccgggtaccccgacgccgaggccccggagccttcctccgctggggctcaggcagcggaggagccgtcgggggccggctcagaagagctgatcaagtcggaccaggtgaacggcgtgctggtgctgagcctcctggacaaaatcatcggggccgtagaccagatccagctgactcaagcacagctggaggagcggcaggcggagatggagggcgcagtgcagagcatccagggcgagctgagcaagctgggcaaggcgcacgccaccacgagcaatacggtgagcaagctgctggagaaggtgcgcaaggtcagcgtcaacgtgaagaccgtgcgcggcagcctggagcgccaggcggggcagatcaagaagctggaggtcaacgaggccgagctgctgcggcgccgcaactttaaagtcatgatctaccaggatgaagtgaagctgccggccaaactgagcatcagcaaatcgctgaaagagtcggaggcgctgccagagaaggagggcgaggagctgggcgagggcgagcggcccgaggaggacgcagcggcgctggagctttcgtcggacgaggcggtggaggttgaggaggttattgaggagtcccgcgcagagcgtatcaagcgcagcggcctgcggcgcgtggacgacttcaagaaggccttctccaaggagaagatggagaagaccaaggtgcgtacccgcgagaacctggagaagacgcgcctcaagaccaaggaaaacctggagaagacgcggcacaccctggagaagcgcatgaacaagctgggcacgcgcctggtgcccgccgagcggcgcgagaaactgaagacgtcgcgggacaagttgcgcaaatccttcacgcccgaccacgtggtgtacgcgcgctccaagaccgcggtctacaaggtgccacccttcaccttccacgtcaagaagatccgcgagggccaggtggaagtgctcaaggccaccgagatggtggaggtgggcgccgacgacgacgagggcggcgcggagcgcggggaggccggcgacctgcggcgcgggagcagccccgacgtgcacgcgctgctggagatcaccgaggagtcggacgccgtgctggtggacaagagcgacagcgactgagccgcccccgctgccacccaccccattcctcgctccttccgaacttcctctttcgcattctctctcggctcgagctggctgagatttttctaaattgaaaacacgcccccctccccacacctccaggaactccactcccagtcttagagctgttaggacccgatggggaggcagcccccgcagtggacagcccccgcttggacacagtccgagtggaatgggaagggaatggtcaatccctgtcctggttgtccaagtcgggatctcagaggaaattgcagtgattccacggttaggcccccctgggggggctgccttcccctcagcctctccccacaccacccacccagctgctgtcattccgctcactgagctcttcttcattctcaccctgatccctgggggactcaaagccaaaactgcccaaagaggaaagattgaatcctaaaggggatccttgcccccatgggaggccccctactagaaggacgtgaaagcagcttttgggggaaactgaggcagtggggaagacagagcagaatgagccctcaccctggctgggggtccagcacaggctgtatctgcagagggtcccagaggaacgctggagccaagagaagccctgggaaggaggggtggggaacgacatgcatgtgagggatggcacactgatgtgtttatgcacctgtacacaggagcgcatggccatggctttggaaaggagaatggaaaaatagaagaaggtcggccgggcttggtggcttaagcctgtaaccccagcactttgggaggccgaggtgggcggatcacctgaggtcaggagttcgggaccagcctggcaaacaccccatctctactaagcgaaaacccatctctactaaaattacaaaaattagctgggcatggttgcgcatgcctgtaatcccagctactttggaggctgaggtggggagaattgcttgaacctgggaggtggaggttgcagtgagccaaggtcgcgacactgcactccagcctgggtgacagagtgagactccatctcaacagaaggaaaaaaaaaggaaaataggagaaggtggaaatgggtgaagagagaagtcccctcactagctgcatgagaaatctatcttactgtggttctccatgggcagcaggaccatttttcagaatcaagagggaggacagtgtgagaaggcgatgatccaaagaagacagagaggtcagccccacccgatccctcaaatgggctcttggaggcacccccaggggcagcccatttctcaaagtccagaaaattagggtcccagaagggggcagcagcaggctgggagttaggagggagagcagggtgccggccctgccaccaagttgagagctggaggggaggtggggagagaacatcacagagcagccagccctggttcactcctggcagtttcttctcaagctccttccctaggagcatggtggcacgtgcctgtggtctcagctacttgggaggctgaggcgggaggatcgccagagcccaggagtttgaggctgcagtgagctatgagggtgcctctgtgctccatcctaggcaacagagtgagacgctgtttaaaaaggaaaaaatccttccctagagctagtatcctaaagctgcagagctagcccagacctcattggtttccttgtccttggggtgcttttcctgaatctttgggggtgaagggagtgttgctcccagtccagaggcctgattctgttcggactgggttctcaagacacgaccaggttctcaagacacgagtccccttgttcctccccattaaagggggtttgtcagaagcaagaacagcccctctccccagtcacagcctgaagggaggccccgagagcttcctccttccccccacctgctccttaccttctctgccctgctttttagaactgcagttcattgttttaagggattgggggagggagcctggggacacaaaccttttatacaatacaaagctttgctttttttttttttttcttccttttccctttctcggttctcttctctcctctgaatggctgaagacccctctgccgagggaggttggggattgtgggacaaggtcccttggtgctgatggcctgaaggggcctgagctgtgggcagatgcagttttctgtgggcttggggaacctctcacgttgctgtgtcctggtgagcagcccgaccaataaacctgcttttctaaaaga

SEQ ID NO: 61890 - DNA, 4221 bp, Homo sapiens
  misc_feature (4199)..(4199): n is a, c, g, or t
acctgattccgttcctcagctcgcattcctccgcccgtcccgctcccgccgccagcggaggccctagtctcccgctccaactattccaaccatcccgggaagggtggggcgctcggctcttgggtccccctccgccgccccgcctcgtcgatctccccttctaccccggtccctccctttctggggtggggccagccaatcagcgatcagactccggagtttggcccgggagctggggagctcaccgatcccccgcccagcagttctggccgctgtcccggtgcgcacggacgtggctcgagtttcctctgctctccgctctcgcccgctagctctcctcccttccgctcctgcttctctccgggtctcccgctccagctccagccccacccggccggtcccgcacggctccgggtagccatggaggaccccacgctctatattgtcgagcggccgcttcccgggtaccccgacgccgaggccccggagccttcctccgctggggctcaggcagcggaggagccgtcgggggccggctcagaagagctgatcaagtcggaccaggtgaacggcgtgctggtgctgagcctcctggacaaaatcatcggggccgtagaccagatccagctgactcaagcacagctggaggagcggcaggcggagatggagggcgcagtgcagagcatccagggcgagctgagcaagctgggcaaggcgcacgccaccacgagcaatacggtgagcaagctgctggagaaggtgcgcaaggtcagcgtcaacgtgaagaccgtgcgcggcagcctggagcgccaggcggggcagatcaagaagctggaggtcaacgaggccgagctgctgcggcgccgcaactttaaagtcatgatctaccaggatgaagtgaagctgccggccaaactgagcatcagcaaatcgctgaaagagtcggaggcgctgccagagaaggagggcgaggagctgggcgagggcgagcggcccgaggaggacgcagcggcgctggagctttcgtcggacgaggcggtggaggttgaggaggttattgaggagtcccgcgcagagcgtatcaagcgcagcggcctgcggcgcgtggacgacttcaagaaggccttctccaaggagaagatggagaagaccaaggtgcgtacccgcgagaacctggagaagacgcgcctcaagaccaaggaaaacctggagaagacgcggcacaccctggagaagcgcatgaacaagctgggcacgcgcctggtgcccgccgagcggcgcgagaaactgaagacgtcgcgggacaagttgcgcaaatccttcacgcccgaccacgtggtgtacgcgcgctccaagaccgcggtctacaaggtgccacccttcaccttccacgtcaagaagatccgcgagggccaggtggaagtgctcaaggccaccgagatggtggaggtgggcgccgacgacgacgagggcggcgcggagcgcggggaggccggcgacctgcggcgcgggagcagccccgacgtgcacgcgctgctggagatcaccgaggagtcggacgccgtgctggtggacaagagcgacagcgactgagccgcccccgctgccacccaccccattcctcgctccttccgaacttcctctttcgcattctctctcggctcgagctggctgagatttttctaaattgaaaacacgcccccctccccacacctccaggaactccactcccagtcttagagctgttaggacccgatggggaggcagcccccgcagtggacagcccccgcttggacacagtccgagtggaatgggaagggaatggtcaatccctgtcctggttgtccaagtcgggatctcagaggaaattgcagtgattccacggttaggcccccctgggggggctgccttcccctcagcctctccccacaccacccacccagctgctgtcattccgctcactgagctcttcttcattctcaccctgatccctgggggactcaaagccaaaactgcccaaagaggaaagattgaatcctaaaggggatccttgcccccatgggaggccccctactagaaggacgtgaaagcagcttttgggggaaactgaggcagtggggaagacagagcagaatgagccctcaccctggctgggggtccagcacaggctgtatctgcagagggtcccagaggaacgctggagccaagagaagccctgggaaggaggggtggggaacgacatgcatgtgagggatggcacactgatgtgtttatgcacctgtacacaggagcgcatggccatggctttggaaaggagaatggaaaaatagaagaaggtcggccgggcttggtggcttaagcctgtaaccccagcactttgggaggccgaggtgggcggatcacctgaggtcaggagttcgggaccagcctggcaaacaccccatctctactaagcgaaaacccatctctactaaaattacaaaaattagctgggcatggttgcgcatgcctgtaatcccagctactttggaggctgaggtggggagaattgcttgaacctgggaggtggaggttgcagtgagccaaggtcgcgacactgcactccagcctgggtgacagagtgagactccatctcaacagaaggaaaaaaaaaggaaaataggagaaggtggaaatgggtgaagagagaagtcccctcactagctgcatgagaaatctatcttactgtggttctccatgggcagcaggaccatttttcagaatcaagagggaggacagtgtgagaaggcgatgatccaaagaagacagagaggtcagccccacccgatccctcaaatgggctcttggaggcacccccaggggcagcccatttctcaaagtccagaaaattagggtcccagaagggggcagcagcaggctgggagttaggagggagagcagggtgccggccctgccaccaagttgagagctggaggggaggtggggagagaacatcacagagcagccagccctggttcactcctggcagtttcttctcaagctccttccctaggagcatggtggcacgtgcctgtggtctcagctacttgggaggctgaggcgggaggatcgccagagcccaggagtttgaggctgcagtgagctatgagggtgcctctgtgctccatcctaggcaacagagtgagacgctgtttaaaaaggaaaaaatccttccctagagctagtatcctaaagctgcagagctagcccagacctcattggtttccttgtccttggggtgcttttcctgaatctttgggggtgaagggagtgttgctcccagtccagaggcctgattctgttcggactgggttctcaagacacgaccaggttctcaagacacgagtccccttgttcctccccattaaagggggtttgtcagaagcaagaacagcccctctccccagtcacagcctgaagggaggccccgagagcttcctccttccccccacctgctccttaccttctctgccctgctttttagaactgcagttcattgttttaagggattgggggagggagcctggggacacaaaccttttatacaatacaaagctttgctttttttttttttttcttccttttccctttctcggttctcttctctcctctgaatggctgaagacccctctgccgagggaggttggggattgtgggacaaggtcccttggtgctgatggcctgaaggggcctgagctgtgggcagatgcagttttctgtgggcttggggaacctctcacgttgctgtgtcctggtgagcagcccgaccaataaacctgcttttctaaaagaaaaaaaataaaaaaaaaacaaagaaaacacaaacaacaaagaaaaaaaaaaaacaaaaaaaaaaaaattttgtgggcggctctgggccttggaaaaaggttttttaagacacattggggtggggcgcgcggggcccaagtcaggtcgagtgtgaacccatggggccaaagctgggacacccaaaggaagacaccggggaacaggaacacagtcgctggggatctcccacgcaaatagaaaaaaagagcgccggggggagcaacacggaagcgttctggaacaactccccgagggggcgtgtcacgaacgagcctcaaccggatgcctcaccaacaaggagtgccaaacggagtccggatatccaattnaacgccggcacggagaggagcg

SEQ ID NO: 61891 - DNA, 3255 bp, Homo sapiens
acctgattccgttcctcagctcgcattcctccgcccgtcccgctcccgccgccagcggaggccctagtctcccgctccaactattccaaccatcccgggaagggtggggcgctcggctcttgggtccccctccgccgccccgcctcgtcgatctccccttctaccccggtccctccctttctggggtggggccagccaatcagcgatcagactccggagtttggcccgggagctggggagctcaccgatcccccgcccagcagttctggccgctgtcccggtgcgcacggacgtggctcgagtttcctctgctctccgctctcgcccgctagctctcctcccttccgctcctgcttctctccgggtctcccgctccagctccagccccacccggccggtcccgcacggctccgggtagccatggaggacgcagcggcgctggagctttcgtcggacgaggcggtggaggttgaggaggttattgaggagtcccgcgcagagcgtatcaagcgcagcggcctgcggcgcgtggacgacttcaagaaggccttctccaaggagaagatggagaagaccaaggtgcgtacccgcgagaacctggagaagacgcgcctcaagaccaaggaaaacctggagaagacgcggcacaccctggagaagcgcatgaacaagctgggcacgcgcctggtgcccgccgagcggcgcgagaaactgaagacgtcgcgggacaagttgcgcaaatccttcacgcccgaccacgtggtgtacgcgcgctccaagaccgcggtctacaaggtgccacccttcaccttccacgtcaagaagatccgcgagggccaggtggaagtgctcaaggccaccgagatggtggaggtgggcgccgacgacgacgagggcggcgcggagcgcggggaggccggcgacctgcggcgcgggagcagccccgacgtgcacgcgctgctggagatcaccgaggagtcggacgccgtgctggtggacaagagcgacagcgactgagccgcccccgctgccacccaccccattcctcgctccttccgaacttcctctttcgcattctctctcggctcgagctggctgagatttttctaaattgaaaacacgcccccctccccacacctccaggaactccactcccagtcttagagctgttaggacccgatggggaggcagcccccgcagtggacagcccccgcttggacacagtccgagtggaatgggaagggaatggtcaatccctgtcctggttgtccaagtcgggatctcagaggaaattgcagtgattccacggttaggcccccctgggggggctgccttcccctcagcctctccccacaccacccacccagctgctgtcattccgctcactgagctcttcttcattctcaccctgatccctgggggactcaaagccaaaactgcccaaagaggaaagattgaatcctaaaggggatccttgcccccatgggaggccccctactagaaggacgtgaaagcagcttttgggggaaactgaggcagtggggaagacagagcagaatgagccctcaccctggctgggggtccagcacaggctgtatctgcagagggtcccagaggaacgctggagccaagagaagccctgggaaggaggggtggggaacgacatgcatgtgagggatggcacactgatgtgtttatgcacctgtacacaggagcgcatggccatggctttggaaaggagaatggaaaaatagaagaaggtcggccgggcttggtggcttaagcctgtaaccccagcactttgggaggccgaggtgggcggatcacctgaggtcaggagttcgggaccagcctggcaaacaccccatctctactaagcgaaaacccatctctactaaaattacaaaaattagctgggcatggttgcgcatgcctgtaatcccagctactttggaggctgaggtggggagaattgcttgaacctgggaggtggaggttgcagtgagccaaggtcgcgacactgcactccagcctgggtgacagagtgagactccatctcaacagaaggaaaaaaaaaggaaaataggagaaggtggaaatgggtgaagagagaagtcccctcactagctgcatgagaaatctatcttactgtggttctccatgggcagcaggaccatttttcagaatcaagagggaggacagtgtgagaaggcgatgatccaaagaagacagagaggtcagccccacccgatccctcaaatgggctcttggaggcacccccaggggcagcccatttctcaaagtccagaaaattagggtcccagaagggggcagcagcaggctgggagttaggagggagagcagggtgccggccctgccaccaagttgagagctggaggggaggtggggagagaacatcacagagcagccagccctggttcactcctggcagtttcttctcaagctccttccctaggagcatggtggcacgtgcctgtggtctcagctacttgggaggctgaggcgggaggatcgccagagcccaggagtttgaggctgcagtgagctatgagggtgcctctgtgctccatcctaggcaacagagtgagacgctgtttaaaaaggaaaaaatccttccctagagctagtatcctaaagctgcagagctagcccagacctcattggtttccttgtccttggggtgcttttcctgaatctttgggggtgaagggagtgttgctcccagtccagaggcctgattctgttcggactgggttctcaagacacgaccaggttctcaagacacgagtccccttgttcctccccattaaagggggtttgtcagaagcaagaacagcccctctccccagtcacagcctgaagggaggccccgagagcttcctccttccccccacctgctccttaccttctctgccctgctttttagaactgcagttcattgttttaagggattgggggagggagcctggggacacaaaccttttatacaatacaaagctttgctttttttttttttttcttccttttccctttctcggttctcttctctcctctgaatggctgaagacccctctgccgagggaggttggggattgtgggacaaggtcccttggtgctgatggcctgaaggggcctgagctgtgggcagatgcagttttctgtgggcttggggaacctctcacgttgctgtgtcctggtgagcagcccgaccaataaacctgcttttctaaaaga

SEQ ID NO: 61892 - DNA, 3970 bp, Homo sapiens
  misc_feature (3788)..(3788): n is a, c, g, or t
acctgattccgttcctcagctcgcattcctccgcccgtcccgctcccgccgccagcggaggccctagtctcccgctccaactattccaaccatcccgggaagggtggggcgctcggctcttgggtccccctccgccgccccgcctcgtcgatctccccttctaccccggtccctccctttctggggtggggccagccaatcagcgatcagactccggagtttggcccgggagctggggagctcaccgatcccccgcccagcagttctggccgctgtcccggtgcgcacggacgtggctcgagtttcctctgctctccgctctcgcccgctagctctcctcccttccgctcctgcttctctccgggtctcccgctccagctccagccccacccggccggtcccgcacggctccgggtagccatggaggaccccacgctctatattgtcgagcggccgcttcccgggtaccccgacgccgaggccccggagccttcctccgctggggctcaggcagcggaggagccgtcgggggccggctcagaagagctgatcaagtcggaccaggtgaacggcgtgctggtgctgagcctcctggacaaaatcatcggggccgtagaccagatccagctgactcaagcacagctggaggagcggcaggcggagatggagggcgcagtgcagagcatccagggcgagctgagcaagctgggcaaggcgcacgccaccacgagcaatacggtgagcaagctgctggagaaggtgcgcaaggtcagcgtcaacgtgaagaccgtgcgcggcagcctggagcgccaggcggggcagatcaagaagctggaggtcaacgaggccgagctgctgcggcgccgcaactttaaagtcatgatctaccaggatgaagtgaagctgccggccaaactgagcatcagcaaatcgctgaaagagtcggaggcgctgccagagaaggagggcgaggagctgggcgagggcgagcggcccgaggaggacgcagcggcgctggagctttcgtcggacgaggcggtggaggttgaggaggttattgaggagtcccgcgcagagcgtatcaagcgcagcggcctgcggcgcgtggacgacttcaagaaggccttctccaaggagaagatggagaagaccaaggtgcgtacccgcgagaacctggagaagacgcgcctcaagaccaaggaaaacctggagaagacgcggcacaccctggagaagcgcatgaacaagctgggcacgcgcctggtgcccgccgagcggcgcgagaaactgaagacgtcgcgggacaagttgcgcaaatccttcacgcccgaccacgtggtgtacgcgcgctccaagaccgcggtctacaaggtgccacccttcaccttccacgtcaagaagatccgcgagggccaggtggaagtgctcaaggccaccgagatggtggaggtgggcgccgacgacgacgagggcggcgcggagcgcggggaggccggcgacctgcggcgcgggagcagccccgacgtgcacgcgctgctggagatcaccgaggagtcggacgccgtgctggtggacaagagcgacagcgactgagccgcccccgctgccacccaccccattcctcgctccttccgaacttcctctttcgcattctctctcggctcgagctggctgagatttttctaaattgaaaacacgcccccctccccacacctccaggaactccactcccagtcttagagctgttaggacccgatggggaggcagcccccgcagtggacagcccccgcttggacacagtccgagtggaatgggaagggaatggtcaatccctgtcctggttgtccaagtcgggatctcagaggaaattgcagtgattccacggttaggcccccctgggggggctgccttcccctcagcctctccccacaccacccacccagctgctgtcattccgctcactgagctcttcttcattctcaccctgatccctgggggactcaaagccaaaactgcccaaagaggaaagattgaatcctaaaggggatccttgcccccatgggaggccccctactagaaggacgtgaaagcagcttttgggggaaactgaggcagtggggaagacagagcagaatgagccctcaccctggctgggggtccagcacaggctgtatctgcagagggtcccagaggaacgctggagccaagagaagccctgggaaggaggggtggggaacgacatgcatgtgagggatggcacactgatgtgtttatgcacctgtacacaggagcgcatggccatggctttggaaaggagaatggaaaaatagaagaaggtcggccgggcttggtggcttaagcctgtaaccccagcactttgggaggccgaggtgggcggatcacctgaggtcaggagttcgggaccagcctggcaaacaccccatctctactaagcgaaaacccatctctactaaaattacaaaaattagctgggcatggttgcgcatgcctgtaatcccagctactttggaggctgaggtggggagaattgcttgaacctgggaggtggaggttgcagtgagccaaggtcgcgacactgcactccagcctgggtgacagagtgagactccatctcaacagaaggaaaaaaaaaggaaaataggagaaggtggaaatgggtgaagagagaagtcccctcactagctgcatgagaaatctatcttactgtggttctccatgggcagcaggaccatttttcagaatcaagagggaggacagtgtgagaaggcgatgatccaaagaagacagagaggtcagccccacccgatccctcaaatgggctcttggaggcacccccaggggcagcccatttctcaaagtccagaaaattagggtcccagaagggggcagcagcaggctgggagttaggagggagagcagggtgccggccctgccaccaagttgagagctggaggggaggtggggagagaacatcacagagcagccagccctggttcactcctggcagtttcttctcaagctccttccctaggagcatggtggcacgtgcctgtggtctcagctacttgggaggctgaggcgggaggatcgccagagcccaggagtttgaggctgcagtgagctatgagggtgcctctgtgctccatcctaggcaacagagtgagacgctgtttaaaaaggaaaaaatccttccctagagctagtatcctaaagctgcagagctagcccagacctcattggtttccttgtccttggggtgcttttcctgaatctttgggggtgaagggagtgttgctcccagtccagaggcctgattctgttcggactgggttctcaagacacgaccaggttctcaagacacgagtccccttgttcctccccattaaagggggtttgtcagaagcaagaacagcccctctccccagtcacagcctgaagggaggccccgagagcttcctccttccccccacctgctccttaccttctctgccctgctttttagaactgcagttcattgttttaagggattgggggagggagcctggggacacaaaccttttatacaatacaaagctttgctttttttttttttttcttccttttccctttctcggttctcttctctcctctgaatggctgaagacccctctgccgagggaggttggggattgtgggacaaggtcccttggtgctgatggcctgaaggggcctgagctgtgggcagatgcagttttctgtgggcttggggaacctctcacggttgggtngtggtcccttgggtggagcaaggccgggaccaaataaaccgtggttttttctaaaaaaaaaacaaagcaaaaacgagaaacaagaaagcagaaaaaggaacacaaatagggagagaagaaaaagaaagagagggacacaggagaaaaggacgacacaaagagaggaaacgaaagaaggaaag

SEQ ID NO: 61893 - DNA, 2121 bp, Homo sapiens
actatggtcatagctgattcttgaggataaacctgttaggacccgatggggaggcagcccccgcagtggacagcccccgcttggacacagtccgagtggaatgggaagggaatggtcaatccctgtcctggttgtccaagtcgggatctcagaggaaattgcagtgattccacggttaggcccccctgggggggctgccttcccctcagcctctccccacaccacccacccagctgctgtcattccgctcactgagctcttcttcattctcaccctgatccctgggggactcaaagccaaaactgcccaaagaggaaagattgaatcctaaaggggatccttgcccccatgggaggccccctactagaaggacgtgaaagcagcttttgggggaaactgaggcagtggggaagacagagcagaatgagccctcaccctggctgggggtccagcacaggctgtatctgcagagggtcccagaggaacgctggagccaagagaagccctgggaaggaggggtggggaacgacatgcatgtgagggatggcacactgatgtgtttatgcacctgtacacaggagcgcatggccatggctttggaaaggagaatggaaaaatagaagaaggtcggccgggcttggtggcttaagcctgtaaccccagcactttgggaggccgaggtgggcggatcacctgaggtcaggagttcgggaccagcctggcaaacaccccatctctactaagcgaaaacccatctctactaaaattacaaaaattagctgggcatggttgcgcatgcctgtaatcccagctactttggaggctgaggtggggagaattgcttgaacctgggaggtggaggttgcagtgagccaaggtcgcgacactgcactccagcctgggtgacagagtgagactccatctcaacagaaggaaaaaaaaaggaaaataggagaaggtggaaatgggtgaagagagaagtcccctcactagctgcatgagaaatctatcttactgtggttctccatgggcagcaggaccatttttcagaatcaagagggaggacagtgtgagaaggcgatgatccaaagaagacagagaggtcagccccacccgatccctcaaatgggctcttggaggcacccccaggggcagcccatttctcaaagtccagaaaattagggtcccagaagggggcagcagcaggctgggagttaggagggagagcagggtgccggccctgccaccaagttgagagctggaggggaggtggggagagaacatcacagagcagccagccctggttcactcctggcagtttcttctcaagctccttccctaggagcatggtggcacgtgcctgtggtctcagctacttgggaggctgaggcgggaggatcgccagagcccaggagtttgaggctgcagtgagctatgagggtgcctctgtgctccatcctaggcaacagagtgagacgctgtttaaaaaggaaaaaatccttccctagagctagtatcctaaagctgcagagctagcccagacctcattggtttccttgtccttggggtgcttttcctgaatctttgggggtgaagggagtgttgctcccagtccagaggcctgattctgttcggactgggttctcaagacacgaccaggttctcaagacacgagtccccttgttcctccccattaaagggggtttgtcagaagcaagaacagcccctctccccagtcacagcctgaagggaggccccgagagcttcctccttccccccacctgctccttaccttctctgccctgctttttagaactgcagttcattgttttaagggattgggggagggagcctggggacacaaaccttttatacaatacaaagctttgctttttttttttttttcttccttttccctttctcggttctcttctctcctctgaatggctgaagacccctctgccgagggaggttggggattgtgggacaaggtcccttggtgctgatggcctgaaggggcctgagctgtgggcagatgcagttttctgtgggcttggggaacctctcacgttgctgtgtcctggtgagcagcccgaccaataaacctgcttttctaaaaga

SEQ ID NO: 61894 - DNA, 3390 bp, Homo sapiens
acctgattccgttcctcagctcgcattcctccgcccgtcccgctcccgccgccagcggaggccctagtctcccgctccaactattccaaccatcccgggaagggtggggcgctcggctcttgggtccccctccgccgccccgcctcgtcgatctccccttctaccccggtccctccctttctggggtggggccagccaatcagcgatcagactccggagtttggcccgggagctggggagctcaccgatcccccgcccagcagttctggccgctgtcccggtgcgcacggacgtggctcgagtttcctctgctctccgctctcgcccgctagctctcctcccttccgctcctgcttctctccgggtctcccgctccagctccagccccacccggccggtcccgcacggctccgggtagccatggaggaccccacgctctatattgtcgagcggccgcttcccgggtaccccgacgccgaggccccggagccttcctccgctggggctcaggcagcggaggagccgtcgggggccggctcagaagagctgatcaagtcggaccaggtgaacggcgtgctggtgctgagcctcctggacaaaatcatcggggccgtagaccagatccagctgactcaagcacagctggaggagcggcaggcggagatggagggcgcagtgcagagcatccagggcgagctgagcaagctgggcaaggcgcacgccaccacgagcaatacggtgagcaagctgctggagaaggtgcgcaaggtcagcgtcaacgtgaagaccgtgcgcggcagcctggagcgccaggcggggcagatcaagaagctggaggtcaacgaggccgagctgctgcggcgccgcaactttaaagtcatgatctaccaggatgaagtgaagctgccggccaaactgagcatcagcaaatcgctgaaagagtcggaggcgctgccagagaaggagggcgaggagctgggcgagggcgagcggcccgaggaggacgcagcggcgctggagctttcgtcggacgaggcggtggaggttgaggaggttattgaggagtcccgcgcagagcgtatcaagcgcagcggcctgcggcgcgtggacgacttcaagaaggccttctccaaggagaagatggagaagaccaaggtgcgtacccgcgagaacctggagaagacgcgcctcaagaccaaggaaaacctggagaagacgcggcacaccctggagaagcgcatgaacaagctgggcacgcgcctggtgcccgccgagcggcgcgagaaactgaagacgtcgcgggacaagttgcgcaaatccttcacgcccgaccacgtggtgtacgcgcgctccaagaccgcggtctacaaggtgccacccttcaccttccacgtcaagaagatccgcgagggccaggtggaagtgctcaaggccaccgagatggtggaggtgggcgccgacgacgacgagggcggcgcggagcgcggggaggccggcgacctgcggcgcgggagcagccccgacgtgcacgcgctgctggagatcaccgaggagtcggacgccgtgctggtggacaagagcgacagcgactgagccgcccccgctgccacccaccccattcctcgctccttccgaacttcctctttcgcattctctctcggctcgagctggctgagatttttctaaattgaaaacacgcccccctccccacacctccaggaactccactcccagtcttagagctgttaggacccgatggggaggcagcccccgcagtggacagcccccgcttggacacagtccgagtggaatgggaagggaatggtcaatccctgtcctggttgtccaagtcgggatctcagaggaaattgcagtgattccacggttaggcccccctgggggggctgccttcccctcagcctctccccacaccacccacccagctgctgtcattccgctcactgagctcttcttcattctcaccctgatccctgggggactcaaagccaaaactgcccaaagaggaaagattgaatcctaaaggggatccttgcccccatgggaggccccctactagaaggacgtgaaagcagcttttgggggaaactgaggcagtggggaagacagagcagaatgagccctcaccctggctgggggtccagcacaggctgtatctgcagagggtcccagaggaacgctggagccaagagaagccctgggaaggaggggtggggaacgacatgcatgtgagggatggcacactgatgtgtttatgcacctgtacacaggagcgcatggccatggctttggaaaggagaatggaaaaatagaagaaggtcggccgggcttggtggcttaagcctgtaaccccagcactttgggaggccgaggtgggcggatcacctgaggtcaggagttcgggaccagcctggcaaacaccccatctctactaagcgaaaacccatctctactaaaattacaaaaattagctgggcatggttgcgcatgcctgtaatcccagctactttggaggctgaggtggggagaattgcttgaacctgggaggtggaggttgcagtgagccaaggtcgcgacactgcactccagcctgggtgacagagtgagactccatctcaacagaaggaaaaaaaaaggaaaataggagaaggtggaaatgggtgaagagagaagtcccctcactagctgcatgagaaatctatcttactgtggttctccatgggcagcaggaccatttttcagaatcaagagggaggacagtgtgagaaggcgatgatccaaagaagacagagaggtcagccccacccgatccctcaaatgggctcttggaggcacccccaggggcagcccatttctcaaagtccagaaaattagggtcccagaagggggcagcagcaggctgggagttaggagggagagcagggtgccggccctgccaccaagttgagagctggaggggaggtggggagagaacatcacagagcagccagccctggttcactcctggcagtttcttctcaagctccttccctaggagcatggtggcacgtgcctgtggtctcagctacttgggaggctgaggcgggaggatcgccagagcccaggagtttgaggctgcagtgagctatgagggtgcctctgtgctccatcctaggcaacagagtgagacgctgtttaaaaaggaaaaaatccttccctagagctagtatcctaaagctgcagagctagcccagacctcattggtcccttggtgctgatggcctgaaggggcctgagctgtgggcagatgcagttttctgtgggcttggggaacctctcacgttgctgtgtcctggtgagcagcccgaccaataaacctgcttttctaaaaga

SEQ ID NO: 61895 - DNA, 1834 bp, Homo sapiens
gcctactactactactaccactaaattcgcggccgcgtcgctaaaggggatccttgcccccatgggaggccccctactagaaggacgtgaaagcagcttttgggggaaactgaggcagtggggaagacagagcagaatgagccctcaccctggctgggggtccagcacaggctgtatctgcagagggtcccagaggaacgctggagccaagagaagccctgggaaggaggggtggggaacgacatgcatgtgagggatggcacactgatgtgtttatgcacctgtacacaggagcgcatggccatggctttggaaaggagaatggaaaaatagaagaaggtcggccgggcttggtggcttaagcctgtaaccccagcactttgggaggccgaggtgggcggatcacctgaggtcaggagttcgggaccagcctggcaaacaccccatctctactaagcgaaaacccatctctactaaaattacaaaaattagctgggcatggttgcgcatgcctgtaatcccagctactttggaggctgaggtggggagaattgcttgaacctgggaggtggaggttgcagtgagccaaggtcgcgacactgcactccagcctgggtgacagagtgagactccatctcaacagaaggaaaaaaaaaggaaaataggagaaggtggaaatgggtgaagagagaagtcccctcactagctgcatgagaaatctatcttactgtggttctccatgggcagcaggaccatttttcagaatcaagagggaggacagtgtgagaaggcgatgatccaaagaagacagagaggtcagccccacccgatccctcaaatgggctcttggaggcacccccaggggcagcccatttctcaaagtccagaaaattagggtcccagaagggggcagcagcaggctgggagttaggagggagagcagggtgccggccctgccaccaagttgagagctggaggggaggtggggagagaacatcacagagcagccagccctggttcactcctggcagtttcttctcaagctccttccctaggagcatggtggcacgtgcctgtggtctcagctacttgggaggctgaggcgggaggatcgccagagcccaggagtttgaggctgcagtgagctatgagggtgcctctgtgctccatcctaggcaacagagtgagacgctgtttaaaaaggaaaaaatccttccctagagctagtatcctaaagctgcagagctagcccagacctcattggtttccttgtccttggggtgcttttcctgaatctttgggggtgaagggagtgttgctcccagtccagaggcctgattctgttcggactgggttctcaagacacgaccaggttctcaagacacgagtccccttgttcctccccattaaagggggtttgtcagaagcaagaacagcccctctccccagtcacagcctgaagggaggccccgagagcttcctccttccccccacctgctccttaccttctctgccctgctttttagaactgcagttcattgttttaagggattgggggagggagcctggggacacaaaccttttatacaatacaaagctttgctttttttttttttttcttccttttccctttctcggttctcttctctcctctgaatggctgaagacccctctgccgagggaggttggggattgtgggacaaggtcccttggtgctgatggcctgaaggggcctgagctgtgggcagatgcagttttctgtgggcttggggaacctctcacgttgctgtgtcctggtgagcagcccgaccaataaacctgcttttctaaaaga

SEQ ID NO: 61896 - DNA, 3229 bp, Homo sapiens
acctgattccgttcctcagctcgcattcctccgcccgtcccgctcccgccgccagcggaggccctagtctcccgctccaactattccaaccatcccgggaagggtggggcgctcggctcttgggtccccctccgccgccccgcctcgtcgatctccccttctaccccggtccctccctttctggggtggggccagccaatcagcgatcagactccggagtttggcccgggagctggggagctcaccgatcccccgcccagcagttctggccgctgtcccggtgcgcacggacgtggctcgagtttcctctgctctccgctctcgcccgctagctctcctcccttccgctcctgcttctctccgggtctcccgctccagctccagccccacccggccggtcccgcacggctccgggtagccatggaggaccccacgctctatattgtcgagcggccgcttcccgggtaccccgacgccgaggccccggagccttcctccgctggggctcaggcagcggaggagccgtcgggggccggctcagaagagctgatcaagtcggaccaggtgaacggcgtgctggtgctgagcctcctggacaaaatcatcggggccgtagaccagatccagctgactcaagcacagctggaggagcggcaggcggagatggagggcgcagtgcagagcatccagggcgagctgagcaagctgggcaaggcgcacgccaccacgagcaatacggtgagcaagctgctggagaaggtgcgcaaggtcagcgtcaacgtgaagaccgtgcgcggcagcctggagcgccaggcggggcagatcaagaagctggaggtcaacgaggccgagctgctgcggcgccgcaactttaaagtcatgatctaccaggatgaagtgaagctgccggccaaactgagcatcagcaaatcgctgaaagagtcggaggcgctgccagagaaggagggcgaggagctgggcgagggcgagcggcccgaggaggacgcagcggcgctggagctttcgtcggacgaggcggtggaggttgaggaggttattgaggagtcccgcgcagagcgtatcaagcgcagcggcctgcggcgcgtggacgacttcaagaaggccttctccaaggagaagatggagaagaccaaggtgcgtacccgcgagaacctggagaagacgcgcctcaagaccaaggaaaacctggagaagacgcggcacaccctggagaagcgcatgaacaagctgggcacgcgcctggtgcccgccgagcggcgcgagaaactgaagacgtcgcgggacaagttgcgcaaatccttcacgcccgaccacgtggtgtacgcgcgctccaagaccgcggtctacaaggtgccacccttcaccttccacgtcaagaagatccgcgagggccaggtggaagtgctcaaggccaccgagatggtggaggtgggcgccgacgacgacgagggcggcgcggagcgcggggaggccggcgacctgcggcgcgggagcagccccgacgtgcacgcgctgctggagatcaccgaggagtcggacgccgtgctggtggacaagagcgacagcgactgagccgcccccgctgccacccaccccattcctcgctccttccgaacttcctctttcgcattctctctcggctcgagctggctgagatttttctaaattgaaaacacgcccccctccccacacctccaggaactccactcccagtcttagagctgttaggacccgatggggaggcagcccccgcagtggacagcccccgcttggacacagtccgagtggaatgggaagggaatggtcaatccctgtcctggttgtccaagtcgggatctcagaggaaattgcagtgattccacggttaggcccccctgggggggctgccttcccctcagcctctccccacaccacccacccagctgctgtcattccgctcactgagctcttcttcattctcaccctgatccctgggggactcaaagccaaaactgcccaaagaggaaagattgaatcctaaaggggatccttgcccccatgggaggccccctactagaaggacgtgaaagcagcttttgggggaaactgaggcagtggggaagacagagcagaatgagccctcaccctggctgggggtccagcacaggctgtatctgcagagggtcccagaggaacgctggagccaagagaagccctgggaaggaggggtggggaacgacatgcatgtgagggatggcacactgatgtgtttatgcacctgtacacaggagcgcatggccatggctttggaaaggagaatggaaaaatagaagaaggtcggccgggcttggtggcttaagcctgtaaccccagcactttgggaggccgaggtgggcggatcacctgaggtcaggagttcgggaccagcctggcaaacaccccatctctactaagcgaaaacccatctctactaaaattacaaaaattagctgggcatggttgcgcatgcctgtaatcccagctactttggaggctgaggtggggagaattgcttgaacctgggaggtggaggttgcagtgagccaaggtcgcgacactgcactccagcctgggtgacagagtgagactccatctcaacagaaggaaaaaaaaaggaaaataggagaaggtggaaatgggtgaagagagaagtcccctcactagctgcatgagaaatctatcttactgtggttctccatgggcagcaggaccatttttcagaatcaagagggaggacagtgtgagaaggcgatgatccaaagaagacagagaggtcagccccacccgatccctcaaatgggctcttggaggcacccccaggggcagcccatttctcaaagtccagaaaattagggtcccagaagggggcagcagcaggctgggagttaggagggagagcagggtgccggccctgccaccaagttgagagctggaggggaggtggggagagaacatcacagagcagccagccctggttcactcctggcagtttcttctcaagctccttccctaggagcatggtggcacgtgcctgtggtctcagctacttgggaggctgaggcgggaggatcgccagagcccaggagtttgaggctgcagtgagctatgagggtgcctctgtgctccatcctaggcaacagagtgagacgctgtttaaaaactcagcataagagatacactacgcaccatt

SEQ ID NO: 61897 - DNA, 1418 bp, Homo sapiens
ctcccttccaccagctggcacctcccttccaccagcctaagcgaaaacccatctctactaaaattacaaaaattagctgggcatggttgcgcatgcctgtaatcccagctactttggaggctgaggtggggagaattgcttgaacctgggaggtggaggttgcagtgagccaaggtcgcgacactgcactccagcctgggtgacagagtgagactccatctcaacagaaggaaaaaaaaaggaaaataggagaaggtggaaatgggtgaagagagaagtcccctcactagctgcatgagaaatctatcttactgtggttctccatgggcagcaggaccatttttcagaatcaagagggaggacagtgtgagaaggcgatgatccaaagaagacagagaggtcagccccacccgatccctcaaatgggctcttggaggcacccccaggggcagcccatttctcaaagtccagaaaattagggtcccagaagggggcagcagcaggctgggagttaggagggagagcagggtgccggccctgccaccaagttgagagctggaggggaggtggggagagaacatcacagagcagccagccctggttcactcctggcagtttcttctcaagctccttccctaggagcatggtggcacgtgcctgtggtctcagctacttgggaggctgaggcgggaggatcgccagagcccaggagtttgaggctgcagtgagctatgagggtgcctctgtgctccatcctaggcaacagagtgagacgctgtttaaaaaggaaaaaatccttccctagagctagtatcctaaagctgcagagctagcccagacctcattggtttccttgtccttggggtgcttttcctgaatctttgggggtgaagggagtgttgctcccagtccagaggcctgattctgttcggactgggttctcaagacacgaccaggttctcaagacacgagtccccttgttcctccccattaaagggggtttgtcagaagcaagaacagcccctctccccagtcacagcctgaagggaggccccgagagcttcctccttccccccacctgctccttaccttctctgccctgctttttagaactgcagttcattgttttaagggattgggggagggagcctggggacacaaaccttttatacaatacaaagctttgctttttttttttttttcttccttttccctttctcggttctcttctctcctctgaatggctgaagacccctctgccgagggaggttggggattgtgggacaaggtcccttggtgctgatggcctgaaggggcctgagctgtgggcagatgcagttttctgtgggcttggggaacctctcacgttgctgtgtcctggtgagcagcccgaccaataaacctgcttttctaaaaga

SEQ ID NO: 61898 - DNA, 1329 bp, Homo sapiens
ggacgcgtgggtccggacgcgtgggtcgacccacgcgtggggagaattgcttgaacctgggaggtggaggttgcagtgagccaaggtcgcgacactgcactccagcctgggtgacagagtgagactccatctcaacagaaggaaaaaaaaaggaaaataggagaaggtggaaatgggtgaagagagaagtcccctcactagctgcatgagaaatctatcttactgtggttctccatgggcagcaggaccatttttcagaatcaagagggaggacagtgtgagaaggcgatgatccaaagaagacagagaggtcagccccacccgatccctcaaatgggctcttggaggcacccccaggggcagcccatttctcaaagtccagaaaattagggtcccagaagggggcagcagcaggctgggagttaggagggagagcagggtgccggccctgccaccaagttgagagctggaggggaggtggggagagaacatcacagagcagccagccctggttcactcctggcagtttcttctcaagctccttccctaggagcatggtggcacgtgcctgtggtctcagctacttgggaggctgaggcgggaggatcgccagagcccaggagtttgaggctgcagtgagctatgagggtgcctctgtgctccatcctaggcaacagagtgagacgctgtttaaaaaggaaaaaatccttccctagagctagtatcctaaagctgcagagctagcccagacctcattggtttccttgtccttggggtgcttttcctgaatctttgggggtgaagggagtgttgctcccagtccagaggcctgattctgttcggactgggttctcaagacacgaccaggttctcaagacacgagtccccttgttcctccccattaaagggggtttgtcagaagcaagaacagcccctctccccagtcacagcctgaagggaggccccgagagcttcctccttccccccacctgctccttaccttctctgccctgctttttagaactgcagttcattgttttaagggattgggggagggagcctggggacacaaaccttttatacaatacaaagctttgctttttttttttttttcttccttttccctttctcggttctcttctctcctctgaatggctgaagacccctctgccgagggaggttggggattgtgggacaaggtcccttggtgctgatggcctgaaggggcctgagctgtgggcagatgcagttttctgtgggcttggggaacctctcacgttgctgtgtcctggtgagcagcccgaccaataaacctgcttttctaaaaga

SEQ ID NO: 61899 - DNA, 2669 bp, Homo sapiens
acctgattccgttcctcagctcgcattcctccgcccgtcccgctcccgccgccagcggaggccctagtctcccgctccaactattccaaccatcccgggaagggtggggcgctcggctcttgggtccccctccgccgccccgcctcgtcgatctccccttctaccccggtccctccctttctggggtggggccagccaatcagcgatcagactccggagtttggcccgggagctggggagctcaccgatcccccgcccagcagttctggccgctgtcccggtgcgcacggacgtggctcgagtttcctctgctctccgctctcgcccgctagctctcctcccttccgctcctgcttctctccgggtctcccgctccagctccagccccacccggccggtcccgcacggctccgggtagccatggaggaccccacgctctatattgtcgagcggccgcttcccgggtaccccgacgccgaggccccggagccttcctccgctggggctcaggcagcggaggagccgtcgggggccggctcagaagagctgatcaagtcggaccaggtgaacggcgtgctggtgctgagcctcctggacaaaatcatcggggccgtagaccagatccagctgactcaagcacagctggaggagcggcaggcggagatggagggcgcagtgcagagcatccagggcgagctgagcaagctgggcaaggcgcacgccaccacgagcaatacggtgagcaagctgctggagaaggtgcgcaaggtcagcgtcaacgtgaagaccgtgcgcggcagcctggagcgccaggcggggcagatcaagaagctggaggtcaacgaggccgagctgctgcggcgccgcaactttaaagtcatgatctaccaggatgaagtgaagctgccggccaaactgagcatcagcaaatcgctgaaagagtcggaggcgctgccagagaaggagggcgaggagctgggcgagggcgagcggcccgaggaggacgcagcggcgctggagctttcgtcggacgaggcggtggaggttgaggaggttattgaggagtcccgcgcagagcgtatcaagcgcagcggcctgcggcgcgtggacgacttcaagaaggccttctccaaggagaagatggagaagaccaaggtgcgtacccgcgagaacctggagaagacgcgcctcaagaccaaggaaaacctggagaagacgcggcacaccctggagaagcgcatgaacaagctgggcacgcgcctggtgcccgccgagcggcgcgagaaactgaagacgtcgcgggacaagttgcgcaaatccttcacgcccgaccacgtggtgtacgcgcgctccaagaccgcggtctacaaggtgccacccttcaccttccacgtcaagaagatccgcgagggccaggtggaagtgctcaaggccaccgagatggtggaggtgggcgccgacgacgacgagggcggcgcggagcgcggggaggccggcgacctgcggcgcgggagcagccccgacgtgcacgcgctgctggagatcaccgaggagtcggacgccgtgctggtggacaagagcgacagcgactgagccgcccccgctgccacccaccccattcctcgctccttccgaacttcctctttcgcattctctctcggctcgagctggctgagatttttctaaattgaaaacacgcccccctccccacacctccaggaactccactcccagtcttagagctgttaggacccgatggggaggcagcccccgcagtggacagcccccgcttggacacagtccgagtggaatgggaagggaatggtcaatccctgtcctggttgtccaagtcgggatctcagaggaaattgcagtgattccacggttaggcccccctgggggggctgccttcccctcagcctctccccacaccacccacccagctgctgtcattccgctcactgagctcttcttcattctcaccctgatccctgggggactcaaagccaaaactgcccaaagaggaaagattgaatcggaaaaaatccttccctagagctagtatcctaaagctgcagagctagcccagacctcattggtttccttgtccttggggtgcttttcctgaatctttgggggtgaagggagtgttgctcccagtccagaggcctgattctgttcggactgggttctcaagacacgaccaggttctcaagacacgagtccccttgttcctccccattaaagggggtttgtcagaagcaagaacagcccctctccccagtcacagcctgaagggaggccccgagagcttcctccttccccccacctgctccttaccttctctgccctgctttttagaactgcagttcattgttttaagggattgggggagggagcctggggacacaaaccttttatacaatacaaagctttgctttttttttttttttcttccttttccctttctcggttctcttctctcctctgaatggctgaagacccctctgccgagggaggttggggattgtgggacaaggtcccttggtgctgatggcctgaaggggcctgagctgtgggcagatgcagttttctgtgggcttggggaacctctcacgttgctgtgtcctggtgagcagcccgaccaataaacctgcttttctaaaaga

SEQ ID NO: 61900 - DNA, 1192 bp, Homo sapiens
tgcgaatcgtggtgctgctcctgggctcttaggcacatcatttcagatggaggttgcagctgtcctggggatgtggccaaggcttttggggcaggagctgacttcgtgatgctgggtggcatgctggctttgagtcccccagggatcagggtgagaatgaagaagagctcagtgagcggaatgacagcagctgggtgggtggtgtggggagaggctgaggggaaggcggatttctcaaagtccagaaaattagggtcccagaagggggcagcagcaggctgggagttaggagggagagcagggtgccggccctgccaccaagttgagagctggaggggaggtggggagagaacatcacagagcagccagccctggttcactcctggcagtttcttctcaagctccttccctaggagcatggtggcacgtgcctgtggtctcagctacttgggaggctgaggcgggaggatcgccagagcccaggagtttgaggctgcagtgagctatgagggtgcctctgtgctccatcctaggcaacagagtgagacgctgtttaaaaaggaaaaaatccttccctagagctagtatcctaaagctgcagagctagcccagacctcattggtttccttgtccttggggtgcttttcctgaatctttgggggtgaagggagtgttgctcccagtccagaggcctgattctgttcggactgggttctcaagacacgaccaggttctcaagacacgagtccccttgttcctccccattaaagggggtttgtcagaagcaagaacagcccctctccccagtcacagcctgaagggaggccccgagagcttcctccttccccccacctgctccttaccttctctgccctgctttttagaactgcagttcattgttttaagggattgggggagggagcctggggacacaaaccttttatacaatacaaagctttgctttttttttttttttcttccttttccctttctcggttctcttctctcctctgaatggctgaagacccctctgccgagggaggttggggattgtgggacaaggtcccttggtgctgatggcctgaaggggcctgagctgtgggcagatgcagttttctgtgggcttggggaacctctcacgttgctgtgtcctggtgagcagcccgaccaataaacctgcttttctaaaaga

SEQ ID NO: 61901 - DNA, 960 bp, Homo sapiens
gatctccttgaggatcccaagctctggaaaagggggcagcagcaggctgggagttaggagggagagcagggtgccggccctgccaccaagttgagagctggaggggaggtggggagagaacatcacagagcagccagccctggttcactcctggcagtttcttctcaagctccttccctaggagcatggtggcacgtgcctgtggtctcagctacttgggaggctgaggcgggaggatcgccagagcccaggagtttgaggctgcagtgagctatgagggtgcctctgtgctccatcctaggcaacagagtgagacgctgtttaaaaaggaaaaaatccttccctagagctagtatcctaaagctgcagagctagcccagacctcattggtttccttgtccttggggtgcttttcctgaatctttgggggtgaagggagtgttgctcccagtccagaggcctgattctgttcggactgggttctcaagacacgaccaggttctcaagacacgagtccccttgttcctccccattaaagggggtttgtcagaagcaagaacagcccctctccccagtcacagcctgaagggaggccccgagagcttcctccttccccccacctgctccttaccttctctgccctgctttttagaactgcagttcattgttttaagggattgggggagggagcctggggacacaaaccttttatacaatacaaagctttgctttttttttttttttcttccttttccctttctcggttctcttctctcctctgaatggctgaagacccctctgccgagggaggttggggattgtgggacaaggtcccttggtgctgatggcctgaaggggcctgagctgtgggcagatgcagttttctgtgggcttggggaacctctcacgttgctgtgtcctggtgagcagcccgaccaataaacctgcttttctaaaaga

SEQ ID NO: 61902 - DNA, 807 bp, Homo sapiens
acgggcggctaataatactaaattcgcgggccgttgacgcacgtgcctgtggtctcagctacttgggaggctgaggcgggaggatcgccagagcccaggagtttgaggctgcagtgagctatgagggtgcctctgtgctccatcctaggcaacagagtgagacgctgtttaaaaaggaaaaaatccttccctagagctagtatcctaaagctgcagagctagcccagacctcattggtttccttgtccttggggtgcttttcctgaatctttgggggtgaagggagtgttgctcccagtccagaggcctgattctgttcggactgggttctcaagacacgaccaggttctcaagacacgagtccccttgttcctccccattaaagggggtttgtcagaagcaagaacagcccctctccccagtcacagcctgaagggaggccccgagagcttcctccttccccccacctgctccttaccttctctgccctgctttttagaactgcagttcattgttttaagggattgggggagggagcctggggacacaaaccttttatacaatacaaagctttgctttttttttttttttcttccttttccctttctcggttctcttctctcctctgaatggctgaagacccctctgccgagggaggttggggattgtgggacaaggtcccttggtgctgatggcctgaaggggcctgagctgtgggcagatgcagttttctgtgggcttggggaacctctcacgttgctgtgtcctggtgagcagcccgaccaataaacctgcttttctaaaaga

SEQ ID NO: 61903 - DNA, 2388 bp, Homo sapiens
  misc_feature (2366)..(2366): n is a, c, g, or t
acctgattccgttcctcagctcgcattcctccgcccgtcccgctcccgccgccagcggaggccctagtctcccgctccaactattccaaccatcccgggaagggtggggcgctcggctcttgggtccccctccgccgccccgcctcgtcgatctccccttctaccccggtccctccctttctggggtggggccagccaatcagcgatcagactccggagtttggcccgggagctggggagctcaccgatcccccgcccagcagttctggccgctgtcccggtgcgcacggacgtggctcgagtttcctctgctctccgctctcgcccgctagctctcctcccttccgctcctgcttctctccgggtctcccgctccagctccagccccacccggccggtcccgcacggctccgggtagccatggaggaccccacgctctatattgtcgagcggccgcttcccgggtaccccgacgccgaggccccggagccttcctccgctggggctcaggcagcggaggagccgtcgggggccggctcagaagagctgatcaagtcggaccaggtgaacggcgtgctggtgctgagcctcctggacaaaatcatcggggccgtagaccagatccagctgactcaagcacagctggaggagcggcaggcggagatggagggcgcagtgcagagcatccagggcgagctgagcaagctgggcaaggcgcacgccaccacgagcaatacggtgagcaagctgctggagaaggtgcgcaaggtcagcgtcaacgtgaagaccgtgcgcggcagcctggagcgccaggcggggcagatcaagaagctggaggtcaacgaggccgagctgctgcggcgccgcaactttaaagtcatgatctaccaggatgaagtgaagctgccggccaaactgagcatcagcaaatcgctgaaagagtcggaggcgctgccagagaaggagggcgaggagctgggcgagggcgagcggcccgaggaggacgcagcggcgctggagctttcgtcggacgaggcggtggaggttgaggaggttattgaggagtcccgcgcagagcgtatcaagcgcagcggcctgcggcgcgtggacgacttcaagaaggccttctccaaggagaagatggagaagaccaaggtgcgtacccgcgagaacctggagaagacgcgcctcaagaccaaggaaaacctggagaagacgcggcacaccctggagaagcgcatgaacaagctgggcacgcgcctggtgcccgccgagcggcgcgagaaactgaagacgtcgcgggacaagttgcgcaaatccttcacgcccgaccacgtggtgtacgcgcgctccaagaccgcggtctacaaggtgccacccttcaccttccacgtcaagaagatccgcgagggccaggtggaagtgctcaaggccaccgagatggtggaggtgggcgccgacgacgacgagggcggcgcggagcgcggggaggccggcgacctgcggcgcgggagcagccccgacgtgcacgcgctgctggagatcaccgaggagtcggacgccgtgctggtggacaagagcgacagcgactgagccgcccccgctgccacccaccccattcctcgctccttccgaacttcctctttcgcattctctctcggctcgagctggctgagatttttctaaattgaaaacacgcccccctccccacacctccaggaactccactcccagtcttagagctgttaggacccgatggggaggcagcccccgcagtggacagcccccgcttggacacagtccgagtggaatgggaagggaatggtcaatccctgtcctggttgtccaagtcgggatctcagaggaaattgcagtgattccacggttaggcccccctgggggggctgccttcccctcagcctctccccacaccacccacccagctgctgtcattccgctcactgagctcttcttcattctcaccctgatccctgggggactcaaagccaaaactgcccaaagaggaaagattgaatcagaaaaaaaaaaaacaaaaaaaaaaaaattttgtgggcggctctgggccttggaaaaaggttttttaagacacattggggtggggcgcgcggggcccaagtcaggtcgagtgtgaacccatggggccaaagctgggacacccaaaggaagacaccggggaacaggaacacagtcgctggggatctcccacgcaaatagaaaaaaagagcgccggggggagcaacacggaagcgttctggaacaactccccgagggggcgtgtcacgaacgagcctcaaccggatgcctcaccaacaaggagtgccaaacggagtccggatatccaattnaacgccggcacggagaggagcg

SEQ ID NO: 61904 - DNA, 635 bp, Homo sapiens
tcggtacccgactctctgtggggggcaactgttgccactgctgctgttgttcaagaggcttctagtttccttgtccttggggtgcttttcctgaatctttgggggtgaagggagtgttgctcccagtccagaggcctgattctgttcggactgggttctcaagacacgaccaggttctcaagacacgagtccccttgttcctccccattaaagggggtttgtcagaagcaagaacagcccctctccccagtcacagcctgaagggaggccccgagagcttcctccttccccccacctgctccttaccttctctgccctgctttttagaactgcagttcattgttttaagggattgggggagggagcctggggacacaaaccttttatacaatacaaagctttgctttttttttttttttcttccttttccctttctcggttctcttctctcctctgaatggctgaagacccctctgccgagggaggttggggattgtgggacaaggtcccttggtgctgatggcctgaaggggcctgagctgtgggcagatgcagttttctgtgggcttggggaacctctcacgttgctgtgtcctggtgagcagcccgaccaataaacctgcttttctaaaaga

SEQ ID NO: 61905 - DNA, 373 bp, Homo sapiens
cccctcttaatgtgtgcccaggctgccccccacctgctccttaccttctctgccctgctttttagaactgcagttcattgttttaagggattgggggagggagcctggggacacaaaccttttatacaatacaaagctttgctttttttttttttttcttccttttccctttctcggttctcttctctcctctgaatggctgaagacccctctgccgagggaggttggggattgtgggacaaggtcccttggtgctgatggcctgaaggggcctgagctgtgggcagatgcagttttctgtgggcttggggaacctctcacgttgctgtgtcctggtgagcagcccgaccaataaacctgcttttctaaaaga

SEQ ID NO: 61906 - DNA, 930 bp, Homo sapiens
acctgattccgttcctcagctcgcattcctccgcccgtcccgctcccgccgccagcggaggccctagtctcccgctccaactattccaaccatcccgggaagggtggggcgctcggctcttgggtccccctccgccgccccgcctcgtcgatctccccttctaccccggtccctccctttctggggtggggccagccaatcagcgatcagactccggagtttggcccgggagctggggagctcaccgatcccccgcccagcagttctggccgctgtcccggtgcgcacggacgtggctcgagtttcctctgctctccgctctcgcccgctagctctcctcccttccgctcctgcttctctccgggtctcccgctccagctccagccccacccggccggtcccgcacggctccgggtagccatggaggaccccacgctctatattgtcgagcggccgcttcccgggtaccccgacgccgaggccccggagccttcctccgctggggctcaggcagcggaggagccgtcgggggccggctcagaagagctgatcaagtcggaccaggtgaacggcgtgctggtgctgagcctcctggacaaaatcatcggggccgtagaccagatccagctgactcaagcacagctggaggagcggcaggcggagatggagggcgcagtgcagagcatccagggcgagctgagcaagctgggcaaggcgcacgccaccacgagcaatacggtgagcaagctgctggagaaggtgcgcaaggtcagcgtcaacgtgaagaccgtgcgcggcagcctggagcgccaggcggggcagatcaagaagctggaggtcaacgaggccgagctgctgcggcgccgcaactttaaagtcatgatctaccaggatgaagtgaagctgccgcgcacgcctcgtgccgaattc

SEQ ID NO: 61907 - DNA, 3831 bp, Homo sapiens
acctgattccgttcctcagctcgcattcctccgcccgtcccgctcccgccgccagcggaggccctagtctcccgctccaactattccaaccatcccgggaagggtggggcgctcggctcttgggtccccctccgccgccccgcctcgtcgatctccccttctaccccggtccctccctttctggggtggggccagccaatcagcgatcagactccggagtttggcccgggagctggggagctcaccgatcccccgcccagcagttctggccgctgtcccggtgcgcacggacgtggctcgagtttcctctgctctccgctctcgcccgctagctctcctcccttccgctcctgcttctctccgggtctcccgctccagctccagccccacccggccggtcccgcacggctccgggtagccatggaggaccccacgctctatattgtcgagcggccgcttcccgggtaccccgacgccgaggccccggagccttcctccgctggggctcaggcagcggaggagccgtcgggggccggctcagaagagctgatcaagtcggaccaggtgaacggcgtgctggtgctgagcctcctggacaaaatcatcggggccgtagaccagatccagctgactcaagcacagctggaggagcggcaggcggagatggagggcgcagtgcagagcatccagggcgagctgagcaagctgggcaaggcgcacgccaccacgagcaatacggtgagcaagctgctggagaaggtgcgcaaggtcagcgtcaacgtgaagaccgtgcgcggcagcctggagcgccaggcggggcagatcaagaagctggaggtcaacgaggccgagctgctgcggcgccgcaactttaaagtcatgatctaccaggatgaagtgaagctgccggccaaactgagcatcagcaaatcgctgaaagagtcggaggcgctgccagagaaggagggcgaggagctgggcgagggcgagcggcccgaggaggacgcagcggcgctggagctttcgtcggacgaggcggtggaggttgaggaggttattgaggagtcccgcgcagagcgtatcaagcgcagcggcctgcggcgcgtggacgacttcaagaaggccttctccaaggagaagatggagaagaccaaggtgcgtacccgcgagaacctggagaagacgcgcctcaagaccaaggaaaacctggagaagacgcggcacaccctggagaagcgcatgaacaagctgggcacgcgcctggtgcccgccgagcggcgcgagaaactgaagacgtcgcgggacaagttgcgcaaatccttcacgcccgaccacgtggtgtacgcgcgctccaagaccgcggtctacaaggtgccacccttcaccttccacgtcaagaagatccgcgagggccaggtggaagtgctcaaggccaccgagatggtggaggtgggcgccgacgacgacgagggcggcgcggagcgcggggaggccggcgacctgcggcgcgggagcagccccgacgtgcacgcgctgctggagatcaccgaggagtcggacgccgtgctggtggacaagagcgacagcgactgagccgcccccgctgccacccaccccattcctcgctccttccgaacttcctctttcgcattctctctcggctcgagctggctgagatttttctaaattgaaaacacgcccccctccccacacctccaggaactccactcccagtcttagagctgttaggacccgatggggaggcagcccccgcagtggacagcccccgcttggacacagtccgagtggaatgggaagggaatggtcaatccctgtcctggttgtccaagtcgggatctcagaggaaattgcagtgattccacggttaggcccccctgggggggctgccttcccctcagcctctccccacaccacccacccagctgctgtcattccgctcactgagctcttcttcattctcaccctgatccctgggggactcaaagccaaaactgcccaaagaggaaagattgaatcctaaaggggatccttgcccccatgggaggccccctactagaaggacgtgaaagcagcttttgggggaaactgaggcagtggggaagacagagcagaatgagccctcaccctggctgggggtccagcacaggctgtatctgcagagggtcccagaggaacgctggagccaagagaagccctgggaaggaggggtggggaacgacatgcatgtgagggatggcacactgatgtgtttatgcacctgtacacaggagcgcatggccatggctttggaaaggagaatggaaaaatagaagaaggtcggccgggcttggtggcttaagcctgtaaccccagcactttgggaggccgaggtgggcggatcacctgaggtcaggagttcgggaccagcctggcaaacaccccatctctactaagcgaaaacccatctctactaaaattacaaaaattagctgggcatggttgcgcatgcctgtaatcccagctactttggaggctgaggtggggagaattgcttgaacctgggaggtggaggttgcagtgagccaaggtcgcgacactgcactccagcctgggtgacagagtgagactccatctcaacagaaggaaaaaaaaaggaaaataggagaaggtggaaatgggtgaagagagaagtcccctcactagctgcatgagaaatctatcttactgtggttctccatgggcagcaggaccatttttcagaatcaagagggaggacagtgtgagaaggcgatgatccaaagaagacagagaggtcagccccacccgatccctcaaatgggctcttggaggcacccccaggggcagcccatttctcaaagtccagaaaattagggtcccagaagggggcagcagcaggctgggagttaggagggagagcagggtgccggccctgccaccaagttgagagctggaggggaggtggggagagaacatcacagagcagccagccctggttcactcctggcagtttcttctcaagctccttccctaggagcatggtggcacgtgcctgtggtctcagctacttgggaggctgaggcgggaggatcgccagagcccaggagtttgaggctgcagtgagctatgagggtgcctctgtgctccatcctaggcaacagagtgagacgctgtttaaaaaggaaaaaatccttccctagagctagtatcctaaagctgcagagctagcccagacctcattggtttccttgtccttggggtgcttttcctgaatctttgggggtgaagggagtgttgctcccagtccagaggcctgattctgttcggactgggttctcaagacacgaccaggttctcaagacacgagtccccttgttcctccccattaaagggggtttgtcagaagcaagaacagcccctctccccagtcacagcctgaagggaggccccgagagcttcctccttccccccacctgctccttaccttctctgccctgctttttagaactgcagttcattgttttaagggattgggggagggagcctggggacacaaaccttttatacaatacaaagctttgctttttttttttttttcttccttttccctttctcggttctcttctctcctctgaatggctgaagacccctctgccgagggaggttggggattgtgggacaaggtcccttggtgctgatggcctgaaggggcctgagctgtgggcagatgcagttttctgtgggcttggggaacctctcacgttgctgtgtcctggtgagcagcccgaccaataaacctgcttttctaaaaga

SEQ ID NO: 61908 - DNA, 3886 bp, Homo sapiens
acctgattccgttcctcagctcgcattcctccgcccgtcccgctcccgccgccagcggaggccctagtctcccgctccaactattccaaccatcccgggaagggtggggcgctcggctcttgggtccccctccgccgccccgcctcgtcgatctccccttctaccccggtccctccctttctggggtggggccagccaatcagcgatcagactccggagtttggcccgggagctggggagctcaccgatcccccgcccagcagttctggccgctgtcccggtgcgcacggacgtggctcgagtttcctctgctctccgctctcgcccgctagctctcctcccttccgctcctgcttctctccgggtctcccgctccagctccagccccacccggccggtcccgcacggctccgggtagccatggaggaccccacgctctatattgtcgagcggccgcttcccgggtaccccgacgccgaggccccggagccttcctccgctggggctcaggcagcggaggagccgtcgggggccggctcagaagagctgatcaagtcggaccaggtgaacggcgtgctggtgctgagcctcctggacaaaatcatcggggccgtagaccagatccagctgactcaagcacagctggaggagcggcaggcggagatggagggcgcagtgcagagcatccagggcgagctgagcaagctgggcaaggcgcacgccaccacgagcaatacggtgagcaagctgctggagaaggtgcgcaaggtcagcgtcaacgtgaagaccgtgcgcggcagcctggagcgccaggcggggcagatcaagaagctggaggtcaacgaggccgagctgctgcggcgccgcaactttaaagtcatgatctaccaggatgaagtgaagctgccggccaaactgagcatcagcaaatcgctgaaagagtcggaggcgctgccagagaaggagggcgaggagctgggcgagggcgagcggcccgaggaggacgcagcggcgctggagctttcgtcggacgaggcggtggaggttgaggaggttattgaggagtcccgcgcagagcgtatcaagcgcagcggcctgcggcgcgtggacgacttcaagaaggccttctccaaggagaagatggagaagaccaaggtgcgtacccgcgagaacctggagaagacgcgcctcaagaccaaggaaaacctggagaagacgcggcacaccctggagaagcgcatgaacaagctgggcacgcgcctggtgcccgccgagcggcgcgagaaactgaagacgtcgcgggacaagttgcgcaaatccttcacgcccgaccacgtggtgtacgcgcgctccaagaccgcggtctacaaggtgccacccttcaccttccacgtcaagaagatccgcgagggccaggtggaagtgctcaaggccaccgagatggtggaggtgggcgccgacgacgacgagggcggcgcggagcgcggggaggccggcgacctgcggcgcgggagcagccccgacgtgcacgcgctgctggagatcaccgaggagtcggacgccgtgctggtggacaagagcgacagcgactgagccgcccccgctgccacccaccccattcctcgctccttccgaacttcctctttcgcattctctctcggctcgagctggctgagatttttctaaattgaaaacacgcccccctccccacacctccaggaactccactcccagtcttagagctgttaggacccgatggggaggcagcccccgcagtggacagcccccgcttggacacagtccgagtggaatgggaagggaatggtcaatccctgtcctggttgtccaagtcgggatctcagaggaaattgcagtgattccacggttaggcccccctgggggggctgccttcccctcagcctctccccacaccacccacccagctgctgtcattccgctcactgagctcttcttcattctcaccctgatccctgggggactcaaagccaaaactgcccaaagaggaaagattgaatcctaaaggggatccttgcccccatgggaggccccctactagaaggacgtgaaagcagcttttgggggaaactgaggcagtggggaagacagagcagaatgagccctcaccctggctgggggtccagcacaggctgtatctgcagagggtcccagaggaacgctggagccaagagaagccctgggaaggaggggtggggaacgacatgcatgtgagggatggcacactgatgtgtttatgcacctgtacacaggagcgcatggccatggctttggaaaggagaatggaaaaatagaagaaggtcggccgggcttggtggcttaagcctgtaaccccagcactttgggaggccgaggtgggcggatcacctgaggtcaggagttcgggaccagcctggcaaacaccccatctctactaagcgaaaacccatctctactaaaattacaaaaattagctgggcatggttgcgcatgcctgtaatcccagctactttggaggctgaggtggggagaattgcttgaacctgggaggtggaggttgcagtgagccaaggtcgcgacactgcactccagcctgggtgacagagtgagactccatctcaacagaaggaaaaaaaaaggaaaataggagaaggtggaaatgggtgaagagagaagtcccctcactagctgcatgagaaatctatcttactgtggttctccatgggcagcaggaccatttttcagaatcaagagggaggacagtgtgagaaggcgatgatccaaagaagacagagaggtcagccccacccgatccctcaaatgggctcttggaggcacccccaggggcagcccatttctcaaagtccagaaaattagggtcccagaagggggcagcagcaggctgggagttaggagggagagcagggtgccggccctgccaccaagttgagagctggaggggaggtggggagagaacatcacagagcagccagccctggttcactcctggcagtttcttctcaagctccttccctaggagcatggtggcacgtgcctgtggtctcagctacttgggaggctgaggcgggaggatcgccagagcccaggagtttgaggctgcagtgagctatgagggtgcctctgtgctccatcctaggcaacagagtgagacgctgtttaaaaaggaaaaaatccttccctagagctagtatcctaaagctgcagagctagcccagacctcattggtttccttgtccttggggtgcttttcctgaatctttgggggtgaagggagtgttgctcccagtccagaggcctgattctgttcggactgggttctcaagacacgaccaggttctcaagacacgagtccccttgttcctccccattaaagggggtttgtcagaagcaagaacagcccctctccccagtcacagcctgaagggaggccccgagagcttcctccttccccccacctgctccttaccttctctgccctgctttttagaactgcagttcattgttttaagggattgggggagggagcctggggacacaaaccttttatacaatacaaagctttgctttttttttttttttcttccttttccctttctcggttctcttctctcctctgaatggctgaagacccctctgccgagggaggttggggattgtgggacaaggtcccttggtgctgatggcctgaaggggcctgagctgtgggcagatgcagttttctgtgggcttggggaacctctcacgttgctgtgtcctggtgagcagcccgaccaataaacctgcttttctaaaagaaaaacaataatcactatacacacacaaacacacactcaatcaacacaaaaggggg

SEQ ID NO: 61909 - DNA, 3669 bp, Homo sapiens
acctgattccgttcctcagctcgcattcctccgcccgtcccgctcccgccgccagcggaggccctagtctcccgctccaactattccaaccatcccgggaagggtggggcgctcggctcttgggtccccctccgccgccccgcctcgtcgatctccccttctaccccggtccctccctttctggggtggggccagccaatcagcgatcagactccggagtttggcccgggagctggggagctcaccgatcccccgcccagcagttctggccgctgtcccggtgcgcacggacgtggctcgagtttcctctgctctccgctctcgcccgctagctctcctcccttccgctcctgcttctctccgggtctcccgctccagctccagccccacccggccggtcccgcacggctccgggtagccatggaggaccccacgctctatattgtcgagcggccgcttcccgggtaccccgacgccgaggccccggagccttcctccgctggggctcaggcagcggaggagccgtcgggggccggctcagaagagctgatcaagtcggaccaggtgaacggcgtgctggtgctgagcctcctggacaaaatcatcggggccgtagaccagatccagctgactcaagcacagctggaggagcggcaggcggagatggagggcgcagtgcagagcatccagggcgagctgagcaagctgggcaaggcgcacgccaccacgagcaatacggtgagcaagctgctggagaaggtgcgcaaggtcagcgtcaacgtgaagaccgtgcgcggcagcctggagcgccaggcggggcagatcaagaagctggaggtcaacgaggccgagctgctgcggcgccgcaactttaaagtcatgatctaccaggatgaagtgaagctgccggccaaactgagcatcagcaaatcgctgaaagagtcggaggcgctgccagagaaggagggcgaggagctgggcgagggcgagcggcccgaggaggacgcagcggcgctggagctttcgtcggacgaggcggtggaggttgaggaggttattgaggagtcccgcgcagagcgtatcaagcgcagcggcctgcggcgcgtggacgacttcaagaaggccttctccaaggagaagatggagaagaccaaggtgcgtacccgcgagaacctggagaagacgcgcctcaagaccaaggaaaacctggagaagacgcggcacaccctggagaagcgcatgaacaagctgggcacgcgcctggtgcccgccgagcggcgcgagaaactgaagacgtcgcgggacaagttgcgcaaatccttcacgcccgaccacgtggtgtacgcgcgctccaagaccgcggtctacaaggtgccacccttcaccttccacgtcaagaagatccgcgagggccaggtggaagtgctcaaggccaccgagatggtggaggtgggcgccgacgacgacgagggcggcgcggagcgcggggaggccggcgacctgcggcgcgggagcagccccgacgtgcacgcgctgctggagatcaccgaggagtcggacgccgtgctggtggacaagagcgacagcgactgagccgcccccgctgccacccaccccattcctcgctccttccgaacttcctctttcgcattctctctcggctcgagctggctgagatttttctaaattgaaaacacgcccccctccccacacctccaggaactccactcccagtcttagagctgccttcccctcagcctctccccacaccacccacccagctgctgtcattccgctcactgagctcttcttcattctcaccctgatccctgggggactcaaagccaaaactgcccaaagaggaaagattgaatcctaaaggggatccttgcccccatgggaggccccctactagaaggacgtgaaagcagcttttgggggaaactgaggcagtggggaagacagagcagaatgagccctcaccctggctgggggtccagcacaggctgtatctgcagagggtcccagaggaacgctggagccaagagaagccctgggaaggaggggtggggaacgacatgcatgtgagggatggcacactgatgtgtttatgcacctgtacacaggagcgcatggccatggctttggaaaggagaatggaaaaatagaagaaggtcggccgggcttggtggcttaagcctgtaaccccagcactttgggaggccgaggtgggcggatcacctgaggtcaggagttcgggaccagcctggcaaacaccccatctctactaagcgaaaacccatctctactaaaattacaaaaattagctgggcatggttgcgcatgcctgtaatcccagctactttggaggctgaggtggggagaattgcttgaacctgggaggtggaggttgcagtgagccaaggtcgcgacactgcactccagcctgggtgacagagtgagactccatctcaacagaaggaaaaaaaaaggaaaataggagaaggtggaaatgggtgaagagagaagtcccctcactagctgcatgagaaatctatcttactgtggttctccatgggcagcaggaccatttttcagaatcaagagggaggacagtgtgagaaggcgatgatccaaagaagacagagaggtcagccccacccgatccctcaaatgggctcttggaggcacccccaggggcagcccatttctcaaagtccagaaaattagggtcccagaagggggcagcagcaggctgggagttaggagggagagcagggtgccggccctgccaccaagttgagagctggaggggaggtggggagagaacatcacagagcagccagccctggttcactcctggcagtttcttctcaagctccttccctaggagcatggtggcacgtgcctgtggtctcagctacttgggaggctgaggcgggaggatcgccagagcccaggagtttgaggctgcagtgagctatgagggtgcctctgtgctccatcctaggcaacagagtgagacgctgtttaaaaaggaaaaaatccttccctagagctagtatcctaaagctgcagagctagcccagacctcattggtttccttgtccttggggtgcttttcctgaatctttgggggtgaagggagtgttgctcccagtccagaggcctgattctgttcggactgggttctcaagacacgaccaggttctcaagacacgagtccccttgttcctccccattaaagggggtttgtcagaagcaagaacagcccctctccccagtcacagcctgaagggaggccccgagagcttcctccttccccccacctgctccttaccttctctgccctgctttttagaactgcagttcattgttttaagggattgggggagggagcctggggacacaaaccttttatacaatacaaagctttgctttttttttttttttcttccttttccctttctcggttctcttctctcctctgaatggctgaagacccctctgccgagggaggttggggattgtgggacaaggtcccttggtgctgatggcctgaaggggcctgagctgtgggcagatgcagttttctgtgggcttggggaacctctcacgttgctgtgtcctggtgagcagcccgaccaataaacctgcttttctaaaaga

SEQ ID NO: 61910 - DNA, 3571 bp, Homo sapiens
acctgattccgttcctcagctcgcattcctccgcccgtcccgctcccgccgccagcggaggccctagtctcccgctccaactattccaaccatcccgggaagggtggggcgctcggctcttgggtccccctccgccgccccgcctcgtcgatctccccttctaccccggtccctccctttctggggtggggccagccaatcagcgatcagactccggagtttggcccgggagctggggagctcaccgatcccccgcccagcagttctggccgctgtcccggtgcgcacggacgtggctcgagtttcctctgctctccgctctcgcccgctagctctcctcccttccgctcctgcttctctccgggtctcccgctccagctccagccccacccggccggtcccgcacggctccgggtagccatggaggaccccacgctctatattgtcgagcggccgcttcccgggtaccccgacgccgaggccccggagccttcctccgctggggctcaggcagcggaggagccgtcgggggccggctcagaagagctgatcaagtcggaccaggtgaacggcgtgctggtgctgagcctcctggacaaaatcatcggggccgtagaccagatccagctgactcaagcacagctggaggagcggcaggcggagatggagggcgcagtgcagagcatccagggcgagctgagcaagctgggcaaggcgcacgccaccacgagcaatacggtgagcaagctgctggagaaggtgcgcaaggtcagcgtcaacgtgaagaccgtgcgcggcagcctggagcgccaggcggggcagatcaagaagctggaggtcaacgaggccgagctgctgcggcgccgcaactttaaagtcatgatctaccaggatgaagtgaagctgccggccaaactgagcatcagcaaatcgctgaaagagtcggaggcgctgccagagaaggagggcgaggagctgggcgagggcgagcggcccgaggaggacgcagcggcgctggagctttcgtcggacgaggcggtggaggttgaggaggttattgaggagtcccgcgcagagcgtatcaagcgcagcggcctgcggcgcgtggacgacttcaagaaggccttctccaaggagaagatggagaagaccaaggtgcgtacccgcgagaacctggagaagacgcgcctcaagaccaaggaaaacctggagaagacgcggcacaccctggagaagcgcatgaacaagctgggcacgcgcctggtgcccgccgagcggcgcgagaaactgaagacgtcgcgggacaagttgcgcaaatccttcacgcccgaccacgtggtgtacgcgcgctccaagaccgcggtctacaaggtgccacccttcaccttccacgtcaagaagatccgcgagggccaggtggaagtgctcaaggccaccgagatggtggaggtgggcgccgacgacgacgagggcggcgcggagcgcggggaggccggcgacctgcggcgcgggagcagccccgacgtgcacgcgctgctggagatcaccgaggagtcggacgccgtgctggtggacaagagcgacagcgactgagccgcccccgctgccacccaccccattcctcgctccttccgaacttcctctttcgcattctctctcggctcgagctggctgagatttttctaaattgaaaacacgcccccctccccacacctccaggaactccactcccagtcttagagctgttaggacccgatggggaggcagcccccgcagtggacagcccccgcttggacacagtccgagtggaatgggaagggaatggtcaatccctgtcctggttgtccaagtcgggatctcagaggaaattgcagtgattccacggttaggcccccctgggggggctgccttcccctcagcctctccccacaccacccacccagctgctgtcattccgctcactgagctcttcttcattctcaccctgatccctgggggactcaaagccaaaactgcccaaagaggaaagattgaatcctaaaggggatccttgcccccatgggaggccccctactagaaggacgtgaaagcagcttttgggggaaactgaggcagtggggaagacagagcagaatgagccctcaccctggctgggggtccagcacaggctgtatctgcagagggtcccagaggaacgctggagccaagagaagccctgggaaggaggggtggggaacgacatgcatgtgagggatggcacactgatgtgtttatgcacctgtacacaggagcgcatggccatggctttggaaaggagaatggaaaaatagaagaaggtcggccgggcttggtggcttaagcctgtaaccccagcactttgggaggccgaggtgggcggatcacctgaggtcaggagttcgggaccagcctggcaaacaccccatctctactaagcgaaaacccatctctactaaaattacaaaaattagctgggcatggttgcgcatgcctgtaatcccagctactttggaggctgaggtggggagaattgcttgaacctgggaggtggaggttgcagtgagccaaggtcgcgacactgcactccagcctgggtgacagagtgagactccatctcaacagaaggaaaaaaaaaggaaaataggagaaggtggaaatgggtgaagagagaagtcccctcactagctgcatgagaaatctatcttactgtggttctccatgggcagcaggaccatttttcagaatcaagagggaggacagtgtgagaaggcgatgatccaaagaagacagagaggtcagccccacccgatccctcaaatgggctcttggaggcacccccaggggcagcccatttctcaaagtccagaaaattagggtcccagaagggggcagcagcaggctgggagttaggagggagagcagggtgccggccctgccaccaagttgagagctggaggggaggtggggagagaacatcacagagcagccagccctggttcactcctggcagtttcttctcaagctccttccctaggagcatggtggcacgtgcctgtggtctcagctacttgggaggctgaggcgggaggatcgccagagcccaggagtttgaggctgcagtgagctatgagggtgcctctgtgctccatcctaggcaacagagtgagacgctgtttaaaaaggaaaaaatccttccctagagctagtatcctaaagctgcagagctagcccagacctcattggtttccttgtccttggggtgcttttcctgaatctttgggggtgaagggagtgttgctcccagtccagaggcctgattctgttcggactgggttctcaagacacgaccaggttctcaagacacgagtccccttgttcctccccattaaagggggtttgtcagaagcaagaacagcccctctccccaatgcgccggcgcttggggggtttaggctgaaggagaatgtccagtttcatctgtacatcagcacctctccctgtggagatgccagaatcttcccaccacgagccgcacaacgagccacacaaagcg

SEQ ID NO: 61911 - DNA, 3391 bp, Homo sapiens
acctgattccgttcctcagctcgcattcctccgcccgtcccgctcccgccgccagcggaggccctagtctcccgctccaactattccaaccatcccgggaagggtggggcgctcggctcttgggtccccctccgccgccccgcctcgtcgatctccccttctaccccggtccctccctttctggggtggggccagccaatcagcgatcagactccggagtttggcccgggagctggggagctcaccgatcccccgcccagcagttctggccgctgtcccggtgcgcacggacgtggctcgagtttcctctgctctccgctctcgcccgctagctctcctcccttccgctcctgcttctctccgggtctcccgctccagctccagccccacccggccggtcccgcacggctccgggtagccatggaggaccccacgctctatattgtcgagcggccgcttcccgggtaccccgacgccgaggccccggagccttcctccgctggggctcaggcagcggaggagccgtcgggggccggctcagaagagctgatcaagtcggaccaggtgaacggcgtgctggtgctgagcctcctggacaaaatcatcggggccgtagaccagatccagctgactcaagcacagctggaggagcggcaggcggagatggagggcgcagtgcagagcatccagggcgagctgagcaagctgggcaaggcgcacgccaccacgagcaatacggtgagcaagctgctggagaaggtgcgcaaggtcagcgtcaacgtgaagaccgtgcgcggcagcctggagcgccaggcggggcagatcaagaagctggaggtcaacgaggccgagctgctgcggcgccgcaactttaaagtcatgatctaccaggatgaagtgaagctgccggccaaactgagcatcagcaaatcgctgaaagagtcggaggcgctgccagagaaggagggcgaggagctgggcgagggcgagcggcccgaggaggacgcagcggcgctggagctttcgtcggacgaggcggtggaggttgaggaggttattgaggagtcccgcgcagagcgtatcaagcgcagcggcctgcggcgcgtggacgacttcaagaaggccttctccaaggagaagatggagaagaccaaggtgcgtacccgcgagaacctggagaagacgcgcctcaagaccaaggaaaacctggagaagacgcggcacaccctggagaagcgcatgaacaagctgggcacgcgcctggtgcccgccgagcggcgcgagaaactgaagacgtcgcgggacaagttgcgcaaatccttcacgcccgaccacgtggtgtacgcgcgctccaagaccgcggtctacaaggtgccacccttcaccttccacgtcaagaagatccgcgagggccaggtggaagtgctcaaggccaccgagatggtggaggtgggcgccgacgacgacgagggcggcgcggagcgcggggaggccggcgacctgcggcgcgggagcagccccgacgtgcacgcgctgctggagatcaccgaggagtcggacgccgtgctggtggacaagagcgacagcgactgagccgcccccgctgccacccaccccattcctcgctccttccgaacttcctctttcgcattctctctcggctcgagctggctgagatttttctaaattgaaaacacgcccccctccccacacctccaggaactccactcccagtcttagagctgttaggacccgatggggaggcagcccccgcagtggacagcccccgcttggacacagtccgagtggaatgggaagggaatggtcaatccctgtcctggttgtccaagtcgggatctcagaggaaattgcagtgattccacggttaggcccccctgggggggctgccttcccctcagcctctccccacaccacccacccagctgctgtcattccgctcactgagctcttcttcattctcaccctgatccctgggggactcaaagccaaaactgcccaaagaggaaagattgaatcctaaaggggatccttgcccccatgggaggccccctactagaaggacgtgaaagcagcttttgggggaaactgaggcagtggggaagacagagcagaatgagccctcaccctggctgggggtccagcacaggctgtatctgcagagggtcccagaggaacgctggagccaagagaagccctgggaaggaggggtggggaacgacatgcatgtgagggatggcacactgatgtgtttatgcacctgtacacaggagcgcatggccatggctttggaaaggagaatggaaaaatagaagaaggtcggccgggcttggtggcttaagcctgtaaccccagcactttgggaggccgaggtgggcggatcacctgaggtcaggagttcgggaccagcctggcaaacaccccatctctactaagcgaaaacccatctctactaaaattacaaaaattagctgggcatggttgcgcatgcctgtaatcccagctactttggaggctgaggtggggagaattgcttgaacctgggaggtggaggttgcagtgagccaaggtcgcgacactgcactccagcctgggtgacagagtgagactccatctcaacagaaggaaaaaaaaaggaaaataggagaaggtggaaatgggtgaagagagaagtcccctcactagctgcatgagaaatctatcttactgtggttctccatgggcagcaggaccatttttcagaatcaagagggaggacagtgtgagaaggcgatgatccaaagaagacagagaggtcagccccacccgatccctcaaatgggctcttggaggcacccccaggggcagcccatttctcaaagtccagaaaattagggtcccagaagggggcagcagcaggctgggagttaggagggagagcagggtgccggccctgccaccaagttgagagctggaggggaggtggggagagaacatcacagagcagccagccctggttcactcctggcagtttcttctcaagctccttccctaggagcatggtggcacgtgcctgtggtctcagctacttgggaggctgaggcgggaggatcgccagagcccaggagtttgaggctgcagtgagctatgagggtgcctctgtgctccatcctaggcaacagagtgagacgctgtttaaaaattcgtctcagacaaacaaaaaaattagccgggcatggttggcaggtgcctgtaatcccagctactcagggggctgaggcagggggaatggcttgaacccaggaggcagaggttgcagtgagccaaggtcataccagtgcactccaggcgggtgacagagcaagactgcgtctcaaaaaaaaacaaaacacag

SEQ ID NO: 61912 - DNA, 3006 bp, Homo sapiens
acctgattccgttcctcagctcgcattcctccgcccgtcccgctcccgccgccagcggaggccctagtctcccgctccaactattccaaccatcccgggaagggtggggcgctcggctcttgggtccccctccgccgccccgcctcgtcgatctccccttctaccccggtccctccctttctggggtggggccagccaatcagcgatcagactccggagtttggcccgggagctggggagctcaccgatcccccgcccagcagttctggccgctgtcccggtgcgcacggacgtggctcgagtttcctctgctctccgctctcgcccgctagctctcctcccttccgctcctgcttctctccgggtctcccgctccagctccagccccacccggccggtcccgcacggctccgggtagccatggaggaccccacgctctatattgtcgagcggccgcttcccgggtaccccgacgccgaggccccggagccttcctccgctggggctcaggcagcggaggagccgtcgggggccggctcagaagagctgatcaagtcggaccaggtgaacggcgtgctggtgctgagcctcctggacaaaatcatcggggccgtagaccagatccagctgactcaagcacagctggaggagcggcaggcggagatggagggcgcagtgcagagcatccagggcgagctgagcaagctgggcaaggcgcacgccaccacgagcaatacggtgagcaagctgctggagaaggtgcgcaaggtcagcgtcaacgtgaagaccgtgcgcggcagcctggagcgccaggcggggcagatcaagaagctggaggtcaacgaggccgagctgctgcggcgccgcaactttaaagtcatgatctaccaggatgaagtgaagctgccggccaaactgagcatcagcaaatcgctgaaagagtcggaggcgctgccagagaaggagggcgaggagctgggcgagggcgagcggcccgaggaggacgcagcggcgctggagctttcgtcggacgaggcggtggaggttgaggaggttattgaggagtcccgcgcagagcgtatcaagcgcagcggcctgcggcgcgtggacgacttcaagaaggccttctccaaggagaagatggagaagaccaaggtgcgtacccgcgagaacctggagaagacgcgcctcaagaccaaggaaaacctggagaagacgcggcacaccctggagaagcgcatgaacaagctgggcacgcgcctggtgcccgccgagcggcgcgagaaactgaagacgtcgcgggacaagttgcgcaaatccttcacgcccgaccacgtggtgtacgcgcgctccaagaccgcggtctacaaggtgccacccttcaccttccacgtcaagaagatccgcgagggccaggtggaagtgctcaaggccaccgagatggtggaggtgggcgccgacgacgacgagggcggcgcggagcgcggggaggccggcgacctgcggcgcgggagcagccccgacgtgcacgcgctgctggagatcaccgaggagtcggacgccgtgctggtggacaagagcgacagcgactgagccgcccccgctgccacccaccccattcctcgctccttccgaacttcctctttcgcattctctctcggctcgagctggctgagatttttctaaattgaaaacacgcccccctccccacacctccaggaactccactcccagtcttagagctgttaggacccgatggggaggcagcccccgcagtggacagcccccgcttggacacagtccgagtggaatgggaagggaatggtcaatccctgtcctggttgtccaagtcgggatctcagaggaaattgcagtgattccacggttaggcccccctgggggggctgccttcccctcagcctctccccacaccacccacccagctgctgtcattccgctcactgagctcttcttcattctcaccctgatccctgggggactcaaagccaaaactgcccaaagaggaaagattgaatcctaaaggggatccttgcccccatgggaggccccctactagaaggacgtgaaagcagcttttgggggaaactgaggcagtggggaagacagagcagaatgagccctcaccctggctgggggtccagcacaggctgtatctgcagagggtcccagaggaacgctggagccaagagaagccctgggaaggaggggtggggaacgacatgcatgtgagggatggcacactgatgtgtttatgcacctgtacacaggagcgcatggccatggctttggaaaggagaatggaaaaatagaagaaggtcggccgggcttggtggcttaagcctgtaaccccagcactttgggaggccgaggtgggcggatcacctgaggtcaggagttcgggaccagcctggcaaacaccccatctctactaagcgaaaacccatctctactaaaattacaaaaattagctgggcatggttgcgcatgcctgtaatcccagctactttggaggctgaggtggggagaattgcttgaacctgggaggtggaggttgcagtgagccaaggtcgcgacactgcactccagcctgggtgacagagtgagactccatctcaacagaaggaaaaaaaaaggaaaataggagaaggtggaaatgggtgaagagagaagtcccctcactagctgcatgagaaatctatcttactgtggttctccatgggcagcaggaccatttttcagaatcaagagggaggacagtgtgagaaggcgatgatccaaagaagacagagaggtcagccccacccgatccctcaaatgggctcttggaggcacccccaggggcagcccataggagtctaaaagtttaaggtcccatatgttcccatcaaccgtcagccagtaatgcctcatagcagtatacctggccagccaacaattagatagctttaatactcttctgaagggaccgtcatcataactgttaga

SEQ ID NO: 61913 - DNA, 2855 bp, Homo sapiens
acctgattccgttcctcagctcgcattcctccgcccgtcccgctcccgccgccagcggaggccctagtctcccgctccaactattccaaccatcccgggaagggtggggcgctcggctcttgggtccccctccgccgccccgcctcgtcgatctccccttctaccccggtccctccctttctggggtggggccagccaatcagcgatcagactccggagtttggcccgggagctggggagctcaccgatcccccgcccagcagttctggccgctgtcccggtgcgcacggacgtggctcgagtttcctctgctctccgctctcgcccgctagctctcctcccttccgctcctgcttctctccgggtctcccgctccagctccagccccacccggccggtcccgcacggctccgggtagccatggaggaccccacgctctatattgtcgagcggccgcttcccgggtaccccgacgccgaggccccggagccttcctccgctggggctcaggcagcggaggagccgtcgggggccggctcagaagagctgatcaagtcggaccaggtgaacggcgtgctggtgctgagcctcctggacaaaatcatcggggccgtagaccagatccagctgactcaagcacagctggaggagcggcaggcggagatggagggcgcagtgcagagcatccagggcgagctgagcaagctgggcaaggcgcacgccaccacgagcaatacggtgagcaagctgctggagaaggtgcgcaaggtcagcgtcaacgtgaagaccgtgcgcggcagcctggagcgccaggcggggcagatcaagaagctggaggtcaacgaggccgagctgctgcggcgccgcaactttaaagtcatgatctaccaggatgaagtgaagctgccggccaaactgagcatcagcaaatcgctgaaagagtcggaggcgctgccagagaaggagggcgaggagctgggcgagggcgagcggcccgaggaggacgcagcggcgctggagctttcgtcggacgaggcggtggaggttgaggaggttattgaggagtcccgcgcagagcgtatcaagcgcagcggcctgcggcgcgtggacgacttcaagaaggccttctccaaggagaagatggagaagaccaaggtgcgtacccgcgagaacctggagaagacgcgcctcaagaccaaggaaaacctggagaagacgcggcacaccctggagaagcgcatgaacaagctgggcacgcgcctggtgcccgccgagcggcgcgagaaactgaagacgtcgcgggacaagttgcgcaaatccttcacgcccgaccacgtggtgtacgcgcgctccaagaccgcggtctacaaggtgccacccttcaccttccacgtcaagaagatccgcgagggccaggtggaagtgctcaaggccaccgagatggtggaggtgggcgccgacgacgacgagggcggcgcggagcgcggggaggccggcgacctgcggcgcgggagcagccccgacgtgcacgcgctgctggagatcaccgaggagtcggacgccgtgctggtggacaagagcgacagcgactgagccgcccccgctgccacccaccccattcctcgctccttccgaacttcctctttcgcattctctctcggctcgagctggctgagatttttctaaattgaaaacacgcccccctccccacacctccaggaactccactcccagtcttagagctgttaggacccgatggggaggcagcccccgcagtggacagcccccgcttggacacagtccgagtggaatgggaagggaatggtcaatccctgtcctggttgtccaagtcgggatctcagaggaaattgcagtgattccacggttaggcccccctgggggggctgccttcccctcagcctctccccacaccacccacccagctgctgtcattccgctcactgagctcttcttcattctcaccctgatccctgggggactcaaagccaaaactgcccaaagaggaaagattgaatcctaaaggggatccttgcccccatgggaggccccctactagaaggacgtgaaagcagcttttgggggaaactgaggcagtggggaagacagagcagaatgagccctcaccctggctgggggtccagcacaggctgtatctgcagagggtcccagaggaacgctggagccaagagaagccctgggaaggaggggtggggaacgacatgcatgtgagggatggcacactgatgtgtttatgcacctgtacacaggagcgcatggccatggctttggaaaggagaatggaaaaatagaagaaggtcggccgggcttggtggcttaagcctgtaaccccagcactttgggaggccgaggtgggcggatcacctgaggtcaggagttcgggaccagcctggcaaacaccccatctctactaagcgaaaacccatctctactaaaattacaaaaattagctgggcatggttgcgcatgcctgtaatcccagctactttggaggctgaggtggggagaattgcttgaacctgggaggtggaggttgcagtgagccaaggtcgcgacactgcactccagcctgggtgacagagtgagactccatctcaacagaaggaaaaaaaaaggaaaataggagaaggtggaaatgggtgaagagagaagtcccctcactagctgcatgagaaatctatcttactgtggttctccatgggcagcaggaccatttttcagaatcaagagggaggacagtgtgagaaggcgatgatcctctcacgttgctgtgtcctggtgagcagcccgaccaataaacctgcttttctaaaaga

SEQ ID NO: 61914 - DNA, 2664 bp, Homo sapiens
acctgattccgttcctcagctcgcattcctccgcccgtcccgctcccgccgccagcggaggccctagtctcccgctccaactattccaaccatcccgggaagggtggggcgctcggctcttgggtccccctccgccgccccgcctcgtcgatctccccttctaccccggtccctccctttctggggtggggccagccaatcagcgatcagactccggagtttggcccgggagctggggagctcaccgatcccccgcccagcagttctggccgctgtcccggtgcgcacggacgtggctcgagtttcctctgctctccgctctcgcccgctagctctcctcccttccgctcctgcttctctccgggtctcccgctccagctccagccccacccggccggtcccgcacggctccgggtagccatggaggaccccacgctctatattgtcgagcggccgcttcccgggtaccccgacgccgaggccccggagccttcctccgctggggctcaggcagcggaggagccgtcgggggccggctcagaagagctgatcaagtcggaccaggtgaacggcgtgctggtgctgagcctcctggacaaaatcatcggggccgtagaccagatccagctgactcaagcacagctggaggagcggcaggcggagatggagggcgcagtgcagagcatccagggcgagctgagcaagctgggcaaggcgcacgccaccacgagcaatacggtgagcaagctgctggagaaggtgcgcaaggtcagcgtcaacgtgaagaccgtgcgcggcagcctggagcgccaggcggggcagatcaagaagctggaggtcaacgaggccgagctgctgcggcgccgcaactttaaagtcatgatctaccaggatgaagtgaagctgccggccaaactgagcatcagcaaatcgctgaaagagtcggaggcgctgccagagaaggagggcgaggagctgggcgagggcgagcggcccgaggaggacgcagcggcgctggagctttcgtcggacgaggcggtggaggttgaggaggttattgaggagtcccgcgcagagcgtatcaagcgcagcggcctgcggcgcgtggacgacttcaagaaggccttctccaaggagaagatggagaagaccaaggtgcgtacccgcgagaacctggagaagacgcgcctcaagaccaaggaaaacctggagaagacgcggcacaccctggagaagcgcatgaacaagctgggcacgcgcctggtgcccgccgagcggcgcgagaaactgaagacgtcgcgggacaagttgcgcaaatccttcacgcccgaccacgtggtgtacgcgcgctccaagaccgcggtctacaaggtgccacccttcaccttccacgtcaagaagatccgcgagggccaggtggaagtgctcaaggccaccgagatggtggaggtgggcgccgacgacgacgagggcggcgcggagcgcggggaggccggcgacctgcggcgcgggagcagccccgacgtgcacgcgctgctggagatcaccgaggagtcggacgccgtgctggtggacaagagcgacagcgactgagccgcccccgctgccacccaccccattcctcgctccttccgaacttcctctttcgcattctctctcggctcgagctggctgagatttttctaaattgaaaacacgcccccctccccacacctccaggaactccactcccagtcttagagctgttaggacccgatggggaggcagcccccgcagtggacagcccccgcttggacacagtccgagtggaatgggaagggaatggtcaatccctgtcctggttgtccaagtcgggatctcagaggaaattgcagtgattccacggttaggcccccctgggggggctgccttcccctcagcctctccccacaccacccacccagctgctgtcattccgctcactgagctcttcttcattctcaccctgatccctgggggactcaaagccaaaactgcccaaagaggaaagattgaatcctaaaggggatccttgcccccatgggaggccccctactagaaggacgtgaaagcagcttttgggggaaactgaggcagtggggaagacagagcagaatgagccctcaccctggctgggggtccagcacaggctgtatctgcagagggtcccagaggaacgctggagccaagagaagccctgggaaggaggggtggggaacgacatgcatgtgagggatggcacactgatgtgtttatgcacctgtacacaggagcgcatggccatggctttggaaaggagaatggaaaaatagaagaaggtcggccgggcttggtggcttaagcctgtaaccccagcactttgggaggccgaggtgggcggatcacctgaggtcaggagttcgggaccagcctggcaaacaccccatctctactaagcgaaaacccatctctactaaaattacaaaaattagctgggcatggttgcgcatgcctgtaatcccagctactttggaggctgaggtggggagaattgcttgaacctgggaggtggaggttgcagtgagccaaggtcgcgacactgcactccagcctgggtgacagagtgagactccagtcgacgcggccgcgaatttagtagtagtaggc

SEQ ID NO: 61915 - DNA, 1356 bp, Homo sapiens
acctgattccgttcctcagctcgcattcctccgcccgtcccgctcccgccgccagcggaggccctagtctcccgctccaactattccaaccatcccgggaagggtggggcgctcggctcttgggtccccctccgccgccccgcctcgtcgatctccccttctaccccggtccctccctttctggggtggggccagccaatcagcgatcagactccggagtttggcccgggagctggggagctcaccgatcccccgcccagcagttctggccgctgtcccggtgcgcacggacgtggctcgagtttcctctgctctccgctctcgcccgctagctctcctcccttccgctcctgcttctctccgggtctcccgctccagctccagccccacccggccggtcccgcacggctccgggtagccatggaggaccccacgctctatattgtcgagcggccgcttcccgggtaccccgacgccgaggccccggagccttcctccgctggggctcaggcagcggaggagccgtcgggggccggctcagaagagctgatcaagtcggaccaggtgaacggcgtgctggtgctgagcctcctggacaaaatcatcggggccgtagaccagatccagctgactcaagcacagctggaggagcggcaggcggagatggagggcgcagtgcagagcatccagggcgagctgagcaagctgggcaaggcgcacgccaccacgagcaatacggtgagcaagctgctggagaaggtgcgcaaggtcagcgtcaacgtgaagaccgtgcgcggcagcctggagcgccaggcggggcagatcaagaagctggaggtcaacgaggccgagctgctgcggcgccgcaactttaaagtcatgatctaccaggatgaagtgaagctgccggccaaactgagcatcagcaaatcgctgaaagagtcggaggcgctgccagagaaggagggcgaggagctgggcgagggcgagcggcccgaggaggacgcagcggcgctggagctttcgtcggacgaggcggtggaggttgaggaggttattgaggagtcccgcgcagagcgtatcaagcgcagcggcctgcggcgcgtggacgacttcaagaaggccttctccaaggagaagatggagaagaccaaggtgcgtacccgcgagaacctggagaagacgcgcctcaagaccaaggaaaacctggagaagacgcggcacaccctggagaagcgcatgaacaagctgggcacgcgcctggtgcccgccgagcggcgcgagaaactgaagacgtcgcgggacaagttgcgcaaatccttcacgcccgaccaataaacctgctttttttaaaga

SEQ ID NO: 61916 - DNA, 936 bp, Homo sapiens
  misc_feature (924)..(924): n is a, c, g, or t
  misc_feature (926)..(926): n is a, c, g, or t
acctgattccgttcctcagctcgcattcctccgcccgtcccgctcccgccgccagcggaggccctagtctcccgctccaactattccaaccatcccgggaagggtggggcgctcggctcttgggtccccctccgccgccccgcctcgtcgatctccccttctaccccggtccctccctttctggggtggggccagccaatcagcgatcagactccggagtttggcccgggagctggggagctcaccgatcccccgcccagcagttctggccgctgtcccggtgcgcacggacgtggctcgagtttcctctgctctccgctctcgcccgctagctctcctcccttccgctcctgcttctctccgggtctcccgctccagctccagccccacccggccggtcccgcacggctccgggtagccatggaggaccccacgctctatattgtcgagcggccgcttcccgggtaccccgacgccgaggccccggagccttcctccgctggggctcaggcagcggaggagccgtcgggggccggctcagaagagctgatcaagtcggaccaggtgaacggcgtgctggtgctgagcctcctggacaaaatcatcggggccgtagaccagatccagctgactcaagcacagctggaggagcggcaggcggagatggagggcgcagtgcagagcatccagggcgagctgagcaagctgggcaaggcgcacgccaccacgagcaatacggtgagcaagctgctggagaaggtgcgcaaggtcagcgtcaacgtgaagaccgtgcgcggcagcctggagcgccaggcggggcagatcaagaagctggaggtcaacgaggccgagctgctgcggcgccgcaactttaaagtcatgatctaccagcctggcaaacaccccatctctctaagcgatccnancggggtgagc

SEQ ID NO: 61917 - DNA, 343 bp, Homo sapiens
atgcaggggatggcgaggaagagaaggaaaacaaacagtgtaggtggaaagtctcaggctcttcccagtaaacaggcattttcaaatatcaaagactcccctgcattaatgctacagagtatttctgtacactttgaagtgatacactcatttgtaaaccaaattataatgttgtgatattatagcccaggatggcaggtgttcagaaagcataccacttattaaaatggccatatgaaagcctagtacattttctgttctattgattccagtctcatttctactgcttctactttcctctgctcctcactgaactgcccacctgctcccagacccacaatca

SEQ ID NO: 61918 - DNA, 891 bp, Homo sapiens
atccattttcatatgtgagagaattcctatgtgtactattacatttgtatcctcttatcttagtcatatcaggctgctgtaacaaaaataccatagacagaatgacttaaacaacgaagatttatttcgcacagttgtggagtttgaaaaatcaagaccaaggcactatcatattcatggtctgatgtgggccccagcccgtggtgcatagactgctcttttctctctctgtcctcacatgatagaaggggcaagggagccttctggggctctttaataaaaacactaatctcattcgtgaggactccacccagattacctagtcacttcccaaaggccccaccttcaaatagcatcacattggggattaggatctcaatatactaattttggggagagataaacagtccatagcagctcagttcaaccaagttgcattgattatggggctctcatgagaatttacaatgctgaatgatctcaaaaaatcattatgttttgatatgtgctgcctaactggttgactctataagacataaacaatcaaacacattttttcattggtccagctatgtagttttgcatttaggtccactgagagtaaatgcagagaaaagtaaaaggtagtaatagaagtctatgtgcaaccattgtggttatcaaagcaatgcaagtttctaagtgataattagagggggattttcttggggtatataaatagataaaaattgaatttcctaactggaagctggccaggagtggtttgtaacagctgtattctcttgaaaaaaacactacagtcattagaacaagagaagggaagggagagagttctaccaaataacatctcagttttggttcatttattaaactttattctcatctcataag

SEQ ID NO: 61919 - DNA, 3826 bp, Homo sapiens
gagcagctgcaccatcccggcgttcgcgtgtgccgccgctttcctcctccatctcttttcctccgcctccgccggcgcgatgggcgaaccgctgacggacagcgagaagcggaagcagatcagcgtgcgcggcctggcggggctaggcgacgtggccgaggtgcggaagagcttcaaccggcacttgcacttcacgctggtcaaggaccgcaatgtggccacgccccgcgactacttcttcgcgctggcgcacacggtgcgcgaccacctcgtgggccgctggatccgcacgcagcagcactactacgagcgcgaccccaagcgaatttattatctttccctggaattctacatgggtcgcacgctgcagaacacgatggtgaacctgggccttcagaatgcctgcgatgaagccatctatcagttggggttagacttggaggaactcgaggagatagaagaagatgctggccttgggaatggaggcctggggaggctggcagcgtgtttccttgactcaatggctaccttgggcctggcagcatacggctatggaatccgctatgaatttgggatttttaaccagaagattgtcaatggctggcaggtagaggaggccgatgactggctgcgctacggcaacccctgggagaaagcgcggcctgagtatatgcttcccgtgcacttctacggacgcgtggagcacacccccgacggcgtgaagtggctggacacacaggtggtgctggccatgccctacgacaccccagtgcccggctacaagaacaacaccgtcaacaccatgcggctgtggtccgccaaggctcccaacgacttcaagctgcaggacttcaacgtgggagactacatcgaggcggtcctggaccggaacttggctgagaacatctccagggtcctgtatccaaatgataacttctttgaggggaaggagctgcggctgaagcaggagtacttcgtggtggccgccacgctccaggacatcatccgccgcttcaagtcgtccaagttcggctgccgggaccctgtgagaacctgtttcgagacgttcccagacaaggtggccatccagctgaacgacacccaccccgccctctccatccctgagctcatgcggatcctggtggacgtggagaaggtggactgggacaaggcctgggaaatcacgaagaagacctgtgcgtacaccaaccacactgtgctgcctgaggccttggagcgctggcccgtgtccatgtttgagaagctgctgccgcggcacctggagataatctatgccatcaaccagcggcacctggaccacgtggccgcgctgtttcccggcgatgtggaccgcctgcgcaggatgtctgtgatcgaggagggggactgcaagcggatcaacatggcccacctgtgtgtgattgggtcccatgctgtcaatggtgtggcgaggatccactcggagatcgtgaaacagtcggtctttaaggatttttatgaactggagccagagaagttccagaataagaccaatggcatcaccccccgccggtggctgctgctgtgcaacccggggctggccgataccatcgtggagaaaattggggaggagttcctgactgacctgagccagctgaagaagctgctgccgctggtcagtgacgaggtgttcatcagggacgtggccaaggtcaaacaggagaacaagctcaagttctcggccttcctggagaaggagtacaaggtgaagatcaacccctcctccatgttcgacgtgcatgtgaagaggatccacgagtacaagcggcagctgctcaactgcctgcacgtcgtcaccctgtacaatcgaatcaagagagacccggccaaggcttttgtgcccaggactgttatgattgggggcaaggcagcgcccggttaccacatggccaagctgatcatcaagttggtcacctccatcggcgacgtcgtcaatcatgacccagttgtgggtgacaggttgaaagtgatcttcctggagaactaccgtgtgtccttggctgagaaagtgatcccggccgctgatctgtcgcagcagatctccactgcaggcaccgaggcctcaggcacaggcaacatgaagttcatgctcaacggggccctcaccatcggcaccatggacggcgccaacgtggagatggccgaggaggccggggccgagaacctcttcatcttcggcctgcgggtggaggatgtcgaggccttggaccggaaagggtacaatgccaggagtactacgaccacctgcccgagctgaagcaggccgtggaccagatcagcagtggctttttttctcccaaggagccagactgcttcaaggacatcgtgaacatgctgatgcaccatgacaggttcaaggtgtttgcagactatgaagcctacatgcagtgccaggcacaggtggaccaactgtaccggaaccccaaggagtggaccaagaaggtcatcaggaacatcgcctgctcgggcaagttctccagtgaccggaccatcacggagtatgcacgggagatctggggtgtggagccctccgaccctgcagcttcagcacctgccccacccagagtgggagtcaggtggagccacctgctgggctcccccagaactttgcacacatcttgctatgtattagccgatgtctttagtgttgagcctctggattctggggtctgggccagtggccatagtgaagcctgggaatgagtgttactgcagcatctgggctgccagccacagggaagggccaagccccatgtagccccagtcatcctgcccagccctgcctcctggccatgccgggaggggtcggatcctctaggcatcgccttcacagccccctgccccctgccctctgtcctggctctgcacctggtatatgggtcatggacccagatggggctttccctttgtagccatccaatgggcattgtgtgggtgcttggaacccgggatgactgagggggacactggagtgggtgcttgtgtctgctgtctcagaggccttggtcaggatgaagttggctgacacagcttagcttggttttgcttattcaaaagagaaaataactacacatggaaatgaaactagctgaagccttttcttgttttagcaactgaaaattgtacttggtcacttttgtgcttgaggaggcccattttctgcctggcagggggcaggtctgtgccctcccgctgactcctgctgtgtcctgaggtgcatttcctgttgtacacacaagggccaggctccattctccctccctttccaccagtgccacagcctcgtctggaaaaaggaccaggggtcccggaggaacccatttgtgctctgcttggacagcaggcctggcactgggaggtgggggtgagcccctcacagccttgcccctccccagggctggcaacctgccttccattgcccaagagagagggcagggaacaggctactgtccttccctgtggaattgccgagaaatctagcaccttgcatgctggatctgggctgcggggaggctctttttctccctggcctccagtgcccaccaggaggatctgcgcacggtgcacagcccaccagagcactacagccttttattgagtggggtggggcaagtgctgggctgtggtcgtgccctgacagcatcttccccaggcagcggctctgtggaggaggccatactcccctagttggccactggggccaccaccctgaccaccactgtgcccctcattgttactaccttgtgagataaaaactgattaaacctttgtggctgtggttggctga

SEQ ID NO: 61920 - DNA, 379 bp, Homo sapiens
caggacttaaccaggctgagatggagacctaggctgtaatggagaccaggctgagaaaggtaaccctggaagcctgtgttggacagaaaactcactcctgccggggaacgggcgttgtactggccctgggcctttcatcctcagccagttcagctctgcctggacacccagacctagccagccgggctgcaggcgagcagggaacggctttagggagtgctccccgtgcagtgcggaggactcacagtgcgtcccggggcgccttgcatgtcacaggcagtgtcatcccccaacagggcacccttactgccgcgcctgcctggcctgccctctgtatcctccctcccctgccctctcctcctgcccctcagccgtgcct

SEQ ID NO: 61921 - DNA, 2549 bp, Homo sapiens
  misc_feature (13)..(13): n is a, c, g, or t
tcgccccgagtantatatgtgaccagccccgccgacgcgtgaaaattggggaggagttcctgactgacctgagccagctgaagaagctgctgccgctggtcagtgacgaggtgttcatcagggacgtggccaaggtcaaacaggagaacaagctcaagttctcggccttcctggagaaggagtacaaggtgaagatcaacccctcctccatgttcgacgtgcatgtgaagaggatccacgagtacaagcggcagctgctcaactgcctgcacgtcgtcaccctgtacaatcgaatcaagagagacccggccaaggcttttgtgcccaggactgttatgattgggggcaaggcagcgcccggttaccacatggccaagctgatcatcaagttggtcacctccatcggcgacgtcgtcaatcatgacccagttgtgggtgacaggttgaaagtgatcttcctggagaactaccgtgtgtccttggctgagaaagtgatcccggccgctgatctgtcgcagcagatctccactgcaggcaccgaggcctcaggcacaggcaacatgaagttcatgctcaacggggccctcaccatcggcaccatggacggcgccaacgtggagatggccgaggaggccggggccgagaacctcttcatcttcggcctgcgggtggaggatgtcgaggccttggaccggaaagggtacaatgccaggagtactacgaccacctgcccgagctgaagcaggccgtggaccagatcagcagtggctttttttctcccaaggagccagactgcttcaaggacatcgtgaacatgctgatgcaccatgacaggttcaaggtgtttgcagactatgaagcctacatgcagtgccaggcacaggtggaccaactgtaccggaaccccaaggagtggaccaagaaggtcatcaggaacatcgcctgctcgggcaagttctccagtgaccggaccatcacggagtatgcacgggagatctggggtgtggagccctccgacctgcagatcccgccccccaacatcccccgggactaggcacaccctgccttggcgggaccagcgggcatttgttttcttgctgactttgcacctccttttttccccaaacactttgccagccgctggtggtccctgcttttctgagtaccatgtttccaggaggggccatgggggtcagggtggttttgagagagcagggtaaggaaggaatgtgctagaagtgctcctagtttcttgtaaaggaagccagagttgacagtacaaagggtcgtggccagccctgcagcttcagcacctgccccacccagagtgggagtcaggtggagccacctgctgggctcccccagaactttgcacacatcttgctatgtattagccgatgtctttagtgttgagcctctggattctggggtctgggccagtggccatagtgaagcctgggaatgagtgttactgcagcatctgggctgccagccacagggaagggccaagccccatgtagccccagtcatcctgcccagccctgcctcctggccatgccgggaggggtcggatcctctaggcatcgccttcacagccccctgccccctgccctctgtcctggctctgcacctggtatatgggtcatggacccagatggggctttccctttgtagccatccaatgggcattgtgtgggtgcttggaacccgggatgactgagggggacactggagtgggtgcttgtgtctgctgtctcagaggccttggtcaggatgaagttggctgacacagcttagcttggttttgcttattcaaaagagaaaataactacacatggaaatgaaactagctgaagccttttcttgttttagcaactgaaaattgtacttggtcacttttgtgcttgaggaggcccattttctgcctggcagggggcaggtctgtgccctcccgctgactcctgctgtgtcctgaggtgcatttcctgttgtacacacaagggccaggctccattctccctccctttccaccagtgccacagcctcgtctggaaaaaggaccaggggtcccggaggaacccatttgtgctctgcttggacagcaggcctggcactgggaggtgggggtgagcccctcacagccttgcccctccccagggctggcaacctgccttccattgcccaagagagagggcagggaacaggctactgtccttccctgtggaattgccgagaaatctagcaccttgcatgctggatctgggctgcggggaggctctttttctccctggcctccagtgcccaccaggaggatctgcgcacggtgcacagcccaccagagcactacagccttttattgagtggggtggggcaagtgctgggctgtggtcgtgccctgacagcatcttccccaggcagcggctctgtggaggaggccatactcccctagttggccactggggccaccaccctgaccaccactgtgcccctcattgttactaccttgtgagataaaaactgattaaacctttgtggctgtggttggctga

SEQ ID NO: 61922 - DNA, 2481 bp, Homo sapiens
tgaggccttaagtagggtcaggtgaaaccacacatgccatctgaagtcagagctgtgccttgctggcccgagcacagaggcctgtgctccctttctgcgccctcacacagcttcttctgcccgggccccgtcctgggatgcccatgtctgcccgtctgtccctctcccacttagctctgccttgtcctgtctggtcttgcttgcgtttttccttttccatcttcgaggtcccagccaaggtgctccatttcacttcctgcccctccggccgtctgtttttcaaaagctctgcccaggatttcacagtgagccaagttctgagtggccctctccactaggaatgtggcatcagccactatgtcctagcagatctgctagtgatgacatttctttaacagtcaaaggagcaggtgggattggctttagactgacttcacatctctgctcgagcaggtccctgctcaagggcctcgtaaccacccatggccactggctgctgccctggaccgtgcaggccttgagctcccagggccatcctggggcaggggctgtgccaggcaccaacatggcttgttctccaaggtggcccacctggggcgctggctgctgactcctggcccatcgcctcacaggtacaatgccaggagtactacgaccacctgcccgagctgaagcaggccgtggaccagatcagcagtggctttttttctcccaaggagccagactgcttcaaggacatcgtgaacatgctgatgcaccatgacaggttcaaggtgtttgcagactatgaagcctacatgcagtgccaggcacaggtggaccaactgtaccggaaccccaaggagtggaccaagaaggtcatcaggaacatcgcctgctcgggcaagttctccagtgaccggaccatcacggagtatgcacgggagatctggggtgtggagccctccgacctgcagatcccgccccccaacatcccccgggactaggcacaccctgccttggcgggaccagcgggcatttgttttcttgctgactttgcacctccttttttccccaaacactttgccagccgctggtggtccctgcttttctgagtaccatgtttccaggaggggccatgggggtcagggtggttttgagagagcagggtaaggaaggaatgtgctagaagtgctcctagtttcttgtaaaggaagccagagttgacagtacaaagggtcgtggccagccctgcagcttcagcacctgccccacccagagtgggagtcaggtggagccacctgctgggctcccccagaactttgcacacatcttgctatgtattagccgatgtctttagtgttgagcctctggattctggggtctgggccagtggccatagtgaagcctgggaatgagtgttactgcagcatctgggctgccagccacagggaagggccaagccccatgtagccccagtcatcctgcccagccctgcctcctggccatgccgggaggggtcggatcctctaggcatcgccttcacagccccctgccccctgccctctgtcctggctctgcacctggtatatgggtcatggacccagatggggctttccctttgtagccatccaatgggcattgtgtgggtgcttggaacccgggatgactgagggggacactggagtgggtgcttgtgtctgctgtctcagaggccttggtcaggatgaagttggctgacacagcttagcttggttttgcttattcaaaagagaaaataactacacatggaaatgaaactagctgaagccttttcttgttttagcaactgaaaattgtacttggtcacttttgtgcttgaggaggcccattttctgcctggcagggggcaggtctgtgccctcccgctgactcctgctgtgtcctgaggtgcatttcctgttgtacacacaagggccaggctccattctccctccctttccaccagtgccacagcctcgtctggaaaaaggaccaggggtcccggaggaacccatttgtgctctgcttggacagcaggcctggcactgggaggtgggggtgagcccctcacagccttgcccctccccagggctggcaacctgccttccattgcccaagagagagggcagggaacaggctactgtccttccctgtggaattgccgagaaatctagcaccttgcatgctggatctgggctgcggggaggctctttttctccctggcctccagtgcccaccaggaggatctgcgcacggtgcacagcccaccagagcactacagccttttattgagtggggtggggcaagtgctgggctgtggtcgtgccctgacagcatcttccccaggcagcggctctgtggaggaggccatactcccctagttggccactggggccaccaccctgaccaccactgtgcccctcattgttactaccttgtgagataaaaactgattaaacctttgtggctgtggttggctga

SEQ ID NO: 61923 - DNA, 1795 bp, Homo sapiens
catgcagtgccaggcacagttggtccacctgtgcctggcactgcatgtaggcttcatagtctgcaaacaccttgaacctgtcatggtgcatcagcatgttcacgatgtccttgaagcagtctggctccttgggaccaactgtaccggaaccccaaggagtggaccaagaaggtcatcaggaacatcgcctgctcgggcaagttctccagtgaccggaccatcacggagtatgcacgggagatctggggtgtggagccctccgacctgcagatcccgccccccaacatcccccgggactaggcacaccctgccttggcgggaccagcgggcatttgttttcttgctgactttgcacctccttttttccccaaacactttgccagccgctggtggtccctgcttttctgagtaccatgtttccaggaggggccatgggggtcagggtggttttgagagagcagggtaaggaaggaatgtgctagaagtgctcctagtttcttgtaaaggaagccagagttgacagtacaaagggtcgtggccagccctgcagcttcagcacctgccccacccagagtgggagtcaggtggagccacctgctgggctcccccagaactttgcacacatcttgctatgtattagccgatgtctttagtgttgagcctctggattctggggtctgggccagtggccatagtgaagcctgggaatgagtgttactgcagcatctgggctgccagccacagggaagggccaagccccatgtagccccagtcatcctgcccagccctgcctcctggccatgccgggaggggtcggatcctctaggcatcgccttcacagccccctgccccctgccctctgtcctggctctgcacctggtatatgggtcatggacccagatggggctttccctttgtagccatccaatgggcattgtgtgggtgcttggaacccgggatgactgagggggacactggagtgggtgcttgtgtctgctgtctcagaggccttggtcaggatgaagttggctgacacagcttagcttggttttgcttattcaaaagagaaaataactacacatggaaatgaaactagctgaagccttttcttgttttagcaactgaaaattgtacttggtcacttttgtgcttgaggaggcccattttctgcctggcagggggcaggtctgtgccctcccgctgactcctgctgtgtcctgaggtgcatttcctgttgtacacacaagggccaggctccattctccctccctttccaccagtgccacagcctcgtctggaaaaaggaccaggggtcccggaggaacccatttgtgctctgcttggacagcaggcctggcactgggaggtgggggtgagcccctcacagccttgcccctccccagggctggcaacctgccttccattgcccaagagagagggcagggaacaggctactgtccttccctgtggaattgccgagaaatctagcaccttgcatgctggatctgggctgcggggaggctctttttctccctggcctccagtgcccaccaggaggatctgcgcacggtgcacagcccaccagagcactacagccttttattgagtggggtggggcaagtgctgggctgtggtcgtgccctgacagcatcttccccaggcagcggctctgtggaggaggccatactcccctagttggccactggggccaccaccctgaccaccactgtgcccctcattgttactaccttgtgagataaaaactgattaaacctttgtggctgtggttggctga

SEQ ID NO: 61924 - DNA, 3781 bp, Homo sapiens
  misc_feature (3764)..(3764): n is a, c, g, or t
  misc_feature (3768)..(3768): n is a, c, g, or t
  misc_feature (3772)..(3772): n is a, c, g, or t
gagcagctgcaccatcccggcgttcgcgtgtgccgccgctttcctcctccatctcttttcctccgcctccgccggcgcgatgggcgaaccgctgacggacagcgagaagcggaagcagatcagcgtgcgcggcctggcggggctaggcgacgtggccgaggtgcggaagagcttcaaccggcacttgcacttcacgctggtcaaggaccgcaatgtggccacgccccgcgactacttcttcgcgctggcgcacacggtgcgcgaccacctcgtgggccgctggatccgcacgcagcagcactactacgagcgcgaccccaagcgaatttattatctttccctggaattctacatgggtcgcacgctgcagaacacgatggtgaacctgggccttcagaatgcctgcgatgaagccatctatcagttggggttagacttggaggaactcgaggagatagaagaagatgctggccttgggaatggaggcctggggaggctggcagcgtgtttccttgactcaatggctaccttgggcctggcagcatacggctatggaatccgctatgaatttgggatttttaaccagaagattgtcaatggctggcaggtagaggaggccgatgactggctgcgctacggcaacccctgggagaaagcgcggcctgagtatatgcttcccgtgcacttctacggacgcgtggagcacacccccgacggcgtgaagtggctggacacacaggtggtgctggccatgccctacgacaccccagtgcccggctacaagaacaacaccgtcaacaccatgcggctgtggtccgccaaggctcccaacgacttcaagctgcaggacttcaacgtgggagactacatcgaggcggtcctggaccggaacttggctgagaacatctccagggtcctgtatccaaatgataacttctttgaggggaaggagctgcggctgaagcaggagtacttcgtggtggccgccacgctccaggacatcatccgccgcttcaagtcgtccaagttcggctgccgggaccctgtgagaacctgtttcgagacgttcccagacaaggtggccatccagctgaacgacacccaccccgccctctccatccctgagctcatgcggatcctggtggacgtggagaaggtggactgggacaaggcctgggaaatcacgaagaagacctgtgcgtacaccaaccacactgtgctgcctgaggccttggagcgctggcccgtgtccatgtttgagaagctgctgccgcggcacctggagataatctatgccatcaaccagcggcacctggaccacgtggccgcgctgtttcccggcgatgtggaccgcctgcgcaggatgtctgtgatcgaggagggggactgcaagcggatcaacatggcccacctgtgtgtgattgggtcccatgctgtcaatggtgtggcgaggatccactcggagatcgtgaaacagtcggtctttaaggatttttatgaactggagccagagaagttccagaataagaccaatggcatcaccccccgccggtggctgctgctgtgcaacccggggctggccgataccatcgtggagaaaattggggaggagttcctgactgacctgagccagctgaagaagctgctgccgctggtcagtgacgaggtgttcatcagggacgtggccaaggtcaaacaggagaacaagctcaagttctcggccttcctggagaaggagtacaaggtgaagatcaacccctcctccatgttcgacgtgcatgtgaagaggatccacgagtacaagcggcagctgctcaactgcctgcacgtcgtcaccctgtacaatcgaatcaagagagacccggccaaggcttttgtgcccaggactgttatgattgggggcaaggcagcgcccggttaccacatggccaagctgatcatcaagttggtcacctccatcggcgacgtcgtcaatcatgacccagttgtgggtgacaggttgaaagtgatcttcctggagaactaccgtgtgtccttggctgagaaagtgatcccggccgctgatctgtcgcagcagatctccactgcaggcaccgaggcctcaggcacaggcaacatgaagttcatgctcaacggggccctcaccatcggcaccatggacggcgccaacgtggagatggccgaggaggccggggccgagaacctcttcatcttcggcctgcgggtggaggatgtcgaggccttggaccggaaagggtacaatgccaggagtactacgaccacctgcccgagctgaagcaggccgtggaccagatcagcagtggctttttttctcccaaggagccagactgcttcaaggacatcgtgaacatgctgatgcaccatgacaggttcaaggtgtttgcagactatgaagcctacatgcagtgccaggcacaggtggaccaactgtaccggaaccccaaggagtggaccaagaaggtcatcaggaacatcgcctgctcgggcaagttctccagtgaccggaccatcacggagtatgcacgggagatctggggtgtggagccctccgacctgcagatcccgccccccaacatcccccgggactaggcacaccctgccttggcgggaccagcgggcatttgttttcttgctgactttgcacctccttttttccccaaacactttgccagccgctggtggtccctgcttttctgagtaccatgtttccaggaggggccatgggggtcagggtggttttgagagagcagggtaaggaaggaatgtgctagaagtgctcctagtttcttgtaaaggaagccagagttgacagtacaaagggtcgtggccagccctgcagcttcagcacctgccccacccagagtgggagtcaggtggagccacctgctgggctcccccagaactttgcacacatcttgctatgtattagccgatgtctttagtgttgagcctctggattctggggtctgggccagtggccatagtgaagcctgggaatgagtgttactgcagcatctgggctgccagccacagggaagggccaagccccatgtagccccagtcatcctgcccagccctgcctcctggccatgccgggaggggtcggatcctctaggcatcgccttcacagccccctgccccctgccctctgtcctggctctgcacctggtatatgggtcatggacccagatggggctttccctttgtagccatccaatgggcattgtgtgggtgcttggaacccgggatgactgagggggaacccatttgtgctctgcttggacagcaggcctggcactgggaggtgggggtgagcccctcacagccttgcccctccccagggctggcaacctgccttccattgcccaagagagagggcagggaacaggctactgtccttccctgtggaattgccgagaaatctagcaccttgcatgctggatctgggctgcggggaggctctttttctccctggcctccagtgcccaccaggaggatctgcgcacggtgcacagcccaccagagcactacagccttttattgagtggggtggggcaagtgctgggctgtggtcgtgccctgacagcatcttccccaggcagcggctctgtggaggaggccatactcccctagttggccactggggccaccaccctgaccaccactgtgcccctcattgttactaccttgtgagataaaaactgattaaacctttgtggctgtggttggctgaaaaaaaaaanaaanaaanaaaaaaaac

SEQ ID NO: 61925 - DNA, 3416 bp, Homo sapiens
gagcagctgcaccatcccggcgttcgcgtgtgccgccgctttcctcctccatctcttttcctccgcctccgccggcgcgatgggcgaaccgctgacggacagcgagaagcggaagcagatcagcgtgcgcggcctggcggggctaggcgacgtggccgaggtgcggaagagcttcaaccggcacttgcacttcacgctggtcaaggaccgcaatgtggccacgccccgcgactacttcttcgcgctggcgcacacggtgcgcgaccacctcgtgggccgctggatccgcacgcagcagcactactacgagcgcgaccccaagcgaatttattatctttccctggaattctacatgggtcgcacgctgcagaacacgatggtgaacctgggccttcagaatgcctgcgatgaagccatctatcagttggggttagacttggaggaactcgaggagatagaagaagatgctggccttgggaatggaggcctggggaggctggcagcgtgtttccttgactcaatggctaccttgggcctggcagcatacggctatggaatccgctatgaatttgggatttttaaccagaagattgtcaatggctggcaggtagaggaggccgatgactggctgcgctacggcaacccctgggagaaagcgcggcctgagtatatgcttcccgtgcacttctacggacgcgtggagcacacccccgacggcgtgaagtggctggacacacaggtggtgctggccatgccctacgacaccccagtgcccggctacaagaacaacaccgtcaacaccatgcggctgtggtccgccaaggctcccaacgacttcaagctgcaggacttcaacgtgggagactacatcgaggcggtcctggaccggaacttggctgagaacatctccagggtcctgtatccaaatgataacttctttgaggggaaggagctgcggctgaagcaggagtacttcgtggtggccgccacgctccaggacatcatccgccgcttcaagtcgtccaagttcggctgccgggaccctgtgagaacctgtttcgagacgttcccagacaaggtggccatccagctgaacgacacccaccccgccctctccatccctgagctcatgcggatcctggtggacgtggagaaggtggactgggacaaggcctgggaaatcacgaagaagacctgtgcgtacaccaaccacactgtgctgcctgaggccttggagcgctggcccgtgtccatgtttgagaagctgctgccgcggcacctggagataatctatgccatcaaccagcggcacctggaccacgtggccgcgctgtttcccggcgatgtggaccgcctgcgcaggatgtctgtgatcgaggagggggactgcaagcggatcaacatggcccacctgtgtgtgattgggtcccatgctgtcaatggtgtggcgaggatccactcggagatcgtgaaacagtcggtctttaaggatttttatgaactggagccagagaagttccagaataagaccaatggcatcaccccccgccggtggctgctgctgtgcaacccggggctggccgataccatcgtggagaaaattggggaggagttcctgactgacctgagccagctgaagaagctgctgccgctggtcagtgacgaggtgttcatcagggacgtggccaaggtcaaacaggagaacaagctcaagttctcggccttcctggagaaggagtacaaggtgaagatcaacccctcctccatgttcgacgtgcatgtgaagaggatccacgagtacaagcggcagctgctcaactgcctgcacgtcgtcaccctgtacaatcgaatcaagagagacccggccaaggcttttgtgcccaggactgttatgattgggggcaaggcagcgcccggttaccacatggccaagctgatcatcaagttggtcacctccatcggcgacgtcgtcaatcatgacccagttgtgggtgacaggttgaaagtgatcttcctggagaactaccgtgtgtccttggctgagaaagtgatcccggccgctgatctgtcgcagcagatctccactgcaggcaccgaggcctcaggcacaggcaacatgaagttcatgctcaacggggccctcaccatcggcaccatggacggcgccaacgtggagatggccgaggaggccggggccgagaacctcttcatcttcggcctgcgggtggaggatgtcgaggccttggaccggaaagggtacaatgccaggagtactacgaccacctgcccgagctgaagcaggccgtggaccagatcagcagtggctttttttctcccaaggagccagactgcttcaaggacatcgtgaacatgctgatgcaccatgacaggttcaaggtgtttgcagactatgaagcctacatgcagtgccaggcacaggtggaccaactgtaccggaaccccaaggagtggaccaagaaggtcatcaggaacatcgcctgctcgggcaagttctccagtgaccggaccatcacggagtatgcacgggagatctggggtgtggagccctccgacctgcagatcccgccccccaacatcccccgggactaggcacaccctgccttggcgggaccagcgggcatttgttttcttgctgactttgcacctccttttttccccaaacactttgccagccgctggtggtccctgcttttctgagtaccatgtttccaggaggggccatgggggtcagggtggttttgagagagcagggtaaggaaggaatgtgctagaagtgctcctagtttcttgtaaaggaagccagagttgacagtacaaagggtcgtggccagccctgcagcttcagcacctgccccacccagagtgggagtcaggtggagccacctgctgggctcccccagaactttgcacacatcttgctatgtattagccgatgtctttagtgttgagcctctggattctggggtctgggccagtggccatagtgaagcctgggaatgagtgttactgcaacctgccttccattgcccaagagagagggcagggaacaggctactgtccttccctgtggaattgccgagaaatctagcaccttgcatgctggatctgggctgcggggaggctctttttctccctggcctccagtgcccaccaggaggatctgcgcacggtgcacagcccaccagagcactacagccttttattgagtggggtggggcaagtgctgggctgtggtcgtgccctgacagcatcttccccaggcagcggctctgtggaggaggccatactcccctagttggccactggggccaccaccctgaccaccactgtgcccctcattgttactaccttgtgagataaaaactgattaaacctttgtggctgtggttggctga

SEQ ID NO: 61926 - DNA, 3003 bp, Homo sapiens
gagcagctgcaccatcccggcgttcgcgtgtgccgccgctttcctcctccatctcttttcctccgcctccgccggcgcgatgggcgaaccgctgacggacagcgagaagcggaagcagatcagcgtgcgcggcctggcggggctaggcgacgtggccgaggtgcggaagagcttcaaccggcacttgcacttcacgctggtcaaggaccgcaatgtggccacgccccgcgactacttcttcgcgctggcgcacacggtgcgcgaccacctcgtgggccgctggatccgcacgcagcagcactactacgagcgcgaccccaagcgaatttattatctttccctggaattctacatgggtcgcacgctgcagaacacgatggtgaacctgggccttcagaatgcctgcgatgaagccatctatcagttggggttagacttggaggaactcgaggagatagaagaagatgctggccttgggaatggaggcctggggaggctggcagcgtgtttccttgactcaatggctaccttgggcctggcagcatacggctatggaatccgctatgaatttgggatttttaaccagaagattgtcaatggctggcaggtagaggaggccgatgactggctgcgctacggcaacccctgggagaaagcgcggcctgagtatatgcttcccgtgcacttctacggacgcgtggagcacacccccgacggcgtgaagtggctggacacacaggtggtgctggccatgccctacgacaccccagtgcccggctacaagaacaacaccgtcaacaccatgcggctgtggtccgccaaggctcccaacgacttcaagctgcaggacttcaacgtgggagactacatcgaggcggtcctggaccggaacttggctgagaacatctccagggtcctgtatccaaatgataacttctttgaggggaaggagctgcggctgaagcaggagtacttcgtggtggccgccacgctccaggacatcatccgccgcttcaagtcgtccaagttcggctgccgggaccctgtgagaacctgtttcgagacgttcccagacaaggtggccatccagctgaacgacacccaccccgccctctccatccctgagctcatgcggatcctggtggacgtggagaaggtggactgggacaaggcctgggaaatcacgaagaagacctgtgcgtacaccaaccacactgtgctgcctgaggccttggagcgctggcccgtgtccatgtttgagaagctgctgccgcggcacctggagataatctatgccatcaaccagcggcacctggaccacgtggccgcgctgtttcccggcgatgtggaccgcctgcgcaggatgtctgtgatcgaggagggggactgcaagcggatcaacatggcccacctgtgtgtgattgggtcccatgctgtcaatggtgtggcgaggatccactcggagatcgtgaaacagtcggtctttaaggatttttatgaactggagccagagaagttccagaataagaccaatggcatcaccccccgccggtggctgctgctgtgcaacccggggctggccgataccatcgtggagaaaattggggaggagttcctgactgacctgagccagctgaagaagctgctgccgctggtcagtgacgaggtgttcatcagggacgtggccaaggtcaaacaggagaacaagctcaagttctcggccttcctggagaaggagtacaaggtgaagatcaacccctcctccatgttcgacgtgcatgtgaagaggatccacgagtacaagcggcagctgctcaactgcctgcacgtcgtcaccctgtacaatcgaatcaagagagacccggccaaggcttttgtgcccaggactgttatgattgggggcaaggcagcgcccggttaccacatggccaagctgatcatcaagttggtcacctccatcggcgacgtcgtcaatcatgacccagttgtgggtgacaggttgaaagtgatcttcctggagaactaccgtgtgtccttggctgagaaagtgatcccggccgctgatctgtcgcagcagatctccactgcaggcaccgaggcctcaggcacaggcaacatgaagttcatgctcaacggggccctcaccatcggcaccatggacggcgccaacgtggagatggccgaggaggccggggccgagaacctcttcatcttcggcctgcgggtggaggatgtcgaggccttggaccggaaagggtacaatgccaggagtactacgaccacctgcccgagctgaagcaggccgtggaccagatcagcagtggctttttttctcccaaggagccagactgcttcaaggacatcgtgaacatgctgatgcaccatgacaggttcaaggtgtttgcagactatgaagcctacatgcagtgccaggcacaggtggaccaactgtaccggaaccccaaggagtggaccaagaaggtcatcaggaacatcgcctgctcgggcaagttctccagtgaccggaccatcacggagtatgcacgggagatctggggtgtggagccctccgacctgcagatcccgccccccaacatcccccgggactaggcacaccctgccttggcgggaccagcgggcatttgttttcttgctgactttgcacctccttttttccccaaacactttgccagccgctggtggtccctgcttttctgagtaccatgtttccaggaggggccatgggggtcagggtggttttgagagagcagggtaaggaaggaatgtgctagaagtgctcctagtttcttgtaaaggaagccagagttgacagtacaaagggtcgtgccctgacagcatcttccccaggcagcggctctgtggaggaggccatactcccctagttggccactggggccaccaccctgaccaccactgtgcccctcattgttactaccttgtgagataaaaactgattaaacctttgtggctgtggttggctga

SEQ ID NO: 61927 - DNA, 1708 bp, Homo sapiens
tgaggccttaagtagggtcaggtgaaaccacacatgccatctgaagtcagagctgtgccttgctggcccgagcacagaggcctgtgctccctttctgcgccctcacacagcttcttctgcccgggccccgtcctgggatgcccatgtctgcccgtctgtccctctcccacttagctctgccttgtcctgtctggtcttgcttgcgtttttccttttccatcttcgaggtcccagccaaggtgctccatttcacttcctgcccctccggccgtctgtttttcaaaagctctgcccaggatttcacagtgagccaagttctgagtggccctctccactaggaatgtggcatcagccactatgtcctagcagatctgctagtgatgacatttctttaacagtcaaaggagcaggtgggattggctttagactgacttcacatctctgctcgagcaggtccctgctcaagggcctcgtaaccacccatggccactggctgctgccctggaccgtgcaggccttgagctcccagggccatcctggggcaggggctgtgccaggcaccaacatggcttgttctccaaggtggcccacctggggcgctggctgctgactcctggcccatcgcctcacaggagccagactgcttcaaggacatcgtgaacatgctgatgcaccatgacaggttcaaggtgtttgcagactatgaagcctacatgcagtgccaggcacaggtggaccaactgtaccggaaccccaaggagtggaccaagaaggtcatcaggaacatcgcctgctcgggcaagttctccagtgaccggaccatcacggagtatgcacgggagatctggggtgtggagccctccgacctgcagatcccgccccccaacatcccccgggactaggcacaccctgccttggcgggaccagcgggcatttgttttcttgctgactttgcacctccttttttccccaaacactttgccagccgctggtggtccctgcttttctgagtaccatgtttccaggaggggccatgggggtcagggtggttttgagagagcagggtaaggaaggaatgtgctagaagtgctcctagtttcttgtaaaggaagccagagttgacagtacaaagggtcgtggccagccctgcagcttcagcacctgccccacccagagtgggagtcaggtggagccacctgctgggctcccccagaactttgcacacatcttgctatgtattagccgatgtctttagtgttgagcctctggattctggggtctgggccagtggccatagtgaagcctgggaatgagtgttactgcaacctgccttccattgcccaagagagagggcagggaacaggctactgtccttccctgtggaattgccgagaaatctagcaccttgcatgctggatctgggctgcggggaggctctttttctccctggcctccagtgcccaccaggaggatctgcgcacggtgcacagcccaccagagcactacagccttttattgagtggggtggggcaagtgctgggctgtggtcgtgccctgacagcatcttccccaggcagcggctctgtggaggaggccatactcccctagttggccactggggccaccaccctgaccaccactgtgcccctcattgttactaccttgtgagataaaaactgattaaacctttgtggctgtggttggctga

SEQ ID NO: 61928 - DNA, 4105 bp, Homo sapiens
gagcagctgcaccatcccggcgttcgcgtgtgccgccgctttcctcctccatctcttttcctccgcctccgccggcgcgatgggcgaaccgctgacggacagcgagaagcggaagcagatcagcgtgcgcggcctggcggggctaggcgacgtggccgaggtgcggaagagcttcaaccggcacttgcacttcacgctggtcaaggaccgcaatgtggccacgccccgcgactacttcttcgcgctggcgcacacggtgcgcgaccacctcgtgggccgctggatccgcacgcagcagcactactacgagcgcgaccccaagcgaatttattatctttccctggaattctacatgggtcgcacgctgcagaacacgatggtgaacctgggccttcagaatgcctgcgatgaagccatctatcagttggggttagacttggaggaactcgaggagatagaagaagatgctggccttgggaatggaggcctggggaggctggcagcgtgtttccttgactcaatggctaccttgggcctggcagcatacggctatggaatccgctatgaatttgggatttttaaccagaagattgtcaatggctggcaggtagaggaggccgatgactggctgcgctacggcaacccctgggagaaagcgcggcctgagtatatgcttcccgtgcacttctacggacgcgtggagcacacccccgacggcgtgaagtggctggacacacaggtggtgctggccatgccctacgacaccccagtgcccggctacaagaacaacaccgtcaacaccatgcggctgtggtccgccaaggctcccaacgacttcaagctgcaggacttcaacgtgggagactacatcgaggcggtcctggaccggaacttggctgagaacatctccagggtcctgtatccaaatgataacttctttgaggggaaggagctgcggctgaagcaggagtacttcgtggtggccgccacgctccaggacatcatccgccgcttcaagtcgtccaagttcggctgccgggaccctgtgagaacctgtttcgagacgttcccagacaaggtggccatccagctgaacgacacccaccccgccctctccatccctgagctcatgcggatcctggtggacgtggagaaggtggactgggacaaggcctgggaaatcacgaagaagacctgtgcgtacaccaaccacactgtgctgcctgaggccttggagcgctggcccgtgtccatgtttgagaagctgctgccgcggcacctggagataatctatgccatcaaccagcggcacctggaccacgtggccgcgctgtttcccggcgatgtggaccgcctgcgcaggatgtctgtgatcgaggagggggactgcaagcggatcaacatggcccacctgtgtgtgattgggtcccatgctgtcaatggtgtggcgaggatccactcggagatcgtgaaacagtcggtctttaaggatttttatgaactggagccagagaagttccagaataagaccaatggcatcaccccccgccggtggctgctgctgtgcaacccggggctggccgataccatcgtggagaaaattggggaggagttcctgactgacctgagccagctgaagaagctgctgccgctggtcagtgacgaggtgttcatcagggacgtggccaaggtcaaacaggagaacaagctcaagttctcggccttcctggagaaggagtacaaggtgaagatcaacccctcctccatgttcgacgtgcatgtgaagaggatccacgagtacaagcggcagctgctcaactgcctgcacgtcgtcaccctgtacaatcgaatcaagagagacccggccaaggcttttgtgcccaggactgttatgattgggggcaaggcagcgcccggttaccacatggccaagctgatcatcaagttggtcacctccatcggcgacgtcgtcaatcatgacccagttgtgggtgacaggttgaaagtgatcttcctggagaactaccgtgtgtccttggctgagaaagtgatcccggccgctgatctgtcgcagcagatctccactgcaggcaccgaggcctcaggcacaggcaacatgaagttcatgctcaacggggccctcaccatcggcaccatggacggcgccaacgtggagatggccgaggaggccggggccgagaacctcttcatcttcggcctgcgggtggaggatgtcgaggccttggaccggaaagggtacaatgccaggagtactacgaccacctgcccgagctgaagcaggccgtggaccagatcagcagtggctttttttctcccaaggagccagactgcttcaaggacatcgtgaacatgctgatgcaccatgacaggttcaaggtgtttgcagactatgaagcctacatgcagtgccaggcacaggtggaccaactgtaccggaaccccaaggagtggaccaagaaggtcatcaggaacatcgcctgctcgggcaagttctccagtgaccggaccatcacggagtatgcacgggagatctggggtgtggagccctccgacctgcagatcccgccccccaacatcccccgggactaggcacaccctgccttggcgggaccagcgggcatttgttttcttgctgactttgcacctccttttttccccaaacactttgccagccgctggtggtccctgcttttctgagtaccatgtttccaggaggggccatgggggtcagggtggttttgagagagcagggtaaggaaggaatgtgctagaagtgctcctagtttcttgtaaaggaagccagagttgacagtacaaagggtcgtggccagccctgcagcttcagcacctgccccacccagagtgggagtcaggtggagccacctgctgggctcccccagaactttgcacacatcttgctatgtattagccgatgtctttagtgttgagcctctggattctggggtctgggccagtggccatagtgaagcctgggaatgagtgttactgcagcatctgggctgccagccacagggaagggccaagccccatgtagccccagtcatcctgcccagccctgcctcctggccatgccgggaggggtcggatcctctaggcatcgccttcacagccccctgccccctgccctctgtcctggctctgcacctggtatatgggtcatggacccagatggggctttccctttgtagccatccaatgggcattgtgtgggtgcttggaacccgggatgactgagggggacactggagtgggtgcttgtgtctgctgtctcagaggccttggtcaggatgaagttggctgacacagcttagcttggttttgcttattcaaaagagaaaataactacacatggaaatgaaactagctgaagccttttcttgttttagcaactgaaaattgtacttggtcacttttgtgcttgaggaggcccattttctgcctggcagggggcaggtctgtgccctcccgctgactcctgctgtgtcctgaggtgcatttcctgttgtacacacaagggccaggctccattctccctccctttccaccagtgccacagcctcgtctggaaaaaggaccaggggtcccggaggaacccatttgtgctctgcttggacagcaggcctggcactgggaggtgggggtgagcccctcacagccttgcccctccccagggctggcaacctgccttccattgcccaagagagagggcagggaacaggctactgtccttccctgtggaattgccgagaaatctagcaccttgcatgctggatctgggctgcggggaggctctttttctccctggcctccagtgcccaccaggaggatctgcgcacggtgcacagcccaccagagcactacagccttttattgagtggggtggggcaagtgctgggctgtggtcgtgccctgacagcatcttccccaggcagcggctctgtggaggaggccatactcccctagttggccactggggccaccaccctgaccaccactgtgcccctcattgttactaccttgtgagataaaaactgattaaacctttgtggctgtggttggctga

SEQ ID NO: 61929 - DNA, 4050 bp, Homo sapiens
gagcagctgcaccatcccggcgttcgcgtgtgccgccgctttcctcctccatctcttttcctccgcctccgccggcgcgatgggcgaaccgctgacggacagcgagaagcggaagcagatcagcgtgcgcggcctggcggggctaggcgacgtggccgaggtgcggaagagcttcaaccggcacttgcacttcacgctggtcaaggaccgcaatgtggccacgccccgcgactacttcttcgcgctggcgcacacggtgcgcgaccacctcgtgggccgctggatccgcacgcagcagcactactacgagcgcgaccccaagcgaatttattatctttccctggaattctacatgggtcgcacgctgcagaacacgatggtgaacctgggccttcagaatgcctgcgatgaagccatctatcagttggggttagacttggaggaactcgaggagatagaagaagatgctggccttgggaatggaggcctggggaggctggcagcgtgtttccttgactcaatggctaccttgggcctggcagcatacggctatggaatccgctatgaatttgggatttttaaccagaagattgtcaatggctggcaggtagaggaggccgatgactggctgcgctacggcaacccctgggagaaagcgcggcctgagtatatgcttcccgtgcacttctacggacgcgtggagcacacccccgacggcgtgaagtggctggacacacaggtggtgctggccatgccctacgacaccccagtgcccggctacaagaacaacaccgtcaacaccatgcggctgtggtccgccaaggctcccaacgacttcaagctgcaggacttcaacgtgggagactacatcgaggcggtcctggaccggaacttggctgagaacatctccagggtcctgtatccaaatgataacttctttgaggggaaggagctgcggctgaagcaggagtacttcgtggtggccgccacgctccaggacatcatccgccgcttcaagtcgtccaagttcggctgccgggaccctgtgagaacctgtttcgagacgttcccagacaaggtggccatccagctgaacgacacccaccccgccctctccatccctgagctcatgcggatcctggtggacgtggagaaggtggactgggacaaggcctgggaaatcacgaagaagacctgtgcgtacaccaaccacactgtgctgcctgaggccttggagcgctggcccgtgtccatgtttgagaagctgctgccgcggcacctggagataatctatgccatcaaccagcggcacctggaccacgtggccgcgctgtttcccggcgatgtggaccgcctgcgcaggatgtctgtgatcgaggagggggactgcaagcggatcaacatggcccacctgtgtgtgattgggtcccatgctgtcaatggtgtggcgaggatccactcggagatcgtgaaacagtcggtctttaaggatttttatgaactggagccagagaagttccagaataagaccaatggcatcaccccccgccggtggctgctgctgtgcaacccggggctggccgataccatcgtggagtggtcagtgacgaggtgttcatcagggacgtggccaaggtcaaacaggagaacaagctcaagttctcggccttcctggagaaggagtacaaggtgaagatcaacccctcctccatgttcgacgtgcatgtgaagaggatccacgagtacaagcggcagctgctcaactgcctgcacgtcgtcaccctgtacaatcgaatcaagagagacccggccaaggcttttgtgcccaggactgttatgattgggggcaaggcagcgcccggttaccacatggccaagctgatcatcaagttggtcacctccatcggcgacgtcgtcaatcatgacccagttgtgggtgacaggttgaaagtgatcttcctggagaactaccgtgtgtccttggctgagaaagtgatcccggccgctgatctgtcgcagcagatctccactgcaggcaccgaggcctcaggcacaggcaacatgaagttcatgctcaacggggccctcaccatcggcaccatggacggcgccaacgtggagatggccgaggaggccggggccgagaacctcttcatcttcggcctgcgggtggaggatgtcgaggccttggaccggaaagggtacaatgccaggagtactacgaccacctgcccgagctgaagcaggccgtggaccagatcagcagtggctttttttctcccaaggagccagactgcttcaaggacatcgtgaacatgctgatgcaccatgacaggttcaaggtgtttgcagactatgaagcctacatgcagtgccaggcacaggtggaccaactgtaccggaaccccaaggagtggaccaagaaggtcatcaggaacatcgcctgctcgggcaagttctccagtgaccggaccatcacggagtatgcacgggagatctggggtgtggagccctccgacctgcagatcccgccccccaacatcccccgggactaggcacaccctgccttggcgggaccagcgggcatttgttttcttgctgactttgcacctccttttttccccaaacactttgccagccgctggtggtccctgcttttctgagtaccatgtttccaggaggggccatgggggtcagggtggttttgagagagcagggtaaggaaggaatgtgctagaagtgctcctagtttcttgtaaaggaagccagagttgacagtacaaagggtcgtggccagccctgcagcttcagcacctgccccacccagagtgggagtcaggtggagccacctgctgggctcccccagaactttgcacacatcttgctatgtattagccgatgtctttagtgttgagcctctggattctggggtctgggccagtggccatagtgaagcctgggaatgagtgttactgcagcatctgggctgccagccacagggaagggccaagccccatgtagccccagtcatcctgcccagccctgcctcctggccatgccgggaggggtcggatcctctaggcatcgccttcacagccccctgccccctgccctctgtcctggctctgcacctggtatatgggtcatggacccagatggggctttccctttgtagccatccaatgggcattgtgtgggtgcttggaacccgggatgactgagggggacactggagtgggtgcttgtgtctgctgtctcagaggccttggtcaggatgaagttggctgacacagcttagcttggttttgcttattcaaaagagaaaataactacacatggaaatgaaactagctgaagccttttcttgttttagcaactgaaaattgtacttggtcacttttgtgcttgaggaggcccattttctgcctggcagggggcaggtctgtgccctcccgctgactcctgctgtgtcctgaggtgcatttcctgttgtacacacaagggccaggctccattctccctccctttccaccagtgccacagcctcgtctggaaaaaggaccaggggtcccggaggaacccatttgtgctctgcttggacagcaggcctggcactgggaggtgggggtgagcccctcacagccttgcccctccccagggctggcaacctgccttccattgcccaagagagagggcagggaacaggctactgtccttccctgtggaattgccgagaaatctagcaccttgcatgctggatctgggctgcggggaggctctttttctccctggcctccagtgcccaccaggaggatctgcgcacggtgcacagcccaccagagcactacagccttttattgagtggggtggggcaagtgctgggctgtggtcgtgccctgacagcatcttccccaggcagcggctctgtggaggaggccatactcccctagttggccactggggccaccaccctgaccaccactgtgcccctcattgttactaccttgtgagataaaaactgattaaacctttgtggctgtggttggctga

SEQ ID NO: 61930 - DNA, 4140 bp, Homo sapiens
gagcagctgcaccatcccggcgttcgcgtgtgccgccgctttcctcctccatctcttttcctccgcctccgccggcgcgatgggcgaaccgctgacggacagcgagaagcggaagcagatcagcgtgcgcggcctggcggggctaggcgacgtggccgaggtgcggaagagcttcaaccggcacttgcacttcacgctggtcaaggaccgcaatgtggccacgccccgcgactacttcttcgcgctggcgcacacggtgcgcgaccacctcgtgggccgctggatccgcacgcagcagcactactacgagcgcgaccccaagcgaatttattatctttccctggaattctacatgggtcgcacgctgcagaacacgatggtgaacctgggccttcagaatgcctgcgatgaagccatctatcagttggggttagacttggaggaactcgaggagatagaagaagatgctggccttgggaatggaggcctggggaggctggcagcgtgtttccttgactcaatggctaccttgggcctggcagcatacggctatggaatccgctatgaatttgggatttttaaccagaagattgtcaatggctggcaggtagaggaggccgatgactggctgcgctacggcaacccctgggagaaagcgcggcctgagtatatgcttcccgtgcacttctacggacgcgtggagcacacccccgacggcgtgaagtggctggacacacaggtggtgctggccatgccctacgacaccccagtgcccggctacaagaacaacaccgtcaacaccatgcggctgtggtccgccaaggctcccaacgacttcaagctgcaggacttcaacgtgggagactacatcgaggcggtcctggaccggaacttggctgagaacatctccagggtcctgtatccaaatgataacttctttgaggggaaggagctgcggctgaagcaggagtacttcgtggtggccgccacgctccaggacatcatccgccgcttcaagtcgtccaagttcggctgccgggaccctgtgagaacctgtttcgagacgttcccagacaaggtggccatccagctgaacgacacccaccccgccctctccatccctgagctcatgcggatcctggtggacgtggagaaggtggactgggacaaggcctgggaaatcacgaagaagacctgtgcgtacaccaaccacactgtgctgcctgaggccttggagcgctggcccgtgtccatgtttgagaagctgctgccgcggcacctggagataatctatgccatcaaccagcggcacctggaccacgtggccgcgctgtttcccggcgatgtggaccgcctgcgcaggatgtctgtgatcgaggagggggactgcaagcggatcaacatggcccacctgtgtgtgattgggtcccatgctgtcaatggtgtggcgaggatccactcggagatcgtgaaacagtcggtctttaaggatttttatgaactggagccagagaagttccagaataagaccaatggcatcaccccccgccggtggctgctgctgtgcaacccggggctggccgataccatcgtggagaaaattggggaggagttcctgactgacctgagccagctgaagaagctgctgccgctggtcagtgacgaggtgttcatcagggacgtggccaaggtcaaacaggagaacaagctcaagttctcggccttcctggagaaggagtacaaggtgaagatcaacccctcctccatgttcgacgtgcatgtgaagaggatccacgagtacaagcggcagctgctcaactgcctgcacgtcgtcaccctgtacaatcgaatcaagagagacccggccaaggcttttgtgcccaggactgttatgattgggggcaaggcagcgcccggttaccacatggccaagctgatcatcaagttggtcacctccatcggcgacgtcgtcaatcatgacccagttgtgggtgacaggttgaaagtgatcttcctggagaactaccgtgtgtccttggctgagaaagtgatcccggccgctgatctgtcgcagcagatctccactgcaggcaccgaggcctcaggcacaggcaacatgaagttcatgctcaacggggccctcaccatcggcaccatggacggcgccaacgtggagatggccgaggaggccggggccgagaacctcttcatcttcggcctgcgggtggaggatgtcgaggccttggaccggaaagggtacaatgccaggagtactacgaccacctgcccgagctgaagcaggccgtggaccagatcagcagtggctttttttctcccaaggagccagactgcttcaaggacatcgtgaacatgctgatgcaccatgacaggttcaaggtgtttgcagactatgaagcctacatgcagtgccaggcacaggtggaccaactgtaccggaaccccaaggagtggaccaagaaggtcatcaggaacatcgcctgctcgggcaagttctccagtgaccggaccatcacggagtatgcacgggagatctggggtgtggagccctccgacctgcagatcccgccccccaacatcccccgggactaggcacaccctgccttggcgggaccagcgggcatttgttttcttgctgactttgcacctccttttttccccaaacactttgccagccgctggtggtccctgcttttctgagtaccatgtttccaggaggggccatgggggtcagggtggttttgagagagcagggtaaggaaggaatgtgctagaagtgctcctagtttcttgtaaaggaagccagagttgacagtacaaagggtcgtggccagccctgcagcttcagcacctgccccacccagagtgggagtcaggtggagccacctgctgggctcccccagaactttgcacacatcttgctatgtattagccgatgtctttagtgttgagcctctggattctggggtctgggccagtggccatagtgaagcctgggaatgagtgttactgcagcatctgggctgccagccacagggaagggccaagccccatgtagccccagtcatcctgcccagccctgcctcctggccatgccgggaggggtcggatcctctaggcatcgccttcacagccccctgccccctgccctctgtcctggctctgcacctggtatatgggtcatggacccagatggggctttccctttgtagccatccaatgggcattgtgtgggtgcttggaacccgggatgactgagggggacactggagtgggtgcttgtgtctgctgtctcagaggccttggtcaggatgaagttggctgacacagcttagcttggttttgcttattcaaaagagaaaataactacacatggaaatgaaactagctgaagccttttcttgttttagcaactgaaaattgtacttggtcacttttgtgcttgaggaggcccattttctgcctggcagggggcaggtctgtgccctcccgctgactcctgctgtgtcctgaggtgcatttcctgttgtacacacaagggccaggctccattctccctccctttccaccagtgccacagcctcgtctggaaaaaggaccaggggtcccggaggaacccatttgtgctctgcttggacagcaggcctggcactgggaggtgggggtgagcccctcacagccttgcccctccccagggctggcaacctgccttccattgcccaagagagagggcagggaacaggctactgtccttccctgtggaattgccgagaaatctagcaccttgcatgctggatctgggctgcggggaggctctttttctccctggcctccagtgcccaccaggaggatctgcgcacggtgcacagcccaccagagcactacagccttttattgagtggggtggggcaagtgctgggctgtggtcgtgccctgacagcatcttccccaggcagcggctctgtggaggaggccatactcccctagttggccactggggccaccaccctgaccaccactgtgcccctcattgttactaccttgtgagataaaaactgattaaacctttgtggctgtggttggctgaaaaaaacaaaaggggggcggaaaaaacccacgggc

SEQ ID NO: 61931 - DNA, 4265 bp, Homo sapiens
gagcagctgcaccatcccggcgttcgcgtgtgccgccgctttcctcctccatctcttttcctccgcctccgccggcgcgatgggcgaaccgctgacggacagcgagaagcggaagcagatcagcgtgcgcggcctggcggggctaggcgacgtggccgaggtgcggaagagcttcaaccggcacttgcacttcacgctggtcaaggaccgcaatgtggccacgccccgcgactacttcttcgcgctggcgcacacggtgcgcgaccacctcgtgggccgctggatccgcacgcagcagcactactacgagcgcgaccccaagcgaatttattatctttccctggaattctacatgggtcgcacgctgcagaacacgatggtgaacctgggccttcagaatgcctgcgatgaagccatctatcagttggggttagacttggaggaactcgaggagatagaagaagatgctggccttgggaatggaggcctggggaggctggcagcgtgtttccttgactcaatggctaccttgggcctggcagcatacggctatggaatccgctatgaatttgggatttttaaccagaagattgtcaatggctggcaggtagaggaggccgatgactggctgcgctacggcaacccctgggagaaagcgcggcctgagtatatgcttcccgtgcacttctacggacgcgtggagcacacccccgacggcgtgaagtggctggacacacaggtggtgctggccatgccctacgacaccccagtgcccggctacaagaacaacaccgtcaacaccatgcggctgtggtccgccaaggctcccaacgacttcaagctgcaggacttcaacgtgggagactacatcgaggcggtcctggaccggaacttggctgagaacatctccagggtcctgtatccaaatgataacttctttgaggggaaggagctgcggctgaagcaggagtacttcgtggtggccgccacgctccaggacatcatccgccgcttcaagtcgtccaagttcggctgccgggaccctgtgagaacctgtttcgagacgttcccagacaaggtggccatccagctgaacgacacccaccccgccctctccatccctgagctcatgcggatcctggtggacgtggagaaggtggactgggacaaggcctgggaaatcacgaagaagacctgtgcgtacaccaaccacactgtgctgcctgaggccttggagcgctggcccgtgtccatgtttgagaagctgctgccgcggcacctggagataatctatgccatcaaccagcggcacctggaccacgtggccgcgctgtttcccggcgatgtggaccgcctgcgcaggatgtctgtgatcgaggagggggactgcaagcggatcaacatggcccacctgtgtgtgattgggtcccatgctgtcaatggtgtggcgaggatccactcggagatcgtgaaacagtcggtctttaaggatttttatgaactggagccagagaagttccagaataagaccaatggcatcaccccccgccggtggctgctgctgtgcaacccggggctggccgataccatcgtggagaaaattggggaggagttcctgactgacctgagccagctgaagaagctgctgccgctggtcagtgacgaggtgttcatcagggacgtggccaaggtcaaacaggagaacaagctcaagttctcggccttcctggagaaggagtacaaggtgaagatcaacccctcctccatgttcgacgtgcatgtgaagaggatccacgagtacaagcggcagctgctcaactgcctgcacgtcgtcaccctgtacaatcgaatcaagagagacccggccaaggcttttgtgcccaggactgttatgattgggggcaaggcagcgcccggttaccacatggccaagctgatcatcaagttggtcacctccatcggcgacgtcgtcaatcatgacccagttgtgggtgacaggttgaaagtgatcttcctggagaactaccgtgtgtccttggctgagaaagtgatcccggccgctgatctgtcgcagcagatctccactgcaggcaccgaggcctcaggcacaggcaacatgaagttcatgctcaacggggccctcaccatcggcaccatggacggcgccaacgtggagatggccgaggaggccggggccgagaacctcttcatcttcggcctgcgggtggaggatgtcgaggccttggaccggaaagggtacaatgccaggagtactacgaccacctgcccgagctgaagcaggccgtggaccagatcagcagtggctttttttctcccaaggagccagactgcttcaaggacatcgtgaacatgctgatgcaccatgacaggttcaaggtgtttgcagactatgaagcctacatgcagtgccaggcacaggtggaccaactgtaccggaaccccaaggagtggaccaagaaggtcatcaggaacatcgcctgctcgggcaagttctccagtgaccggaccatcacggagtatgcacgggagatctggggtgtggagccctccgacctgcagatcccgccccccaacatcccccgggactaggcacaccctgccttggcgggaccagcgggcatttgttttcttgctgactttgcacctccttttttccccaaacactttgccagccgctggtggtccctgcttttctgagtaccatgtttccaggaggggccatgggggtcagggtggttttgagagagcagggtaaggaaggaatgtgctagaagtgctcctagtttcttgtaaaggaagccagagttgacagtacaaagggtcgtggccagccctgcagcttcagcacctgccccacccagagtgggagtcaggtggagccacctgctgggctcccccagaactttgcacacatcttgctatgtattagccgatgtctttagtgttgagcctctggattctggggtctgggccagtggccatagtgaagcctgggaatgagtgttactgcagcatctgggctgccagccacagggaagggccaagccccatgtagccccagtcatcctgcccagccctgcctcctggccatgccgggaggggtcggatcctctaggcatcgccttcacagccccctgccccctgccctctgtcctggctctgcacctggtatatgggtcatggacccagatggggctttccctttgtagccatccaatgggcattgtgtgggtgcttggaacccgggatgactgagggggacactggagtgggtgcttgtgtctgctgtctcagaggccttggtcaggatgaagttggctgacacagcttagcttggttttgcttattcaaaagagaaaataactacacatggaaatgaaactagctgaagccttttcttgttttagcaactgaaaattgtacttggtcacttttgtgcttgaggaggcccattttctgcctggcagggggcaggtctgtgccctcccgctgactcctgctgtgtcctgaggtgcatttcctgttgtacacacaagggccaggctccattctccctccctttccaccagtgccacagcctcgtctggaaaaaggaccaggggtcccggaggaacccatttgtgctctgcttggacagcaggcctggcactgggaggtgggggtgagcccctcacagccttgcccctccccagggctggcaacctgccttccattgcccaagagagagggcagggaacaggctactgtccttccctgtggaattgccgagaaatctagcaccttgcatgctggatctgggctgcggggaggctctttttctccctggcctccagtgcccaccaggaggatctgcgcacggtgcacagcccaccagagcactacagccttttattgagtggggtggggcaagtgctgggctgtggtcgtgccctgacagcatcttccccaggcagcggctctgtggaggaggccatactcccctagttggccactggggccaccaccctgaccaccactgtgcccctcattgttactaccttgtgagataaaaactgattaaacctttgtggctgtggttggctgaaaaaaaaaaaaatatttaagaaaaaacaaaatttaactataaaataaaaattaattttaaaattatggaaataaaatttctaaaaaacttgagataacaaatctgaggggggggcccgtacccccatttccccctatagggggccatttcacatttccat

SEQ ID NO: 61932 - DNA, 3814 bp, Homo sapiens
  misc_feature (3797)..(3797): n is a, c, g, or t
  misc_feature (3801)..(3801): n is a, c, g, or t
  misc_feature (3805)..(3805): n is a, c, g, or t
gagcagctgcaccatcccggcgttcgcgtgtgccgccgctttcctcctccatctcttttcctccgcctccgccggcgcgatgggcgaaccgctgacggacagcgagaagcggaagcagatcagcgtgcgcggcctggcggggctaggcgacgtggccgaggtgcggaagagcttcaaccggcacttgcacttcacgctggtcaaggaccgcaatgtggccacgccccgcgactacttcttcgcgctggcgcacacggtgcgcgaccacctcgtgggccgctggatccgcacgcagcagcactactacgagcgcgaccccaagcgaatttattatctttccctggaattctacatgggtcgcacgctgcagaacacgatggtgaacctgggccttcagaatgcctgcgatgaagccatctatcagttggggttagacttggaggaactcgaggagatagaagaagatgctggccttgggaatggaggcctggggaggctggcagcgtgtttccttgactcaatggctaccttgggcctggcagcatacggctatggaatccgctatgaatttgggatttttaaccagaagattgtcaatggctggcaggtagaggaggccgatgactggctgcgctacggcaacccctgggagaaagcgcggcctgagtatatgcttcccgtgcacttctacggacgcgtggagcacacccccgacggcgtgaagtggctggacacacaggtggtgctggccatgccctacgacaccccagtgcccggctacaagaacaacaccgtcaacaccatgcggctgtggtccgccaaggctcccaacgacttcaagctgcaggacttcaacgtgggagactacatcgaggcggtcctggaccggaacttggctgagaacatctccagggtcctgtatccaaatgataacttctttgaggggaaggagctgcggctgaagcaggagtacttcgtggtggccgccacgctccaggacatcatccgccgcttcaagtcgtccaagttcggctgccgggaccctgtgagaacctgtttcgagacgttcccagacaaggtggccatccagctgaacgacacccaccccgccctctccatccctgagctcatgcggatcctggtggacgtggagaaggtggactgggacaaggcctgggaaatcacgaagaagacctgtgcgtacaccaaccacactgtgctgcctgaggccttggagcgctggcccgtgtccatgtttgagaagctgctgccgcggcacctggagataatctatgccatcaaccagcggcacctggaccacgtggccgcgctgtttcccggcgatgtggaccgcctgcgcaggatgtctgtgatcgaggagggggactgcaagcggatcaacatggcccacctgtgtgtgattgggtcccatgctgtcaatggtgtggcgaggatccactcggagatcgtgaaacagtcggtctttaaggatttttatgaactggagccagagaagttccagaataagaccaatggcatcaccccccgccggtggctgctgctgtgcaacccggggctggccgataccatcgtggagaaaattggggaggagttcctgactgacctgagccagctgaagaagctgctgccgctggtcagtgacgaggtgttcatcagggacgtggccaaggtcaaacaggagaacaagctcaagttctcggccttcctggagaaggagtacaaggtgaagatcaacccctcctccatgttcgacgtgcatgtgaagaggatccacgagtacaagcggcagctgctcaactgcctgcacgtcgtcaccctgtacaatcgaatcaagagagacccggccaaggcttttgtgcccaggactgttatgattgggggcaaggcagcgcccggttaccacatggccaagctgatcatcaagttggtcacctccatcggcgacgtcgtcaatcatgacccagttgtgggtgacaggttgaaagtgatcttcctggagaactaccgtgtgtccttggctgagaaagtgatcccggccgctgatctgtcgcagcagatctccactgcaggcaccgaggcctcaggcacaggcaacatgaagttcatgctcaacggggccctcaccatcggcaccatggacggcgccaacgtggagatggccgaggaggccggggccgagaacctcttcatcttcggcctgcgggtggaggatgtcgaggccttggaccggaaagggtacaatgccaggagtactacgaccacctgcccgagctgaagcaggccgtggaccagatcagcagtggctttttttctcccaaggagccagactgcttcaaggacatcgtgaacatgctgatgcaccatgacaggttcaaggtgtttgcagactatgaagcctacatgcagtgccaggcacaggtggaccaactgtaccggaaccccaaggagtggaccaagaaggtcatcaggaacatcgcctgctcgggcaagttctccagtgaccggaccatcacggagtatgcacgggagatctggggtgtggagccctccgacctgcagatcccgccccccaacatcccccgggactaggcacaccctgccttggcgggaccagcgggcatttgttttcttgctgactttgcacctccttttttccccaaacactttgccagccgctggtggtccctgcttttctgagtaccatgtttccaggaggggccatgggggtcagggtggttttgagagagcagggtaaggaaggaatgtgctagaagtgctcctagtttcttgtaaaggaagccagagttgacagtacaaagggtcgtggccagccctgcagcttcagcacctgccccacccagagtgggagtcaggtggagccacctgctgggctcccccagaactttgcacacatcttgctatgtattagccgatgtctttagtgttgagcctctggattctggggtctgggccagtggccatagtgaagcctgggaatgagtgttactgcagcatctgggctgccagccacagggaagggccaagccccatgtagccccagtcatcctgcccagccctgcctcctggccatgccgggaggggtcggatcctctaggcatcgccttcacagccccctgccccctgccctctgtcctggctctgcacctggtatatgggtcatggacccagatggggctttccctttgtagccatccaatgggcattgtgtgggtgcttggaacccgggatgactgagggggacactggagtgggtgcttgtgtctgctgtctcagaggccttggtcaggatgaagttggctgacacagcttagcttggttttgcttattcaaaagagaaaataactacacatggaaatgaaactagctgaagccttttcttgttttagcaactgaaaattgtacttggtcacttttgtgcttgaggaggcccattttctgcctggcagggggcaggtctgtgccctcccgctgactcctgctgtgtcctgaggtgcatttcctgttgtacacacaagggccaggctccattctccctccctttccaccagtgccacagcctcgtctggaaaaaggaccaggggtcccggaggaacccatttgtgctctgcttggacagcaggcctggcactgggaggtgggggtgagcccctcacagccttgcccctccccagggctggcaacctgccttccattgcccaagagagagggcagggaacaggctactgtccttccctgtggaattgccaaaaaaaaanaaanaaanaaaaaaaac

SEQ ID NO: 61933 - DNA, 2869 bp, Homo sapiens
gagcagctgcaccatcccggcgttcgcgtgtgccgccgctttcctcctccatctcttttcctccgcctccgccggcgcgatgggcgaaccgctgacggacagcgagaagcggaagcagatcagcgtgcgcggcctggcggggctaggcgacgtggccgaggtgcggaagagcttcaaccggcacttgcacttcacgctggtcaaggaccgcaatgtggccacgccccgcgactacttcttcgcgctggcgcacacggtgcgcgaccacctcgtgggccgctggatccgcacgcagcagcactactacgagcgcgaccccaagcgaatttattatctttccctggaattctacatgggtcgcacgctgcagaacacgatggtgaacctgggccttcagaatgcctgcgatgaagccatctatcagttggggttagacttggaggaactcgaggagatagaagaagatgctggccttgggaatggaggcctggggaggctggcagcgtgtttccttgactcaatggctaccttgggcctggcagcatacggctatggaatccgctatgaatttgggatttttaaccagaagattgtcaatggctggcaggtagaggaggccgatgactggctgcgctacggcaacccctgggagaaagcgcggcctgagtatatgcttcccgtgcacttctacggacgcgtggagcacacccccgacggcgtgaagtggctggacacacaggtggtgctggccatgccctacgacaccccagtgcccggctacaagaacaacaccgtcaacaccatgcggctgtggtccgccaaggctcccaacgacttcaagctgcaggacttcaacgtgggagactacatcgaggcggtcctggaccggaacttggctgagaacatctccagggtcctgtatccaaatgataacttctttgaggggaaggagctgcggctgaagcaggagtacttcgtggtggccgccacgctccaggacatcatccgccgcttcaagtcgtccaagttcggctgccgggaccctgtgagaacctgtttcgagacgttcccagacaaggtggccatccagctgaacgacacccaccccgccctctccatccctgagctcatgcggatcctggtggacgtggagaaggtggactgggacaaggcctgggaaatcacgaagaagacctgtgcgtacaccaaccacactgtgctgcctgaggccttggagcgctggcccgtgtccatgtttgagaagctgctgccgcggcacctggagataatctatgccatcaaccagcggcacctggaccacgtggccgcgctgtttcccggcgatgtggaccgcctgcgcaggatgtctgtgatcgaggagggggactgcaagcggatcaacatggcccacctgtgtgtgattgggtcccatgctgtcaatggtgtggcgaggatccactcggagatcgtgaaacagtcggtctttaaggatttttatgaactggagccagagaagttccagaataagaccaatggcatcaccccccgccggtggctgctgctgtgcaacccggggctggccgataccatcgtggagaaaattggggaggagttcctgactgacctgagccagctgaagaagctgctgccgctggtcagtgacgaggtgttcatcagggacgtggccaaggtcaaacaggagaacaagctcaagttctcggccttcctggagaaggagtacaaggtgaagatcaacccctcctccatgttcgacgtgcatgtgaagaggatccacgagtacaagcggcagctgctcaactgcctgcacgtcgtcaccctgtacaatcgaatcaagagagacccggccaaggcttttgtgcccaggactgttatgattgggggcaaggcagcgcccggttaccacatggccaagctgatcatcaagttggtcacctccatcggcgacgtcgtcaatcatgacccagttgtgggtgacaggttgaaagtgatcttcctggagaactaccgtgtgtccttggctgagaaagtgatcccggccgctgatctgtcgcagcagatctccactgcaggcaccgaggcctcaggcacaggcaacatgaagttcatgctcaacggggccctcaccatcggcaccatggacggcgccaacgtggagatggccgaggaggccggggccgagaacctcttcatcttcggcctgcgggtggaggatgtcgaggccttggaccggaaagggtacaatgccaggagtactacgaccacctgcccgagctgaagcaggccgtggaccagatcagcagtggctttttttctcccaaggagccagactgcttcaaggacatcgtgaacatgctgatgcaccatgacaggttcaaggtgtttgcagactatgaagcctacatgcagtgccaggcacaggtggaccaactgtaccggaaccccaaggagtggaccaagaaggtcatcaggaacatcgcctgctcgggcaagttctccagtgaccggaccatcacggagtatgcacgggagatctggggtgtggagccctccgacctgcagatcccgccccccaacatcccccgggactaggcacaccctgccttggcgggaccagcgggcatttgttttcttgctgactttgcacctccttttttccccaaacactttgccagccgctggtggtccctgcttttctgagtaccatgtttcccaggcagcggctctgtggaggaggccatactcccctagttggccactggggccaccaccctgaccaccactgtgcccctcattgttactaccttgtgagataaaaactgattaaacctttgtggctgtggttggctga

SEQ ID NO: 61934 - DNA, 620 bp, Homo sapiens
ggtgtgagccaccatgcctggccctaaactgtacaataggtttttaatatatttatagggttgtacaatcatcaacacaatcaacttagaacctttccgtggccccaaaaagaaacgctgcacctgttagccagcattccccaatccctccgtccctcctagtcttgaatgactaccatcctacttttttatttctctagttttgcctatggagtcataatgtataatgtgtggtccattgtgactggcatcttctacttagattaatgttctttgaattttattgtgttatagcgtatatcagtacttcatttgtttttatgttgaataataatgtatgaataccacattttatccttgagttgatggaaacgtgtgttacttctgctttatggttgttatgaacaatgctgctgtgaacatttcatgtacaagtttttgtatggacaggtgttctcagtttctgttagatacatactgaggagaagaattgctgggttatattgtaactaggttttaactgtttaaggaactgccagacttttccaaagtggctgcagcatttgacattaccaccagcagtctgtgaggattccagtttctccacatttgagccaata

SEQ ID NO: 61935 - DNA, 421 bp, Homo sapiens
ttcttgaaactctgaacaggaagccttctgttgactcatccctgcttttcagactggaaagcacttgtaattttatctgccatgtatagtctctaaaaatttattttgaagatatgctgtatcaaaagcaatttaagaaagtaggaaggtaggaaatataacaaccaaaaccaaacagtgacactaaatatatacatatatatagctgtacactagacttaacctaaactgaccagctagatgattttgatgcagtaaagacaagttaagaaaatttgtctttactgtcaacaagacagtaaacttgtctctatgtcaacaagaaaaaaggcaattagaaattcttggaaaaacagaaatttgcaaatgaagtcccaatttaatatgaggtaaactgaaatgtgacagaattctgcataat

SEQ ID NO: 61936 - DNA, 561 bp, Homo sapiens
gtaccacgcaatgatgggtgccagtgaggtggcccagaccctcgccaaggagacttttgcatccaccgcctcccagctccacagcaatgttgtcaactatgtccagcagatcgtggcacccaagggcagttagaggctcgtgtgcatggcccctgcctcttcaggctctccaggctttcagaataattgtttgttcccaaattcctgttccctgatcaacttcctggagtttatatcccctcaggataatctattctctagcttaggtatctgtgactcttgggcctctgctctggtgggaacttacttctctatagcccactgagccccgagacagagaacctgcccacagctctccccgctacaggctgcaggcactgcagggcagcgggtattctcctccccacctaagtctctgggaagaagtggagaggactgatgctcttcttttttctctttcctttttcttgctgattttatgcaaagggctggcattctgattgttcttttttcaggtttaatccttattttaataaagttttcaagaaaaaagttaaaaaa

SEQ ID NO: 61937 - DNA, 342 bp, Homo sapiens
cacagccacacctgtccccaccctgacactgagcccccaaggctgatgctagggttaagcactgcccactgtttctggagtgaggtgcaggcaggggagggttctgagtctggaagggccctgatctgactcaggtgttcacaaggtctctgggtggggaacagactgggggagcagggagaggagcctagaggccagggaagaggctgccaggatggtccagtcaggaggggatggagttcagccagaggtggtgggagaaatgtacaactgtagaaggtgaaactgacagagtccatggctgagtgcttctgtgtggggcgtgagggcaagggaagggct

SEQ ID NO: 61938 - DNA, 830 bp, Homo sapiens
ctagaagtgtgactgaaataggagaaccacgtccaggggttcaggggggattcctctgaaatcgcagctggaagcatttcgtaatagttctggtactgcacccatagatactgtcacctctactctttcttccaatcaccattagcagatgccacaggattcctacttctgaaagtttttgggccccgcaggtggaagaccggagaagccaataaagtttaaggctacattttattccatccacaaatttggtgaaggaggaaatgtttacaattctgccatgccatgaataggagttttccaccgggtgtacactgctgttaacaaggtgtaaatacttgtccagtaaagagaccgtacggtactgctgatggacgtcccaacacaatgccagatgcaaaaacttctttggtgattgcttttgataacactgagtggctaaaggtcttctttcacatctttgcccacctcaaatcctgaaggcaaggtctctggaatttgaggctgtgccctcacatgcctccaaggcaccaacaaagcaaaatgaagagtctgcactgcttatcagttgacccaacactcagtccacattggaggggaaggggtggtgggctgaggatgtcttcttcctgtccaggatgcaatatggtcaaggatgaaaggaaagagatgctgggagcaagtctgcattgaagatgtatttctgttgctttactaccaaccctggttataaatgatgaaactataatgggtctgtaatagctactttcccatatagctcttgtctgtacatacataaaattaaaaataatagaatacttccattacta

SEQ ID NO: 61939 - DNA, 883 bp, Homo sapiens
ctagaagtgtgactgaaataggagaaccacgtccaggggttcaggggggattcctctgaaatcgcagctggaagcatttcgtaatagttctggtactgcacccatagatactgtcacctctactctttcttccaatcaccattagcagatgccacaggattcctacttctgaaagtttttgggccccgcaggtggaagaccggagaagccaataaagtttaaggctacattttattccatccacaaatttggtgaaggaggaaatgtttacaattctgccatgccatgaataggagttttccaccgggtgtacactgctgttaacaaggtgtaaatacttgtccagtaaagagaccgtacggtactgctgatggacgtcccaacacaatgccagatgcaaaaacttctttggtgattgcttttgataacactgagtggctaaaggtcttctttcacatctttgcccacctcaaatcctgaaggcaaggtctctggaatttgaggctgtgccctcacatgcctccaaggcaccaacaaagcaaaatgaagagtctgcactgcttatcagttgacccaacactcagtccacattggaggggaaggggtggtgggctgaggatgtcttcttcctgtccaggatgcaatatggtcaaggatgaaaggaaagagatgctgggagcaagtctgcattgaagatgtatttctgttgctttactaccaaccctggttataaatgatgaaactataatgggtctgtaatagctactttcccatatagctcttgtctgtacatacataaaattaaaaataatagaatacttccattactaacatgtggtgacaagcattcttcatttaccatttttattccaaaaacatgatt

SEQ ID NO: 61940 - DNA, 710 bp, Homo sapiens
aacctcaggagtcatcaaattaaagagtagcatgaaagagaaaaagagaaccggttcgaatatggaagaaatgatgctggggaggcttttttctgactctgctgtgaactcaaattattaaagagcttacaaatgatcaaaacccataaaatcagttgctgatggcattctaccttacagtttcccataaagtgtatataaggtttttggaggttggggagatgctactgataaggactgcaagccagttcacttacattttgagtccacacagaagttgtataccagtcggaaactctgctttgccatctgaaaatacgatgagtacagtccagtagatggcattactaggattaactaaaggatgtcaaagcaactagtctagtgcctggcagaagtagttggagctcagtaaatgttagtcgtggtctctcctttatccctcccccagtggaaggtatggtgtcagagacatgaaccatgtcttattcatctttctgtggatgacatctagaaaaggaattcagggtgagcaaatatcagtgcatcttccctgaatgaatcaatgaatcaatgaatgtgtttccatggctctaacagcactgggaaatccagacatcagaaagagttatgaggcaagaatatgttgcaaacgtaagactgttggggaattgaagtggtcttcattaataaatttatagaaaatcaaa

SEQ ID NO: 61941 - DNA, 346 bp, Homo sapiens
atcaagcagtcccttttttcttaaagtgatagaagacatttgacagtgcttcagcatttgtcgtagatggctgtacacgtatcatgatggcaaaagctgtagagaaacctgagtctacattggaagccacaaagagcaaagagtcagtgatgtctagggtagaatggattggcacagcccacatgtgggtagatgatgaaactggtgacaatgcaagcaagacccagcagaccttggagtaacaggtcagacaggtggcagtcagaggagacagaagttgtccttaaggagaaacatttccatcttggggcttgagaggatctatggcagtaaaggctatttcaaa

SEQ ID NO: 61942 - DNA, 536 bp, Homo sapiens
cttagaagacaaaaaaaaaaaaatcacacaaaaaatctcccttgttgcgattcttctgtgaaggtacagtgtgtatgtgtgtatgtgtgtatgtgtgtgcgtgtctctgtcccagaccctgtgtcccccacactgccccctgtccttcggtgcttcccagagacccctctgagctggcctgtggggcacgggaagccccctggatgggaggcggggccacaggtcggctagagggtctccaccaggcccactgaacagaaccccacggctgccagaatgttccctgagcccacactgtggccagtgggacagtcctggtggctgacatcagcgtccatgcttggctcagggcctggggcggggtcctgggtagagtcctagccccagagccccagcccctcatgtcttgccgcccttcctccatgtgtttgtaaatactctggcatcctttggccctgagaaggtttttaaatgtgttatttacttctctaaacatgacgattgctataaaaataaacaaaagtttagaaaaatga

SEQ ID NO: 61943 - DNA, 523 bp, Homo sapiens
aataagcagtacgagctggtgggaattcggccgaggcgtcttctgtgaaggtacagtgtgtatgtgtgtatgtgtgtatgtgtgtgcgtgtctctgtcccagaccctgtgtcccccacactgccccctgtccttcggtgcttcccagagacccctctgagctggcctgtggggcacgggaagccccctggatgggaggcggggccacaggtcggctagagggtctccaccaggcccactgaacagaaccccacggctgccagaatgttccctgagcccacactgtggccagtgggacagtcctggtggctgacatcagcgtccatgcttggctcagggcctggggcggggtcctgggtagagtcctagccccagagccccagcccctcatgtcttgccgcccttcctccatgtgtttgtaaatactctggcatcctttggccctgagaaggtttttaaatgtgttatttacttctctaaacatgacgattgctataaaaataaacaaaagtttagaaaaatga

SEQ ID NO: 61944 - DNA, 508 bp, Homo sapiens
cacgcgtcgcggacgcgtgggtctgtctctctctctgtctctctctctctgtgggggtgtgtatgtgtgtgcgtgtctctgtcccagaccctgtgtcccccacactgccccctgtccttcggtgcttcccagagacccctctgagctggcctgtggggcacgggaagccccctggatgggaggcggggccacaggtcggctagagggtctccaccaggcccactgaacagaaccccacggctgccagaatgttccctgagcccacactgtggccagtgggacagtcctggtggctgacatcagcgtccatgcttggctcagggcctggggcggggtcctgggtagagtcctagccccagagccccagcccctcatgtcttgccgcccttcctccatgtgtttgtaaatactctggcatcctttggccctgagaaggtttttaaatgtgttatttacttctctaaacatgacgattgctataaaaataaacaaaagtttagaaaaatga

SEQ ID NO: 61945 - DNA, 242 bp, Homo sapiens
tttaaaaggcctcaaccttgtgtccccttttagccactgtactatttctttgctactaatgtgagccacagtttttgaaaacataacctacacttatgactgacatttcctgactagtcactcttccttttttaaaaaatatatgtagtcatattaaacatatataacattttataagtgatcttaaattattctaatatcagaaaggacaggctagcttatcctactataacaaacaatcc

SEQ ID NO: 61946 - DNA, 254 bp, Homo sapiens
actgcacccaccccaaggccatggcagggtatggagatgtcatttattataagatggacagataagctggaccaataatttacagattccagcagagggtgaggacacccagatgcgccaggactgtaggaaatcacaatgatggcaacgccttggccttcctggggacagggagccctatttccaaatatagtcacattctgaggagccgggggttataacatcaagtctgcccttgacctcacacaagccag

SEQ ID NO: 61947 - DNA, 364 bp, Homo sapiens
atagatagatagatagatagatagaaaggaggaaatattggaacatttaattgaattttttaacaggttatagatgcttggtaatcaagaacatattagttgctgagatgtgcagaatttaattgagtagagcaacgactcctggagagttcttcaacaggctccaaatgtatgggttttgttgaattactgggttttgttgaattactgggggtcctgtcagagtattagagttcaccaaactcctcttacttctggagaattcagctgtattactttatggttagacttgtcaaagaacaggtcaacactctggctgaattctagacttttatatgcaaaaaagcttttccctggggaagga

SEQ ID NO: 61948 - DNA, 432 bp, Homo sapiens
gtcttaaggggaaaaaactctagttcaggatttgagccctgaacagatagttttatagggatattagtgtaacgaaaaagaaaaaactctggctggaatgaccatcaaaggatatctggccgagtgtgttgttgctcgtgtagtcccagctactcaggaggctgagacaggaggatcacttgagcccagaagtttgacgctataacgagctctgccaattgggtgtccacactaagttcggtatcgatatggtgacctcctgggaggagggaccaccaagatgcctaaaaaggggtgaaccagcccaggtcagaaacagagcaggtgaaaacccctgtgctgattagcagtgagatcatgcctgtgaagaacacactgcgctccagcagcaacataaaaagaccctgtcttttatttaaaaaaaaaaaaaaa

SEQ ID NO: 61949 - DNA, 319 bp, Homo sapiens
caaaggatttttaaaaaacaagttttgtagctcgatattttctataaggtatggagtaaagaaactctcaagctttgctgatgacaatgtatcgttatccactaaaatataaaatgtataactaacactgtgatttctactcgtaaaaatgtatcttgtaggtgtatttgtttgtgaacaatgtgtataaggatatccactgctaaagactgaaaaccacctaacgcccatcactgaggatgttcaggttttggacaggttaaataaactactgggaacccatagagtagaatactatgtggcctttaaacagaatgag

SEQ ID NO: 61950 - DNA, 553 bp, Homo sapiens
gtccagcttcttcaccttagcaaataaaaatacaggacagccagttaaatttgaatttcagataaacaatgattttttaaaaatgtatataccatgcaacatttggaccatacttctcctaaacaaatttgttatttatctaaaattcaaatttaactgggcctcctgtatagtatctgacaaccatatatatataaaaacatgacctcaaaagtggcctatccagtaaaaaggaaataaaggaaatatggcataggaagtttcattgccaggattaaaaatatcctatatattttctgctttaaaaaaatcaccatcttgaagtcactcacatgtacccaagccaacttcacagagatctgatgaaattcattcttcctgtgtcctaaaagtagaaatggcatgacaaaaatgtaacatcatttttatataaacataattgggtctcggttattagatatatagacaactctacacacattgaatagttgatgcacattatttttaagcacacatgaattattaataaaatatgccatatatgaagctgtaa

SEQ ID NO: 61951 - DNA, 2597 bp, Homo sapiens
  misc_feature (2591)..(2592): n is a, c, g, or t
  misc_feature (2594)..(2596): n is a, c, g, or t
atgcatctgctcccagccctggcaggggtcctggccacactcgtcctcgcccagccctgtgagggcactgacccagcctcccctggggcagtggagacctcggtcctgcgagactgcatagcagaggccaagttgctggtggatgctgcctacaattggacccagaagagcatcaagcagcggcttcgcagcggttcagccagccccatggacctcctgtcctacttcaaacaaccggtagcagccaccaggacagttgttcgggccgcagattatatgcatgtggctttggggctgcttgaagagaagttacaaccccagcggtccggacccttcaatgtcactgatgtgctaacagaaccacagctgcggctgctgtcccaggccagtggctgtgctctccgggaccaggccgagcgctgcagcgacaagtaccgcaccatcactggacggtgcaacaacaagaggagacccttgctaggggcctccaaccaggctctggctcgctggctgcccgccgagtatgaggatgggctgtcgctccccttcggctggacccccagcaggaggcgcaatggcttccttctccctcttgtccgggctgtctccaaccagattgtgcgcttccccaatgagagactgacctccgaccgtggccgagccctcatgttcatgcagtggggccagttcattgaccatgacctggacttctccccggagtccccggccagagtggccttcactgcaggcgttgactgtgagaggacctgcgcccagctgcccccctgctttcccatcaagatcccacccaatgacccccgcatcaagaaccagcgtgactgcatccctttcttccgctcggcaccctcatgcccccaaaacaagaacagagtccgcaaccagatcaacgcgctcacctcctttgtggacgccagcatggtgtatggcagtgaggtctccctctcgctgcggctccgcaaccggaccaactacctggggctgctggccatcaaccagcgctttcaagacaacggccgggccctgctgcccttcgacaacctgcacgatgacccctgtctcctcaccaaccgctcggcgcgcatcccctgcttcctggcaggtgacacccgatcaacggaaacccccaaactggcagccatgcacaccctctttatgcgagagcacaaccggctggccaccgagctgagacgcctgaatccccggtggaatggagacaaactgtacaatgaggctcggaagatcatgggggccatggtccagatcatcacctaccgagactttctgcccctggttctgggcaaggcccgggccaggagaaccctggggcactacagggggtactgctccaatgtggacccacgggtggccaatgtcttcaccctggccttccgctttggccacacaatgctccagcccttcatgttccgcttggacagtcagtaccgggcctccgcacccaactcgcatgtcccacttagctctgccttctttgccagctggcggatcgtgtatgaagggggcatcgaccccatcctccggggcctcatggccacccctgccaagctgaaccgtcaggatgccatgttagtggatgagctccgggaccggctgtttcggcaagtgaggaggattgggctggacctggcagctctcaacatgcaacgaagccgggaccacggccttccagggtacaatgcttggaggcgcttctgtgggctctcccagccccggaatttggcacagcttagccgggtgctgaaaaaccaggacttggcaaggaagttcctgaatttgtatggaacacctgacaacattgacatctggattggggccatcgctgagcctcttttgccgggggctcgagtggggcctcttctggcttgtctgttcgagaaccagttcagaagagcccgagacggagacaggttctggtggcagaaacgaggtgttttcaccaaaagacagcgcaaggccctgagcagaatttccttgtctcgaattatatgtgacaataccggtatcaccacggtttcaagggacatcttcagagccaacatctaccctcggggctttgtgaactgcagccgtatccccaggttgaacctatcagcctggcgagggacatgaggcttctgcaggagtctatcccaagtctccaacttttggagacaaggggaaggggaggaccatgaggctgccttgtctccctggagcaagtgcaggctgctgacgcttctgctggctacagctcagagctgggttccccagccaggagtgaaggctgggggctcctatcagcaatggaccttcccgccttgggagcctcttaggtattaggctatgaatcagcgccacgtgcaaaggcttgggagccaagccatgtggtcttgcaccccaggcaagaaaagtcagctggagggtttacagcactttctactgtttcccagccctccctcccctccctcaccatgactaagagaccactcggtcctagcctccagacaccccacaatactcctctgagcctgaggccaggcagcatgctctgcttctaccaataaagcactgcnnannnc

SEQ ID NO: 61952 - DNA, 408 bp, Homo sapiens
agaggccctgattgtcccccttccactaaggtggtcctgtagttgaccaggtgtgggctgcatggtagctcttttccaggattctacagcctggagtaacatatagctctctctgctatatcccgaagtccctgcggatcagcccccgagggccttccagcttccgtctcccaatactaagttcacttcttgtatctcacggcagagaggagatttagcattccttggagacctgaaaggatgcagtgagcttaagaattttcaagagcttatcaatcggtcagcccttgttcatctctgagcagatgtgtggtggtattgtagtagacctttagtaggcactctgccgaataactagagtggcacttatggtttagtccatttcaccctggtatttcatcaaccaga

SEQ ID NO: 61953 - DNA, 597 bp, Homo sapiens
gtttacatcatattactacacaactattattcactatcaagccaaataatataattatgcttcttttctagtataattgtttagctgagtattaaaagttgccttagttttcatttactagataactatgacaccattaatatttcctctaaatgctccaatgttttattccgtagctgtcaataacattttccatgcactcactcactccagtttcttcttttccttgatgtcctccctttcagagcctgctgaacaggctgctttcttggccagttgcacagttgtcttctgggacttttcatcaatattatatccactatttttgggcagctatgttgtgctctttctgggtttgctggtctgaagatgtccttatttttcttttatgcttgattcatagtttggctggctataaattctagtctcactcagaattttgacaatattgctttatggttttctagtatccactgttgctgttgagaagtcatgtgttaatttgacttcaactttgctttttctctcttgatgctcttagaaaagtcttttatcaccagtgttctaagatttcatgatgataaagcttggcattaa

SEQ ID NO: 61954 - DNA, 401 bp, Homo sapiens
ttttgactgtaacctcatgaaagaccctgagccagaatcacccagcaaagctgattccagattccttgtcctcaaaaaatgtgtgagataataaatgttgtcgttagctgctgagtttaagggtaacttatttgcagcaatagataactaatactatttttttccttttttttctgactccaacttgtatgactaaagtactaaatttaaaaagtataaaaagagataagctgggtgtggtggctcacacctgtaatcccaacactttggcaggctgaggcaggaagattgcttgaatccaggagtttgagaccagcctgggcaacatggcaaaaccccgattcaacaacaaatacaaaaatgagctgggcatggtggtgtgtccctgcagtcccagttac

SEQ ID NO: 61955 - DNA, 5077 bp, Homo sapiens
  misc_feature (3067)..(3067): n is a, c, g, or t
atatggtcgatgcaaaaacttcacgtttcttcggaatagccagagaccaaagtgcgacatggagactagaagcagccggcgctggtcagccgcctcgttctgttttattaccttggactccaggaggatcagctgcgcctggtgacatagagcagcttttcctctccagaagctcctcacctttaaacagagtatcctctgggtgctgaaaagaaagaaagacagaaagagagaaagagagagagagagagaaagagagaatgcaagcctaattggttgcatggatgcagggccaaagggctaggttttggggtactagggagtgaggtacaaggccagcttgcccagtcccagctctgccctccaggaacatgaggtgcaaaggtacccaaatgggggcttgcttgtatttggggcctgtgggaagaaagcaagcttcaaagaagcccagtggggagctctagggtgcattttgacaaggtggaggtgcccttgccaccatcccagcccacccccagctacatgggcaagggcagcgagggccccctgctattttggcagggcccagctttggctgggaacccccgggcctgggcactggtagaaagcatggcggttactcattgcctaatttgattcaagctggccagattctggtaacttttgggtgaccctgatgaagacaaagccaggacggcggcctttgtatggcagatccctgctcccgccggctgcaggcagggcgggcaggcaggaaccctcctcgcctggggcactctgcccaactcagaggcgagttcacccacccacctttcattgctctgtaccccaataggaggattcattctcccttgagctgtgcctacttggtgtcggggggcgggggttgcattcagctgggggtgagtggaagggccacggaaggttggcaaaatcagtggcagacaaaagctgggattacctgaggggaatggggtgctggggactggaactacattaatatctggcaggggctctcaaatgtgccatagcaagctacttgattacacgtatgttatttagttaaatttgtgaaaattatgagatgctcaccaacccggtgataaacttgctccctcgccattggctggcctggtcacatggctgcccaactttattcagttgacagcaagtaggagggccctatggaaggagaaaaaaagacaacacgagaaaaattagtattttctaccttctgaaattaatggtcatgagttcgtatatggtgaactccaagtatgtggaccccaagttccctccgtgcgaggagtatttgcagggcggctacctaggcgagcagggcgccgactactacggcggcggcgcgcagggcgcagacttccagcccccggggctctacccacggcccgacttcggtgagcagcctttcggaggcagcggccccgggcctggctcggcgctgcctgcgcggggtcacggacaagagccaggcggccccggcggtcactacgccgctccaggagagccttgcccagctcccccggcgcctccgccggcgcccctgcctggcgcccgggcctacagtcagtccgaccccaagcagccgccctccgggacggcactcaagcagccggccgtggtctacccctggatgaagaaggtgcacgtgaattcggtgaaccccaactacaccggtggggaacccaagcggtcccgaacggcctacacccggcagcaagtcctagaactggaaaaagaatttcattttaacaggtatctgacaaggcgccgtcggattgaaatcgctcacaccctgtgtctgtcggagcgccagatcaagatctggttccagaaccggaggatgaagtggaaaaaagatcataagctgcccaacactaaaggcaggtcatcgtcctcatcttcctcctcatcttgctcctcctcagtcgcccccagccagcatttacagccgatggccaaagaccaccacacggacctgacgaccttatagaagtggggaccctgggcccatctctccctgcgcaccaggctgagccgaagctgcgggggcaggccgggcctgctgtcacctcgctgggctctaaggtactgtggggtggacctgggacaagcaggccgccctcggactaggttagcatcctgcccgagggcagccccctccctagagcgggatggggatgggagggggggcgggattctctctctaagtatattatatggcaggagctactgagaacataaaatcttggcgagtcattaaacttatgaaaatcaccgctcttggattttgaatttgcaaatgaaggttggatgctttatcccactgtgaatttggacattctcccccactccacccctccagggtgctttgtggcttaataatgtgggggagttgaggcagaaggttggccacccctgtgctaggtgctttcagtggaagccagagagctgggtcaggatttctggactttctgggttgtctatggaatttcatgtgattaaaaaatatatattttgctcccagtggccccacctccaaagaaatgggtctaagaaggaagtaaaaatgggttattttatgtttagatatttgcttaaatatttatttgttgggaaatgtggtacagaaataactgacaccttcatgccaaaaatcttaaaaaggtgaaaggggctgaacttcagggagcagaatcagagatatgtgcacttacttctgaactccacccctccccactctctggaaatgtatataggggggccttaacccttccagaaggaagcaaaggattcactcaaagttgcattcttgaaaatatatttccacatgtgtttttttcagcactgtgcttacaaccagttctgggtgattaaaggaaagggaaaaaaaccaacaaatggtccaacattttccttctggggaaagaaaacaaaacctctatgcactgggtcattagataatgactgaattttctgttccaactggattccaaatgccctaaataccctcatatagcagtgttttacaggaattagtgtatggccngtgtaggggaggggctgtgcagtggggagaaagtgggaaggtgaggaactcttgctttaagaaggaaaaaaaaaaaaccctaattgaatctagaagtccacaaaagttagccttagagtttttttccccctgaagttttaatttttttaaaaaccaaatctaaggaagttttcctcagctcattaattagaagcagaatttgtaaaagtataaaagttttcaagcactcgtctttgccttgagaatagtggttttttaaagaatcactctcaacaggggagatgtcctctagtcgtttttcttctgcctctcctgggaagggttcaaagttcatttttctaaaatgctgaccctcaagcataaggaggaagaagtcaaagttaatggccagagttcatatactcagatgaaaccagtcttcccaaggcctcaggctccaaaaaaggttgtagctatcaaaaagtgaccaaagtgggaaagggagaaaggataagcttaaaatttaattttaagatccagaaggggggtatttttttcagtacttcaaaaacactttagaaggtttctgttgtaatttaaaaaatatatttaagtgggagggaaaaaagagtttctctgtaggcttgttctttggctgtgtctcctgagagctgagggcaggtattcactgcagtccctaggctgaaattccgcttctctgaagtgtcttccaagccttggtcttttgtattagaccctggggactgctctttgtttctccttggggtgagcctggctctcagacttgcacatggcaatacttgaatgtcaccacgtcgggatattaaagatggatattcgtgcattattcacatcattgtttctatgacaaaaagcacagagttcatacatagtcaagacgtcttttttctgacgccctcacgttgagaagctgaaaaggtattttaccgaagttcgggtaaattacagaatcaggttcatccagaggacaaattttctatttgattagctgtatttcagccgggaggactgacctctaaacccctaaccttttggactctaactacccttctcttcttttttcctctctaacatggagagcagtctttggatgtaccatttgaaaggagccgctatccttaggcaagttggaaagttgctaagctgctttcctaaaacccaaatctgtctatacattgaaccttctctttgagaaggggaaaaaggtatatattttcacaacatccaattacatatatataatagagatttgttgtatagattttcccccacctcagaagttcaggttactcacccccagtttcataccaaatgccacacaggcttaactgactgcatccctgccccagaggaaagccaagaaacatgttttcatgaggaaaacccaagctccttctcaaacatagccccactactttggaaagtaacttaatcagagaaacaacttctttgtttataagtctcagctctccttctcagcttggagggattcttttgaaatgttaatggagcctggatggcccagagtgcagcccccaaccctgaggtcccagtcggaccccagcatccatttgggcccacaggagtgggccagggaaggggtagggccccgtaaccacttagggcagggaaggaaatgggtttccatctgagaacgtgctttggagaaagctaggtgtggaaaagctccaatgcccatttgctattatttgtttccagtttgttcctttaaatatgagccagaagtgtttgtgttggtgttttaaaaacaaaaacaaaaaccgtgttggggtcctgactgggggagggggagagtgaagtgtttgctgaggacattgctcctctgactcccatctcactttgtccatcgcagccttttgttgggagatgacactgtcagtcagcccatgatgtctgttcacacgagatgcttttttaatagaattgaccaatgttttgctgccactgattaaagtattatttatacta

SEQ ID NO: 61956 - DNA, 2561 bp, Homo sapiens
  misc_feature (551)..(551): n is a, c, g, or t
aaagcaagagttcctcaccttccgcactttggccccacctccaaagaaatgggtctaagaaggaagtaaaaatgggttattttatgtttagatatttgcttaaatatttatttgttgggaaatgtggtacagaaataactgacaccttcatgccaaaaatcttaaaaaggtgaaaggggctgaacttcagggagcagaatcagagatatgtgcacttacttctgaactccacccctccccactctctggaaatgtatataggggggccttaacccttccagaaggaagcaaaggattcactcaaagttgcattcttgaaaatatatttccacatgtgtttttttcagcactgtgcttacaaccagttctgggtgattaaaggaaagggaaaaaaaccaacaaatggtccaacattttccttctggggaaagaaaacaaaacctctatgcactgggtcattagataatgactgaattttctgttccaactggattccaaatgccctaaataccctcatatagcagtgttttacaggaattagtgtatggccngtgtaggggaggggctgtgcagtggggagaaagtgggaaggtgaggaactcttgctttaagaaggaaaaaaaaaaaaccctaattgaatctagaagtccacaaaagttagccttagagtttttttccccctgaagttttaatttttttaaaaaccaaatctaaggaagttttcctcagctcattaattagaagcagaatttgtaaaagtataaaagttttcaagcactcgtctttgccttgagaatagtggttttttaaagaatcactctcaacaggggagatgtcctctagtcgtttttcttctgcctctcctgggaagggttcaaagttcatttttctaaaatgctgaccctcaagcataaggaggaagaagtcaaagttaatggccagagttcatatactcagatgaaaccagtcttcccaaggcctcaggctccaaaaaaggttgtagctatcaaaaagtgaccaaagtgggaaagggagaaaggataagcttaaaatttaattttaagatccagaaggggggtatttttttcagtacttcaaaaacactttagaaggtttctgttgtaatttaaaaaatatatttaagtgggagggaaaaaagagtttctctgtaggcttgttctttggctgtgtctcctgagagctgagggcaggtattcactgcagtccctaggctgaaattccgcttctctgaagtgtcttccaagccttggtcttttgtattagaccctggggactgctctttgtttctccttggggtgagcctggctctcagacttgcacatggcaatacttgaatgtcaccacgtcgggatattaaagatggatattcgtgcattattcacatcattgtttctatgacaaaaagcacagagttcatacatagtcaagacgtcttttttctgacgccctcacgttgagaagctgaaaaggtattttaccgaagttcgggtaaattacagaatcaggttcatccagaggacaaattttctatttgattagctgtatttcagccgggaggactgacctctaaacccctaaccttttggactctaactacccttctcttcttttttcctctctaacatggagagcagtctttggatgtaccatttgaaaggagccgctatccttaggcaagttggaaagttgctaagctgctttcctaaaacccaaatctgtctatacattgaaccttctctttgagaaggggaaaaaggtatatattttcacaacatccaattacatatatataatagagatttgttgtatagattttcccccacctcagaagttcaggttactcacccccagtttcataccaaatgccacacaggcttaactgactgcatccctgccccagaggaaagccaagaaacatgttttcatgaggaaaacccaagctccttctcaaacatagccccactactttggaaagtaacttaatcagagaaacaacttctttgtttataagtctcagctctccttctcagcttggagggattcttttgaaatgttaatggagcctggatggcccagagtgcagcccccaaccctgaggtcccagtcggaccccagcatccatttgggcccacaggagtgggccagggaaggggtagggccccgtaaccacttagggcagggaaggaaatgggtttccatctgagaacgtgctttggagaaagctaggtgtggaaaagctccaatgcccatttgctattatttgtttccagtttgttcctttaaatatgagccagaagtgtttgtgttggtgttttaaaaacaaaaacaaaaaccgtgttggggtcctgactgggggagggggagagtgaagtgtttgctgaggacattgctcctctgactcccatctcactttgtccatcgcagccttttgttgggagatgacactgtcagtcagcccatgatgtctgttcacacgagatgcttttttaatagaattgaccaatgttttgctgccactgattaaagtattatttatacta

SEQ ID NO: 61957 - DNA, 5392 bp, Homo sapiens
  misc_feature (3067)..(3067): n is a, c, g, or t
atatggtcgatgcaaaaacttcacgtttcttcggaatagccagagaccaaagtgcgacatggagactagaagcagccggcgctggtcagccgcctcgttctgttttattaccttggactccaggaggatcagctgcgcctggtgacatagagcagcttttcctctccagaagctcctcacctttaaacagagtatcctctgggtgctgaaaagaaagaaagacagaaagagagaaagagagagagagagagaaagagagaatgcaagcctaattggttgcatggatgcagggccaaagggctaggttttggggtactagggagtgaggtacaaggccagcttgcccagtcccagctctgccctccaggaacatgaggtgcaaaggtacccaaatgggggcttgcttgtatttggggcctgtgggaagaaagcaagcttcaaagaagcccagtggggagctctagggtgcattttgacaaggtggaggtgcccttgccaccatcccagcccacccccagctacatgggcaagggcagcgagggccccctgctattttggcagggcccagctttggctgggaacccccgggcctgggcactggtagaaagcatggcggttactcattgcctaatttgattcaagctggccagattctggtaacttttgggtgaccctgatgaagacaaagccaggacggcggcctttgtatggcagatccctgctcccgccggctgcaggcagggcgggcaggcaggaaccctcctcgcctggggcactctgcccaactcagaggcgagttcacccacccacctttcattgctctgtaccccaataggaggattcattctcccttgagctgtgcctacttggtgtcggggggcgggggttgcattcagctgggggtgagtggaagggccacggaaggttggcaaaatcagtggcagacaaaagctgggattacctgaggggaatggggtgctggggactggaactacattaatatctggcaggggctctcaaatgtgccatagcaagctacttgattacacgtatgttatttagttaaatttgtgaaaattatgagatgctcaccaacccggtgataaacttgctccctcgccattggctggcctggtcacatggctgcccaactttattcagttgacagcaagtaggagggccctatggaaggagaaaaaaagacaacacgagaaaaattagtattttctaccttctgaaattaatggtcatgagttcgtatatggtgaactccaagtatgtggaccccaagttccctccgtgcgaggagtatttgcagggcggctacctaggcgagcagggcgccgactactacggcggcggcgcgcagggcgcagacttccagcccccggggctctacccacggcccgacttcggtgagcagcctttcggaggcagcggccccgggcctggctcggcgctgcctgcgcggggtcacggacaagagccaggcggccccggcggtcactacgccgctccaggagagccttgcccagctcccccggcgcctccgccggcgcccctgcctggcgcccgggcctacagtcagtccgaccccaagcagccgccctccgggacggcactcaagcagccggccgtggtctacccctggatgaagaaggtgcacgtgaattcggtgaaccccaactacaccggtggggaacccaagcggtcccgaacggcctacacccggcagcaagtcctagaactggaaaaagaatttcattttaacaggtatctgacaaggcgccgtcggattgaaatcgctcacaccctgtgtctgtcggagcgccagatcaagatctggttccagaaccggaggatgaagtggaaaaaagatcataagctgcccaacactaaaggcaggtcatcgtcctcatcttcctcctcatcttgctcctcctcagtcgcccccagccagcatttacagccgatggccaaagaccaccacacggacctgacgaccttatagaagtggggaccctgggcccatctctccctgcgcaccaggctgagccgaagctgcgggggcaggccgggcctgctgtcacctcgctgggctctaaggtactgtggggtggacctgggacaagcaggccgccctcggactaggttagcatcctgcccgagggcagccccctccctagagcgggatggggatgggagggggggcgggattctctctctaagtatattatatggcaggagctactgagaacataaaatcttggcgagtcattaaacttatgaaaatcaccgctcttggattttgaatttgcaaatgaaggttggatgctttatcccactgtgaatttggacattctcccccactccacccctccagggtgctttgtggcttaataatgtgggggagttgaggcagaaggttggccacccctgtgctaggtgctttcagtggaagccagagagctgggtcaggatttctggactttctgggttgtctatggaatttcatgtgattaaaaaatatatattttgctcccagtggccccacctccaaagaaatgggtctaagaaggaagtaaaaatgggttattttatgtttagatatttgcttaaatatttatttgttgggaaatgtggtacagaaataactgacaccttcatgccaaaaatcttaaaaaggtgaaaggggctgaacttcagggagcagaatcagagatatgtgcacttacttctgaactccacccctccccactctctggaaatgtatataggggggccttaacccttccagaaggaagcaaaggattcactcaaagttgcattcttgaaaatatatttccacatgtgtttttttcagcactgtgcttacaaccagttctgggtgattaaaggaaagggaaaaaaaccaacaaatggtccaacattttccttctggggaaagaaaacaaaacctctatgcactgggtcattagataatgactgaattttctgttccaactggattccaaatgccctaaataccctcatatagcagtgttttacaggaattagtgtatggccngtgtaggggaggggctgtgcagtggggagaaagtgggaaggtgaggaactcttgctttaagaaggaaaaaaaaaaaaccctaattgaatctagaagtccacaaaagttagccttagagtttttttccccctgaagttttaatttttttaaaaaccaaatctaaggaagttttcctcagctcattaattagaagcagaatttgtaaaagtataaaagttttcaagcactcgtctttgccttgagaatagtggttttttaaagaatcactctcaacaggggagatgtcctctagtcgtttttcttctgcctctcctgggaagggttcaaagttcatttttctaaaatgctgaccctcaagcataaggaggaagaagtcaaagttaatggccagagttcatatactcagatgaaaccagtcttcccaaggcctcaggctccaaaaaaggttgtagctatcaaaaagtgaccaaagtgggaaagggagaaaggataagcttaaaatttaattttaagatccagaaggggggtatttttttcagtacttcaaaaacactttagaaggtttctgttgtaatttaaaaaatatatttaagtgggagggaaaaaagagtttctctgtaggcttgttctttggctgtgtctcctgagagctgagggcaggtattcactgcagtccctaggctgaaattccgcttctctgaagtgtcttccaagccttggtcttttgtattagaccctggggactgctctttgtttctccttggggtgagcctggctctcagacttgcacatggcaatacttgaatgtcaccacgtcgggatattaaagatggatattcgtgcattattcacatcattgtttctatgacaaaaagcacagagttcatacatagtcaagacgtcttttttctgacgccctcacgttgagaagctgaaaaggtattttaccgaagttcgggtaaattacagaatcaggttcatccagaggacaaattttctatttgattagctgtatttcagccgggaggactgacctctaaacccctaaccttttggactctaactacccttctcttcttttttcctctctaacatggagagcagtctttggatgtaccatttgaaaggagccgctatccttaggcaagttggaaagttgctaagctgctttcctaaaacccaaatctgtctatacattgaaccttctctttgagaaggggaaaaaggtatatattttcacaacatccaattacatatatataatagagatttgttgtatagattttcccccacctcagaagttcaggttactcacccccagtttcataccaaatgccacacaggcttaactgactgcatccctgccccagaggaaagccaagaaacatgttttcatgaggaaaacccaagctccttctcaaacatagccccactactttggaaagtaacttaatcagagaaacaacttctttgtttataagtctcagctctccttctcagcttggagggattcttttgaaatgttaatggagcctggatggcccagagtgcagcccccaaccctgaggtcccagtcggaccccagcatccatttgggcccacaggagtgggccagggaaggggtagggccccgtaaccacttagggcagggaaggaaatgggtttccatctgagaacgtgctttggagaaagctaggtgtggaaaagctccaatgcccatttgctattatttgtttccagtttgttcctttaaatatgagccagaagtgtttgtgttggtgttttaaaaacaaaaacaaaaaccgtgttggggtcctgactgggggagggggagagtgaagtgtttgctgaggacattgctcctctgactcccatctcactttgtccatcgcagccttttgttgggagatgacactgtcagtcagcccatgatgtctgttcacacgagatgcttttttaatagaattgaccaatgttttgctgccactgattaaagtattatttatactaattgttgcttgtagttttgatgtaattcattgatctatatttaaaataataaaaggtgtagcaaaatctccctcctgtttggtgccttaacagaagcattcatcctttgttaagtcttctaaaagctaacatttaacataaacaagttattattttctgcaataaattaggcaccattttttggggggtgcctaaagtgtgaaggttaaaccatgtaaggcttagcaattctattattaccacctccttaatgtacacacactcccagttggccaccatattttgtgagcattgggaagcctggggttgaattca

SEQ ID NO: 61958 - DNA, 2870 bp, Homo sapiens
gaggagctgagaggaacaggaagtgtcaggactttacgacccgcgcctccagctgaggtttctagacgtgacccagggcagactggtagcaaagcccccacgcccagccaggagcaccgccgaggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacgggaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccatctcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggtccttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttgccacagctcttgaggatgtcaccaattaaccagaaatccagttattttccgccctcaaaatgacagccatggccggccgggtgcttctgggggctcgtcggggggacagctccactctgactggcacagtctttgcatggagacttgaggagggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatggaaa

SEQ ID NO: 61959 - DNA, 2786 bp, Homo sapiens
agcacaggctctgctcacggaggacctggggcacactggggcagagtgcacacaccgggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacgggaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccatctcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggtccttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttgccacagctcttgaggatgtcaccaattaaccagaaatccagttattttccgccctcaaaatgacagccatggccggccgggtgcttctgggggctcgtcggggggacagctccactctgactggcacagtctttgcatggagacttgaggagggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatggaaa

SEQ ID NO: 61960 - DNA, 3235 bp, Homo sapiens
  misc_feature (2920)..(2920): n is a, c, g, or t
gaggagctgagaggaacaggaagtgtcaggactttacgacccgcgcctccagctgaggtttctagacgtgacccagggcagactggtagcaaagcccccacgcccagccaggagcaccgccgaggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacgggaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccatctcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggtccttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttgccacagctcttgaggatgtcaccaattaaccagaaatccagttattttccgccctcaaaatgacagccatggccggccgggtgcttctgggggctcgtcggggggacagctccactctgactggcacagtctttgcatggagacttgaggagggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatggaaaaaaaaaaaaaaaaaaaaaaaaaaaaaaaaaaaaaaaaaaaaaaaaaaaanaaaaaaaaaaaaaaaaaaaaaaaaaaaaaaaaaaaaaaaaaaaaaaaaaaaaaaaaaaaagggggcccccttggcccaaacgattttaaaactggaaaaatttaaaaaaggggcccaaattcgggctaaattggccaaatcccccaaagagggggggaataaaaaaaaaatggcccgtcgttaaaaaagcaggaaatggaaaaaaccgggggaaacccaaataaaacggcttggaaaaaaaaaccccttttccaaacgggggaaaaatcaaaaaggcccaacacaaatgcgccttttaaaaaagtgcccaaccaa

SEQ ID NO: 61961 - DNA, 3252 bp, Homo sapiens
gaggagctgagaggaacaggaagtgtcaggactttacgacccgcgcctccagctgaggtttctagacgtgacccagggcagactggtagcaaagcccccacgcccagccaggagcaccgccgaggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacgggaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccatctcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggtccttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttgccacagctcttgaggatgtcaccaattaaccagaaatccagttattttccgccctcaaaatgacagccatggccggccgggtgcttctgggggctcgtcggggggacagctccactctgactggcacagtctttgcatggagacttgaggagggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatggaaaaaaaaaaaaaaaaaaaaaaaaaaaaaaaaaaaaaaaaaaaaaaaaaaagggggggcgcccccaaaaattctcccccggggggccccattccgtcccccattttttcgagcgaagaaggtggggccccctaaatgagggaggcgctcgcgtatctattaaaatcccggtagccggcagcggagggccccggctgtttaaacaaacaaagcatgtcgatgtagcgtggagaacacaaatgggcgccactacgggggggaatatccctggggggaggagacaacccctaaacgtcgggggggggaggagacacattttggggggggaacaacattgcccccaagaagaattataaagcggtcccggaggggagaaaattacactc

SEQ ID NO: 61962 - DNA, 2485 bp, Homo sapiens
gccacccttggctatcacgcagccatctcagtgagctgtgtatcaacaaaggctacagagaagatcagtctcacacatgctcttctgaatagtagtcgagtgggtagcccttaaactgcgcagtttaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacgggaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccatctcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggtccttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttgccacagctcttgaggatgtcaccaattaaccagaaatccagttattttccgccctcaaaatgacagccatggccggccgggtgcttctgggggctcgtcggggggacagctccactctgactggcacagtctttgcatggagacttgaggagggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatggaaa

SEQ ID NO: 61963 - DNA, 2110 bp, Homo sapiens
tgagatggagtttcgctctgtcgcccaggctggagtgcactggtgcgatcttggctcactacaatccaagtgattctcctgactcagcctcctgagtagctgggactacaggcgtgtgccaccacgctcggctaattttgtatttttagtagagacagagtttcgccatgttggccaggctggtctcaaactcttgccctcagatgatctacccgcctcggcctcccacagtgctgggattacaggcgtgagccgcggcgcccagctgtcccatggattctcaccagaacgtttccctcatgttgggtggtctgagtgggagtgtgctcagcttctcctgatttgctgtctgcgtgtcacatgtctctgcgtgatgtgtggccggggagatcctggtgccggccagtgcgggagtgcgggcagagcaccttcttgccggctgactttggctctcggatctgagcatcagctcttcctgctcctggtcaccccttcctccccacgctgaaccccccaggacccctgcagaggccaggaggtgagggttgggagctgggctgccaccctggccaccgagggtccccacctgagcccagcactgccctgcagatcaccttccaggtgaaggtcacggccacagagtgcatccaggagcagtcgtttgtcatccgggcgctgggcttcacggacatagtgaccgtgcaggtccttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttgccacagctcttgaggatgtcaccaattaaccagaaatccagttattttccgccctcaaaatgacagccatggccggccgggtgcttctgggggctcgtcggggggacagctccactctgactggcacagtctttgcatggagacttgaggagggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatggaaa

SEQ ID NO: 61964 - DNA, 2280 bp, Homo sapiens
gaggagctgagaggaacaggaagtgtcaggactttacgacccgcgcctccagctgaggtttctagacgtgacccagggcagactggtagcaaagcccccacgcccagccaggagcaccgccgaggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacgggaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccatctcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggtccttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcccgccatctcgtggttgctttaagtaccgccc

SEQ ID NO: 61965 - DNA, 867 bp, Homo sapiens
ggaattgcagcgcggcgtgtccgggcctgcagctgtcgaacaaccccgtgaagggcaggagctaccagctgcctctgtgccaggagtgccccggctgcccctcaccctgtggcaagtacatctcctgcgccgagtgcctgaagttcgaaaagggcccctttgggaagaactgcagccaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttgccacagctcttgaggatgtcaccaattaaccagaaatccagttattttccgccctcaaaatgacagccatggccggccgggtgcttctgggggctcgtcggggggacagctccactctgactggcacagtctttgcatggagacttgaggagggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatggaaa

SEQ ID NO: 61966 - DNA, 1474 bp, Homo sapiens
gaggagctgagaggaacaggaagtgtcaggactttacgacccgcgcctccagctgaggtttctagacgtgacccagggcagactggtagcaaagcccccacgcccagccaggagcaccgccgaggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccattttccgccctcaaaatgacagccatggccggccgggtgcttctgggggctcgtcggggggacagctccactctgactggcacagtctttgcatggagacttgaggagggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatggaaaaaaaaaaaaaaaaaaaaaaaaaaaaaaaaaaaaaaaaaaaaaaaaaaagggggggcgcccccaaaaattctcccccggggggccccattccgtcccccattttttcgagcgaagaaggtggggccccctaaatgagggaggcgctcgcgtatctattaaaatcccggtagccggcagcggagggccccggctgtttaaacaaacaaagcatgtcgatgtagcgtggagaacacaaatgggcgccactacgggggggaatatccctggggggaggagacaacccctaaacgtcgggggggggaggagacacattttggggggggaacaacattgcccccaagaagaattataaagcggtcccggaggggagaaaattacactc

SEQ ID NO: 61967 - DNA, 838 bp, Homo sapiens
gaggagctgagaggaacaggaagtgtcaggactttacgacccgcgcctccagctgaggtttctagacgtgacccagggcagactggtagcaaagcccccacgcccagccaggagcaccgccgaggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatggaaa

SEQ ID NO: 61968 - DNA, 491 bp, Homo sapiens
gaggagctgagaggaacaggaagtgtcaggactttacgacccgcgcctccagctgaggtttctagacgtgacccagggcagactggtagcaaagcccccacgcccagccaggagcaccgccgaggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgggagcggctttgggtcctccagcccacgccaccgcggcgagcagtccccggaggagaagccgggtggctcccgtctgtcctcggactgagcagggtggccaggccccaggtggaaactaccttggtcaggctgggttttttccctcccctttctggaggttttcagctcctctgaaataaacacctttcagtgagaaaa

SEQ ID NO: 61969 - DNA, 2816 bp, Homo sapiens
gtcccaggccagctggaggggagcttcatgggtggtcagccccaggggttgggcctgagaccgtcaccaagaccccttccctccacaggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacgggaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccatctcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggtccttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttgccacagctcttgaggatgtcaccaattaaccagaaatccagttattttccgccctcaaaatgacagccatggccggccgggtgcttctgggggctcgtcggggggacagctccactctgactggcacagtctttgcatggagacttgaggagggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatggaaa

SEQ ID NO: 61970 - DNA, 2941 bp, Homo sapiens
gtcccaggccagctggaggggagcttcatgggtggtcagccccaggggttgggcctgagaccgtcaccaagaccccttccctccacaggacatgctgggcctgcgccccccactgctcgccctggtggggctgctctccctcgggtgcggtgagttctgtgttccacggaggggactccacgcgtgacattccaatcagggagaacagggcctgccctcactttcccatagacagaagttcccgggaggctggggaaggaccttgccactggggtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacgggaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccatctcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggtccttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttgccacagctcttgaggatgtcaccaattaaccagaaatccagttattttccgccctcaaaatgacagccatggccggccgggtgcttctgggggctcgtcggggggacagctccactctgactggcacagtctttgcatggagacttgaggagggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatggaaa

SEQ ID NO: 61971 - DNA, 3259 bp, Homo sapiens
  misc_feature (2883)..(2883): n is a, c, g, or t
gaggagctgagaggaacaggaagtgtcaggactttacgacccgcgcctccagctgaggtttctagacgtgacccagggcagactggtagcaaagcccccacgcccagccaggagcaccgccgaggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacgggaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccatctcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggtccttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttgccacagctcttgaggatgtcaccaattaaccagaaatccagttattttccgccctcaaaatgacagccatggccggccgggtgcttctgggggctcgtcggggggacagctccactctgactggcacagtctttgcatggagacttgaggagggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatggaaaaaaaaaaaaaaanaaaaaaaaaaaaccttgttgcccgggaggagtgaaaagatcaatttgtttttttaaaggatcactctggctgctgtgttaagaacagtctttaacaagacaaagagggaaggactctggttaggaagctgtgatgataatccggattaaggcccagggcagttgcagttatggtggaaaaagtgtgtttttttttaatatacgaatggcccaccgattccatgggttctgcatttggagattccaacaatcacacaattgaaaatttttggaaaaaaactggatcttgttaaaccaggacaagatttttttgggctttattccctaagccaaaaccgggttaccaccttttttacctggcctttaaatccgctttt

SEQ ID NO: 61972 - DNA, 1695 bp, Homo sapiens
atctagaggatctattttgcggctgctttccctcattaagaattgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggtccttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttgccacagctcttgaggatgtcaccaattaaccagaaatccagttattttccgccctcaaaatgacagccatggccggccgggtgcttctgggggctcgtcggggggacagctccactctgactggcacagtctttgcatggagacttgaggagggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatggaaa

SEQ ID NO: 61973 - DNA, 1084 bp, Homo sapiens
gcggccgccgtgcccctgtgtccctcctccctcctgtgcgcacctgccgcgggccctgggatcaggcttccagttcacccgctgcacccgcatctgccccacttgggccccctccttggcctgagggcgccccaaccccacctgccccccctggtggacacacacccaagcccgagcccccgttgccggagcccccgcacaccctggcaccgatgctcacacctggctccccgcagctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttgccacagctcttgaggatgtcaccaattaaccagaaatccagttattttccgccctcaaaatgacagccatggccggccgggtgcttctgggggctcgtcggggggacagctccactctgactggcacagtctttgcatggagacttgaggagggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatggaaa

SEQ ID NO: 61974 - DNA, 1092 bp, Homo sapiens
gaggagctgagaggaacaggaagtgtcaggactttacgacccgcgcctccagctgaggtttctagacgtgacccagggcagactggtagcaaagcccccacgcccagccaggagcaccgccgaggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccattttccgccctcaaaatgacagccatggccggccgggtgcttctgggggctcgtcggggggacagctccactctgactggcacagtctttgcatggagacttgaggagggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatggaaa

SEQ ID NO: 61975 - DNA, 1138 bp, Homo sapiens
  misc_feature (762)..(762): n is a, c, g, or t
gaggagctgagaggaacaggaagtgtcaggactttacgacccgcgcctccagctgaggtttctagacgtgacccagggcagactggtagcaaagcccccacgcccagccaggagcaccgccgaggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacacttgaggagggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaataaaacttcaatacaggctgtccatggaaaaaaaaaaaaaaanaaaaaaaaaaaaccttgttgcccgggaggagtgaaaagatcaatttgtttttttaaaggatcactctggctgctgtgttaagaacagtctttaacaagacaaagagggaaggactctggttaggaagctgtgatgataatccggattaaggcccagggcagttgcagttatggtggaaaaagtgtgtttttttttaatatacgaatggcccaccgattccatgggttctgcatttggagattccaacaatcacacaattgaaaatttttggaaaaaaactggatcttgttaaaccaggacaagatttttttgggctttattccctaagccaaaaccgggttaccaccttttttacctggcctttaaatccgctttt

SEQ ID NO: 61976 - DNA, 562 bp, Homo sapiens
gtcccaggccagctggaggggagcttcatgggtggtcagccccaggggttgggcctgagaccgtcaccaagaccccttccctccacaggacatgctgggcctgcgccccccactgctcgccctggtggggctgctctccctcgggtgcggtgagttctgtgttccacggaggggactccacgcgtgacattccaatcagggagaacagggcctgccctcactttcccatagacagaagttcccgggaggctggggaaggaccttgccactggggtcctctctcaggagtgcacgaagttcaaggtcagcagctgccgggaatgcatcgagtcggggcccggctgcacctggtgccagaagctgggagcggctttgggtcctccagcccacgccaccgcggcgagcagtccccggaggagaagccgggtggctcccgtctgtcctcggactgagcagggtggccaggccccaggtggaaactaccttggtcaggctgggttttttccctcccctttctggaggttttcagctcctctgaaataaacacctttcagtgagaaaa

SEQ ID NO: 61977 - DNA, 2198 bp, Homo sapiens
ctcggtcttccagtttcccggcgtgcttagggcgcgccaaatgggagggggagacgcaagatggcggcagccgcgaactccggctctagcctcccgctgttcgactgcccaacctgggcaggtaagccccctcccggtttacatctggatgtagtcaaaggagacaaactaattgagaaactgattattgatgagaagaagtattacttatttgggagaaaccctgatttgtgtgactttaccattgaccaccagtcttgctctcgggtccatgctgcacttgtctaccacaagcatctgaagagagttttcctgatagatctcaacagtacacacggcactttcttgggtcacattcggttggaacctcacaagcctcagcaaattcccatcgattccacggtctcatttggcgcatccacaagggcatacactctgcgcgagaagcctcagacattgccatcggctgtgaaaggagatgagaagatgggtggagaggatgatgaactcaagggcttactggggcttccagaggaggaaactgagcttgataacctgacagagttcaacactgcccacaacaagcggatttctacccttaccattgaggagggaaatctggacattcaaagaccaaagaggaagaggaagaactcacgggtgacattcagtgaggatgatgagatcatcaacccagaggatgtggatccctcagttggtcgattcaggaacatggtgcaaactgcagtggtcccagtcaagaagaagcgtgtggagggccctggctccctgggcctggaggaatcagggagcaggcgcatgcagaactttgccttcagcggaggactctacgggggcctgccccccacacacagtgaagcaggctcccagccacatggcatccatgggacagcactcatcggtggcttgcccatgccatacccaaaccttgcccctgatgtggacttgactcctgttgtgccgtcagcagtgaacatgaaccctgcaccaaaccctgcagtctataaccctgaagctgtaaatgaacccaagaagaagaaatatgcaaaagaggcttggccaggcaagaagcccacaccttccttgctgatttgatatttttggtcatggagaagggtgggattgggtgggaatggggtggaagggtgatggggagctaatgaactagggagaaaaactttccatgtgtgcggtatcgtctttcagaatgtctcctggcatcctaaccatgtaatatgacaattgggggtggggttgaaatagcccataaagacctgtcttcacaacacttgcattgtagagaaaggcttcttatatccttttcaatagactgccctggctctttcctaggccttccactacctcctttctttctcccactttctaggatcatttttatgtaaagtcacatatcccaggccctcaggttgaatccagagctgtagaggttacagtagcatcaccagccttgggggtccagagcctaatttatattcactatccttccaagtcccgggtagcagaagggttgccatagatctcagtttgatcaaaaagaaggcttagaattctgcagttaagctgaggtttaaactaaaaaatgtttccttgggtcagtggttttgaggtccagtagctaggcttttctcttttgtccttcctgttggaatgaaaacatttcgattttccttcatctgtgactggtgccatagacacaggtttatagttttaacttacagtattgtttgaaatttacctgtttttcttgtcaaacctgagcactcctcctgctgaagtttcttatttaattccagagtactgtcctctactctaaggcattacttttaagtgtattatgaaggcagttttcaaaggatatgaccagttggggtaattcaaattaaaaaggaaaagatttgtttggaagtaactggtgtctctaagaggaatttttagatgtcagtttggaggctctttcccccctcaattgagagctcttgttattcagagctccaagactagacctggctaacaaacataggagacaaagttaggaaacattgatacaagctttgtacagagatttgtacatttgtgtaataggccttttcatgctttatgtgtagctttttacctgtaacctttattacattgtaaattaaacgtaacttttgtca

SEQ ID NO: 61978 - DNA, 1359 bp, Homo sapiens
tctcatttaacttttttaataggtctcaaaattctgtgacaaatttttggtcaagttgtttccattaaaaagtactgattttaaaaactaataacttaaaactgccacacgcaaaaaagaaaaccaaagtggtccacaaaacattctcctttccttctgaaggttttacgatgcattgttatcattaaccagtcttttactactaaacttaaatggccaattgaaacaaacagttctgagaccgttcttccaccactgattaagagtggggtggcaggtattagggataatattcatttagccttctgagctttctgggcagacttggtgaccttgccagctccagcagccttcttgtccactgctttgatgacacccaccgcaactgtctgtctcctggcatcctaaccatgtaatatgacaattgggggtggggttgaaatagcccataaagacctgtcttcacaacacttgcattgtagagaaaggcttcttatatccttttcaatagactgccctggctctttcctaggccttccactacctcctttctttctcccactttctaggatcatttttatgtaaagtcacatatcccaggccctcaggttgaatccagagctgtagaggttacagtagcatcaccagccttgggggtccagagcctaatttatattcactatccttccaagtcccgggtagcagaagggttgccatagatctcagtttgatcaaaaagaaggcttagaattctgcagttaagctgaggtttaaactaaaaaatgtttccttgggtcagtggttttgaggtccagtagctaggcttttctcttttgtccttcctgttggaatgaaaacatttcgattttccttcatctgtgactggtgccatagacacaggtttatagttttaacttacagtattgtttgaaatttacctgtttttcttgtcaaacctgagcactcctcctgctgaagtttcttatttaattccagagtactgtcctctactctaaggcattacttttaagtgtattatgaaggcagttttcaaaggatatgaccagttggggtaattcaaattaaaaaggaaaagatttgtttggaagtaactggtgtctctaagaggaatttttagatgtcagtttggaggctctttcccccctcaattgagagctcttgttattcagagctccaagactagacctggctaacaaacataggagacaaagttaggaaacattgatacaagctttgtacagagatttgtacatttgtgtaataggccttttcatgctttatgtgtagctttttacctgtaacctttattacattgtaaattaaacgtaacttttgtca

SEQ ID NO: 61979 - DNA, 2069 bp, Homo sapiens
atacggctaggtacgaggctgggtgtcgcaaggagacaactaattgagaaactgattattgatgagaagaagtattacttatttgggagaaaccctgatttgtgtgactttaccattgaccaccagtcttgctctcgggtccatgctgcacttgtctaccacaagcatctgaagagagttttcctgatagatctcaacagtacacacggcactttcttgggtcacattcggttggaacctcacaagcctcagcaaattcccatcgattccacggtctcatttggcgcatccacaagggcatacactctgcgcgagaagcctcagacattgccatcggctgtgaaaggagatgagaagatgggtggagaggatgatgaactcaagggcttactggggcttccagaggaggaaactgagcttgataacctgacagagttcaacactgcccacaacaagcggatttctacccttaccattgaggagggaaatctggacattcaaagaccaaagaggaagaggaagaactcacgggtgacattcagtgaggatgatgagatcatcaacccagaggatgtggatccctcagttggtcgattcaggaacatggtgcaaactgcagtggtcccagtcaagaagaagcgtgtggagggccctggctccctgggcctggaggaatcagggagcaggcgcatgcagaactttgccttcagcggaggactctacgggggcctgccccccacacacagtgaagcaggctcccagccacatggcatccatgggacagcactcatcggtggcttgcccatgccatacccaaaccttgcccctgatgtggacttgactcctgttgtgccgtcagcagtgaacatgaaccctgcaccaaaccctgcagtctataaccctgaagctgtaaatgaacccaagaagaagaaatatgcaaaagaggcttggccaggcaagaagcccacaccttccttgctgatttgatatttttggtcatggagaagggtgggattgggtgggaatggggtggaagggtgatggggagctaatgaactagggagaaaaactttccatgtgtgcggtatcgtctttcagaatgtctcctggcatcctaaccatgtaatatgacaattgggggtggggttgaaatagcccataaagacctgtcttcacaacacttgcattgtagagaaaggcttcttatatccttttcaatagactgccctggctctttcctaggccttccactacctcctttctttctcccactttctaggatcatttttatgtaaagtcacatatcccaggccctcaggttgaatccagagctgtagaggttacagtagcatcaccagccttgggggtccagagcctaatttatattcactatccttccaagtcccgggtagcagaagggttgccatagatctcagtttgatcaaaaagaaggcttagaattctgcagttaagctgaggtttaaactaaaaaatgtttccttgggtcagtggttttgaggtccagtagctaggcttttctcttttgtccttcctgttggaatgaaaacatttcgattttccttcatctgtgactggtgccatagacacaggtttatagttttaacttacagtattgtttgaaatttacctgtttttcttgtcaaacctgagcactcctcctgctgaagtttcttatttaattccagagtactgtcctctactctaaggcattacttttaagtgtattatgaaggcagttttcaaaggatatgaccagttggggtaattcaaattaaaaaggaaaagatttgtttggaagtaactggtgtctctaagaggaatttttagatgtcagtttggaggctctttcccccctcaattgagagctcttgttattcagagctccaagactagacctggctaacaaacataggagacaaagttaggaaacattgatacaagctttgtacagagatttgtacatttgtgtaataggccttttcatgctttatgtgtagctttttacctgtaacctttattacattgtaaattaaacgtaacttttgtca

SEQ ID NO: 61980 - DNA, 1518 bp, Homo sapiens
  misc_feature (38)..(38): n is a, c, g, or t
atcttatcaatagtatttaatgttttgaagaaatagancagtgtacaaagggatagggaattcatttctgttaatgtatttattagttcttactaggagaagaaatgtaactattctcttcaaaaccgttaaaaatcaagcactgaggcagccacaccatcgtttgctccctatgttccgatatccttaagatgagctcaaagaaaaattaaatcttgattcagggtaaaagtttctgctaattggcttgcccatgccatacccaaaccttgcccctgatgtggacttgactcctgttgtgccgtcagcagtgaacatgaaccctgcaccaaaccctgcagtctataaccctgaagctgtaaatgaacccaagaagaagaaatatgcaaaagaggcttggccaggcaagaagcccacaccttccttgctgatttgatatttttggtcatggagaagggtgggattgggtgggaatggggtggaagggtgatggggagctaatgaactagggagaaaaactttccatgtgtgcggtatcgtctttcagaatgtctcctggcatcctaaccatgtaatatgacaattgggggtggggttgaaatagcccataaagacctgtcttcacaacacttgcattgtagagaaaggcttcttatatccttttcaatagactgccctggctctttcctaggccttccactacctcctttctttctcccactttctaggatcatttttatgtaaagtcacatatcccaggccctcaggttgaatccagagctgtagaggttacagtagcatcaccagccttgggggtccagagcctaatttatattcactatccttccaagtcccgggtagcagaagggttgccatagatctcagtttgatcaaaaagaaggcttagaattctgcagttaagctgaggtttaaactaaaaaatgtttccttgggtcagtggttttgaggtccagtagctaggcttttctcttttgtccttcctgttggaatgaaaacatttcgattttccttcatctgtgactggtgccatagacacaggtttatagttttaacttacagtattgtttgaaatttacctgtttttcttgtcaaacctgagcactcctcctgctgaagtttcttatttaattccagagtactgtcctctactctaaggcattacttttaagtgtattatgaaggcagttttcaaaggatatgaccagttggggtaattcaaattaaaaaggaaaagatttgtttggaagtaactggtgtctctaagaggaatttttagatgtcagtttggaggctctttcccccctcaattgagagctcttgttattcagagctccaagactagacctggctaacaaacataggagacaaagttaggaaacattgatacaagctttgtacagagatttgtacatttgtgtaataggccttttcatgctttatgtgtagctttttacctgtaacctttattacattgtaaattaaacgtaacttttgtca

SEQ ID NO: 61981 - DNA, 2350 bp, Homo sapiens
ctcggtcttccagtttcccggcgtgcttagggcgcgccaaatgggagggggagacgcaagatggcggcagccgcgaactccggctctagcctcccgctgttcgactgcccaacctgggcaggtaagccccctcccggtttacatctggatgtagtcaaaggagacaaactaattgagaaactgattattgatgagaagaagtattacttatttgggagaaaccctgatttgtgtgactttaccattgaccaccagtcttgctctcgggtccatgctgcacttgtctaccacaagcatctgaagagagttttcctgatagatctcaacagtacacacggcactttcttgggtcacattcggttggaacctcacaagcctcagcaaattcccatcgattccacggtctcatttggcgcatccacaagggcatacactctgcgcgagaagcctcagacattgccatcggctgtgaaaggagatgagaagatgggtggagaggatgatgaactcaagggcttactggggcttccagaggaggaaactgagcttgataacctgacagagttcaacactgcccacaacaagcggatttctacccttaccattgaggagggaaatctggacattcaaagaccaaagaggaagaggaagaactcacgggtgacattcagtgaggatgatgagatcatcaacccagaggatgtggatccctcagttggtcgattcaggaacatggtgcaaactgcagtggtcccagtcaagaagaagcgtgtggagggccctggctccctgggcctggaggaatcagggagcaggcgcatgcagaactttgccttcagcggaggactctacgggggcctgccccccacacacagtgaagcaggctcccagccacatggcatccatgggacagcactcatcggtggcttgcccatgccatacccaaaccttgcccctgatgtggacttgactcctgttgtgccgtcagcagtgaacatgaaccctgcaccaaaccctgcagtctataaccctgaagctgtaaatgaacccaagaagaagaaatatgcaaaagaggcttggccaggcaagaagcccacaccttccttgctgatttgatatttttggtcatggagaagggtgggattgggtgggaatggggtggaagggtgatggggagctaatgaactagggagaaaaactttccatgtgtgcggtatcgtctttcagaatgtctcctggcatcctaaccatgtaatatgacaattgggggtggggttgaaatagcccataaagacctgtcttcacaacacttgcattgtagagaaaggcttcttatatccttttcaatagactgccctggctctttcctaggccttccactacctcctttctttctcccactttctaggatcatttttatgtaaagtcacatatcccaggccctcaggttgaatccagagctgtagaggttacagtagcatcaccagccttgggggtccagagcctaatttatattcactatccttccaagtcccgggtagcagaagggttgccatagatctcagtttgatcaaaaagaaggcttagaattctgcagttaagctgaggtttaaactaaaaaatgtttccttgggtcagtggttttgaggtccagtagctaggcttttctcttttgtccttcctgttggaatgaaaacatttcgattttccttcatctgtgactggtgccatagacacaggtttatagttttaacttacagtattgtttgaaatttacctgtttttcttgtcaaacctgagcactcctcctgctgaagtttcttatttaattccagagtactgtcctctactctaaggcattacttttaagtgtattatgaaggcagttttcaaaggatatgaccagttggggtaattcaaattaaaaaggaaaagatttgtttggaagtaactggtgtctctaagaggaatttttagatgtcagtttggaggctctttcccccctcaattgagagctcttgttattcagagctccaagactagacctggctaacaaacataggagacaaagttaggaaacattgatacaagctttgtacagagatttgtacatttgtgtaataggccttttcatgctttatgtgtagctttttacctgtaacctttattacattgtaaattaaacgtaacttttgtcatttgggtgcaggctgtgaatttgtctctcagtcactgattgccactgccatctggaaatgtttgctaaaggcacagtcactgggcttgggaggcaatgctccatccccattatattacaaataaagatgccctaaatgagtgtggaaattct

SEQ ID NO: 61982 - DNA, 2705 bp, Homo sapiens
ctcggtcttccagtttcccggcgtgcttagggcgcgccaaatgggagggggagacgcaagatggcggcagccgcgaactccggctctagcctcccgctgttcgactgcccaacctggtgagtggcggggcggccagggctagagtggcccggccggagctagcctgggctggaagggcggctctttttttacttttctgctgcgagccgaacggctcagaaaccccggaatggttgaggaaaaactgtttgctgcaccgggccgggcgacgtgttgaagaaccgagagcctggagcccaggcccaggaactgaagaaacccggggttgggggctcaaaggcgctcacttaggcagcccctttgagcgattagccagtcgccggagcgcttcgaggccttggcccgaacttacgcccaactcttgactgagtgcctggtgctctcgtggagcatcgcatctggccccttcctggcaggtaagccccctcccggtttacatctggatgtagtcaaaggagacaaactaattgagaaactgattattgatgagaagaagtattacttatttgggagaaaccctgatttgtgtgactttaccattgaccaccagtcttgctctcgggtccatgctgcacttgtctaccacaagcatctgaagagagttttcctgatagatctcaacagtacacacggcactttcttgggtcacattcggttggaacctcacaagcctcagcaaattcccatcgattccacggtctcatttggcgcatccacaagggcatacactctgcgcgagaagcctcagacattgccatcggctgtgaaaggagatgagaagatgggtggagaggatgatgaactcaagggcttactggggcttccagaggaggaaactgagcttgataacctgacagagttcaacactgcccacaacaagcggatttctacccttaccattgaggagggaaatctggacattcaaagaccaaagaggaagaggaagaactcacgggtgacattcagtgaggatgatgagatcatcaacccagaggatgtggatccctcagttggtcgattcaggaacatggtgcaaactgcagtggtcccagtcaagaagaagcgtgtggagggccctggctccctgggcctggaggaatcagggagcaggcgcatgcagaactttgccttcagcggaggactctacgggggcctgccccccacacacagtgaagcaggctcccagccacatggcatccatgggacagcactcatcggtggcttgcccatgccatacccaaaccttgcccctgatgtggacttgactcctgttgtgccgtcagcagtgaacatgaaccctgcaccaaaccctgcagtctataaccctgaagctgtaaatgaacccaagaagaagaaatatgcaaaagaggcttggccaggcaagaagcccacaccttccttgctgatttgatatttttggtcatggagaagggtgggattgggtgggaatggggtggaagggtgatggggagctaatgaactagggagaaaaactttccatgtgtgcggtatcgtctttcagaatgtctcctggcatcctaaccatgtaatatgacaattgggggtggggttgaaatagcccataaagacctgtcttcacaacacttgcattgtagagaaaggcttcttatatccttttcaatagactgccctggctctttcctaggccttccactacctcctttctttctcccactttctaggatcatttttatgtaaagtcacatatcccaggccctcaggttgaatccagagctgtagaggttacagtagcatcaccagccttgggggtccagagcctaatttatattcactatccttccaagtcccgggtagcagaagggttgccatagatctcagtttgatcaaaaagaaggcttagaattctgcagttaagctgaggtttaaactaaaaaatgtttccttgggtcagtggttttgaggtccagtagctaggcttttctcttttgtccttcctgttggaatgaaaacatttcgattttccttcatctgtgactggtgccatagacacaggtttatagttttaacttacagtattgtttgaaatttacctgtttttcttgtcaaacctgagcactcctcctgctgaagtttcttatttaattccagagtactgtcctctactctaaggcattacttttaagtgtattatgaaggcagttttcaaaggatatgaccagttggggtaattcaaattaaaaaggaaaagatttgtttggaagtaactggtgtctctaagaggaatttttagatgtcagtttggaggctctttcccccctcaattgagagctcttgttattcagagctccaagactagacctggctaacaaacataggagacaaagttaggaaacattgatacaagctttgtacagagatttgtacatttgtgtaataggccttttcatgctttatgtgtagctttttacctgtaacctttattacattgtaaattaaacgtaacttttgtcatttgggtgcaggctgtgaatttgtctctcagtcactgattgccactgccatctggaaatgtttgctaaaggcacagtcactgggcttgggaggcaatgctccatccccattatattacaaataaagatgccctaaatgagtgtggaaattct

SEQ ID NO: 61983 - DNA, 1233 bp, Homo sapiens
ctcggtcttccagtttcccggcgtgcttagggcgcgccaaatgggagggggagacgcaagatggcggcagccgcgaactccggctctagcctcccgctgttcgactgcccaacctgggcaggtaagccccctcccggtttacatctggatgtagtcaaaggagacaaactaattgagaaactgattattgatgagaagaagtattacttatttgggagaaaccctgatttgtgtgactttaccattgaccaccagtcttgctctcgggtccatgctgcacttgtctaccacaagcatctgaagagagttttcctgatagatctcaacagtacacacggcactttcttgggtcacattcggttggaacctcacaagcctcagcaaattcccatcgattccacggtctcatttggcgcatccacaagggcatacactctgcgcgagaagcctcagacattgccatcggctgtgaaaggagatgagaagatgggtggagaggatgatgaactcaagggcttactggggcttccagaggaggaaactgagcttgataacctgacagagttcaacactgcccacaacaagcggatttctacccttaccattgaggagggaaatctggacattcaaagaccaaagaggaagaggaagaactcacgggtgacattcagtgaggatgatgagatcatcaacccagaggatgtggatccctcagttggtcgattcaggaacatggtgcaaactgcagtggtcccagtcaagaagaagcgtgtggagggccctggctccctgggcctggaggaatcagggagcaggcgcatgcagaactttgccttcagcggaggactctacgggggcctgccccccacacacagtgaagcaggctcccagccacatggcatccatgggacagcactcatcggtggcttgcccatgccatacccaaaccttgcccctgatgtggacttgactcctgttgtgccgtcagcagtgaacatgaaccctgcaccaaaccctgcagtctataaccctgaagctgtaaatgaacccaagaagaagaaatatgcaaaagaggcttggctttgggtgcaggctgtgaatttgtctctcagtcactgattgccactgccatctggaaatgtttgctaaaggcacagtcactgggcttgggaggcaatgctccatccccattatattacaaataaagatgccctaaatgagtgtggaaattct

SEQ ID NO: 61984 - DNA, 162 bp, Homo sapiens
ctcgggtccatgctgcacttgtctaccacaagcatctgaagagagttttcctgatagatctcaacagtagtaagtaactccctcccaattcacatgttacctttaggcaatatgaaaatactctttgggttctttagtttggaaattacgttttatggaaaa

SEQ ID NO: 61985 - DNA, 2452 bp, Homo sapiens
ctcggtcttccagtttcccggcgtgcttagggcgcgccaaatgggagggggagacgcaagatggcggcagccgcgaactccggctctagcctcccgctgttcgactgcccaacctggtgagtggcggggcggccagggctagagtggcccggccggagctagcctgggctggaagggcggctctttttttacttttctgctgcgagccgaacggctcagaaaccccggaatggttgaggaaaaactgtttgctgcaccgggccgggcgacgtgttgaagaaccgagagcctggagcccaggcccaggaactgaagaaacccggggttgggggctcaaaggcgctcacttaggcagcccctttgagcgattagccagtcgccggagcgcttcgaggccttggcccgaacttacgcccaactcttgactgagtgcctggtgctctcgtggagcatcgcatctggccccttcctgtacgtcccgagcgcgctcgagccagccccggccccaaccctacctccaagccccgcatccctctgtggttgctgcatccctcgtgcggcacttgtctgtctgccacagagaatacgaggggcaggtaagccccctcccggtttacatctggatgtagtcaaaggagacaaactaattgagaaactgattattgatgagaagaagtattacttatttgggagaaaccctgatttgtgtgactttaccattgaccaccagtcttgctctcgggtccatgctgcacttgtctaccacaagcatctgaagagagttttcctgatagatctcaacagtaaacctgacagagttcaacactgcccacaacaagcggatttctacccttaccattgaggagggaaatctggacattcaaagaccaaagaggaagaggaagaactcacgggtgacattcagtgaggatgatgagatcatcaacccagaggatgtggatccctcagttggtcgattcaggaacatggtgcaaactgcagtggtcccagtcaagaagaagcgtgtggagggccctggctccctgggcctggaggaatcagggagcaggcgcatgcagaactttgccttcagcggaggactctacgggggcctgccccccacacacagtgaagcaggctcccagccacatggcatccatgggacagcactcatcggtggcttgcccatgccatacccaaaccttgcccctgatgtggacttgactcctgttgtgccgtcagcagtgaacatgaaccctgcaccaaaccctgcagtctataaccctgaagctgtaaatgaacccaagaagaagaaatatgcaaaagaggcttggccaggcaagaagcccacaccttccttgctgatttgatatttttggtcatggagaagggtgggattgggtgggaatggggtggaagggtgatggggagctaatgaactagggagaaaaactttccatgtgtgcggtatcgtctttcagaatgtctcctggcatcctaaccatgtaatatgacaattgggggtggggttgaaatagcccataaagacctgtcttcacaacacttgcattgtagagaaaggcttcttatatccttttcaatagactgccctggctctttcctaggccttccactacctcctttctttctcccactttctaggatcatttttatgtaaagtcacatatcccaggccctcaggttgaatccagagctgtagaggttacagtagcatcaccagccttgggggtccagagcctaatttatattcactatccttccaagtcccgggtagcagaagggttgccatagatctcagtttgatcaaaaagaaggcttagaattctgcagttaagctgaggtttaaactaaaaaatgtttccttgggtcagtggttttgaggtccagtagctaggcttttctcttttgtccttcctgttggaatgaaaacatttcgattttccttcatctgtgactggtgccatagacacaggtttatagttttaacttacagtattgtttgaaatttacctgtttttcttgtcaaacctgagcactcctcctgctgaagtttcttatttaattccagagtactgtcctctactctaaggcattacttttaagtgtattatgaaggcagttttcaaaggatatgaccagttggggtaattcaaattaaaaaggaaaagatttgtttggaagtaactggtgtctctaagaggaatttttagatgtcagtttggaggctctttcccccctcaattgagagctcttgttattcagagctccaagactagacctggctaacaaacataggagacaaagttaggaaacattgatacaagctttgtacagagatttgtacatttgtgtaataggccttttcatgctttatgtgtagctttttacctgtaacctttattacattgtaaattaaacgtaacttttgtca

SEQ ID NO: 61986 - DNA, 2553 bp, Homo sapiens
ctcggtcttccagtttcccggcgtgcttagggcgcgccaaatgggagggggagacgcaagatggcggcagccgcgaactccggctctagcctcccgctgttcgactgcccaacctggtgagtggcggggcggccagggctagagtggcccggccggagctagcctgggctggaagggcggctctttttttacttttctgctgcgagccgaacggctcagaaaccccggaatggttgaggaaaaactgtttgctgcaccgggccgggcgacgtgttgaagaaccgagagcctggagcccaggcccaggaactgaagaaacccggggttgggggctcaaaggcgctcacttaggcagcccctttgagcgattagccagtcgccggagcgcttcgaggccttggcccgaacttacgcccaactcttgactgagtgcctggtgctctcgtggagcatcgcatctggccccttcctggcaggtaagccccctcccggtttacatctggatgtagtcaaaggagacaaactaattgagaaactgattattgatgagaagaagtattacttatttgggagaaaccctgatttgtgtgactttaccattgaccaccagtcttgctctcgggtccatgctgcacttgtctaccacaagcatctgaagagagttttcctgatagatctcaacagtacacacggcactttcttgggtcacattcggttggaacctcacaagcctcagcaaattcccatcgattccacggtctcatttggcgcatccacaagggcatacactctgcgcgagaagcctcagacattgccatcggctgtgaaaggagatgagaagatgggtggagaggatgatgaactcaagggcttactggggcttccagaggaggaaactgagcttgataacctgacagagttcaacactgcccacaacaagcggatttctacccttaccattgaggagggaaatctggacattcaaagaccaaagaggaagaggaagaactcacgggtgacattcagtgaggatgatgagatcatcaacccagaggatgtggatccctcagttggtcgattcaggaacatggtgcaaactgcagtggtcccagtcaagaagaagcgtgtggagggccctggctccctgggcctggaggaatcagggagcaggcgcatgcagaactttgccttcagcggaggactctacgggggcctgccccccacacacagtgaagcaggctcccagccacatggcatccatgggacagcactcatcggtggcttgcccatgccatacccaaaccttgcccctgatgtggacttgactcctgttgtgccgtcagcagtgaacatgaaccctgcaccaaaccctgcagtctataaccctgaagctgtaaatgaacccaagaagaagaaatatgcaaaagaggcttggccaggcaagaagcccacaccttccttgctgatttgatatttttggtcatggagaagggtgggattgggtgggaatggggtggaagggtgatggggagctaatgaactagggagaaaaactttccatgtgtgcggtatcgtctttcagaatgtctcctggcatcctaaccatgtaatatgacaattgggggtggggttgaaatagcccataaagacctgtcttcacaacacttgcattgtagagaaaggcttcttatatccttttcaatagactgccctggctctttcctaggccttccactacctcctttctttctcccactttctaggatcatttttatgtaaagtcacatatcccaggccctcaggttgaatccagagctgtagaggttacagtagcatcaccagccttgggggtccagagcctaatttatattcactatccttccaagtcccgggtagcagaagggttgccatagatctcagtttgatcaaaaagaaggcttagaattctgcagttaagctgaggtttaaactaaaaaatgtttccttgggtcagtggttttgaggtccagtagctaggcttttctcttttgtccttcctgttggaatgaaaacatttcgattttccttcatctgtgactggtgccatagacacaggtttatagttttaacttacagtattgtttgaaatttacctgtttttcttgtcaaacctgagcactcctcctgctgaagtttcttatttaattccagagtactgtcctctactctaaggcattacttttaagtgtattatgaaggcagttttcaaaggatatgaccagttggggtaattcaaattaaaaaggaaaagatttgtttggaagtaactggtgtctctaagaggaatttttagatgtcagtttggaggctctttcccccctcaattgagagctcttgttattcagagctccaagactagacctggctaacaaacataggagacaaagttaggaaacattgatacaagctttgtacagagatttgtacatttgtgtaataggccttttcatgctttatgtgtagctttttacctgtaacctttattacattgtaaattaaacgtaacttttgtca

SEQ ID NO: 61987 - DNA, 2384 bp, Homo sapiens
ctcggtcttccagtttcccggcgtgcttagggcgcgccaaatgggagggggagacgcaagatggcggcagccgcgaactccggctctagcctcccgctgttcgactgcccaacctgggcaggtaagccccctcccggtttacatctggatgtagtcaaaggagacaaactaattgagaaactgattattgatgagaagaagtattacttatttgggagaaaccctgatttgtgtgactttaccattgaccaccagtcttgctctcgggtccatgctgcacttgtctaccacaagcatctgaagagagttttcctgatagatctcaacagtacacacggcactttcttgggtcacattcggttggaacctcacaagcctcagcaaattcccatcgattccacggtctcatttggcgcatccacaagggcatacactctgcgcgagaagcctcagacattgccatcggctgtgaaaggagatgagaagatgggtggagaggatgatgaactcaagggcttactggggcttccagaggaggaaactgagcttgataacctgacagagttcaacactgcccacaacaagcggatttctacccttaccattgaggagggaaatctggacattcaaagaccaaagaggaagaggaagaactcacgggtgacattcagtgaggatgatgagatcatcaacccagaggatgtggatccctcagttggtcgattcaggaacatggtgcaaactgcagtggtcccagtcaagaagaagcgtgtggagggccctggctccctgggcctggaggaatcagggagcaggcgcatgcagaactttgccttcagcggaggactctacgggggcctgccccccacacacagtgaagcaggctcccagccacatggcatccatgggacagcactcatcggtggcttgcccatgccatacccaaaccttgcccctgatgtggacttgactcctgttgtgccgtcagcagtgaacatgaaccctgcaccaaaccctgcagtctataaccctgaagctgtaaatgaacccaagaagaagaaatatgcaaaagaggcttggccaggcaagaagcccacaccttccttgctgatttgatatttttggtcatggagaagggtgggattgggtgggaatggggtggaagggtgatggggagctaatgaactagggagaaaaactttccatgtgtgcggtatcgtctttcagaatgtctcctggcatcctaaccatgtaatatgacaattgggggtggggttgaaatagcccataaagacctgtcttcacaacacttgcattgtagagaaaggcttcttatatccttttcaatagactgccctggctctttcctaggccttccactacctcctttctttctcccactttctaggatcatttttatgtaaagtcacatatcccaggccctcaggttgaatccagagctgtagaggttacagtagcatcaccagccttgggggtccagagcctaatttatattcactatccttccaagtcccgggtagcagaagggttgccatagatctcagtttgatcaaaaagaaggcttagaattctgcagttaagctgaggtttaaactaaaaaatgtttccttgggtcagtggttttgaggtccagtagctaggcttttctcttttgtccttcctgttggaatgaaaacatttcgattttccttcatctgtgactggtgccatagacacaggtttatagttttaacttacagtattgtttgaaatttacctgtttttcttgtcaaacctgagcactcctcctgctgaagtttcttatttaattccagagtactgtcctctactctaaggcattacttttaagtgtattatgaaggcagttttcaaaggatatgaccagttggggtaattcaaattaaaaaggaaaagatttgtttggaagtaactggtgtctctaagaggaatttttagatgtcagtttggaggctctttcccccctcaattgagagctcttgttattcagagctccaagactagacctggctaacaaacataggagacaaagttaggaaacattgatacaagctttgtacagagatttgtacatttgtgtaataggccttttcatgctttatgtgtagctttttacctgtaacctttattacattgtaaattaaacgtaacttttgtcaaaaaaaaaaaacacacaagcacccacgcaccacaacaacacaacaccaaaccaaacaaaacaaaacacggggggcgcccataaaaaacatccccgggggacccacaatgacgcgccaccttcttgcgcaaagggggccccaaaagggggggatacacaagaggaggcggcgccaaacacagcgcga

SEQ ID NO: 61988 - DNA, 281 bp, Homo sapiens
gcaatatttactgtaaactcatggaggggcttgttgagacagattcttagtgttgtgttaggagcattgtgtgttcctatttctctgtggaaaaaaaaaaaaaagagagaaatctcagcaacaacacaacctgcccagcaaaaatcccagctgttcctggcaggaaactgcaagatctcttagcagccggctgttggatgcctagccctggactgggtgctgtgtgggggtggcataacagacaagatagcaagcaagacctgcccagagaacagtggagg

SEQ ID NO: 61989 - DNA, 649 bp, Homo sapiens
aatacttagaatatttttttccaatctccagatacctttgcaagtgatattcctgtaaacataccacagtatccaaaaaagtctggaaacatcaaggaaatagtatttttactgtaattttttctgactagcaaggtggtatgatccatttctttcatacttcattggggatcattacttttttctgcctcacaggatgtataaatgactcataataaattaaggattattaaataataatgacaataataataacaactataatgataatagtaaaaataacaagcagcagcagcagcagcagaaagcacaagcctaagtggaaaattaggtttcctagaggctcctgttctccacagcatgaccttaaaatgggaatcatttctcaagcctctaagacaccaaagcacagatgcacggtgcataaacaaataagtgaccacattagtggtgccctttgggggtttaaaatcttattcttatgaccccaggaagctgaccagagagaagggggaagaaagaagtacaggatatttatctttacattttggaaatgcttttgatcagcagagctggaacaagtttctgtgcttttgtgggaactacaaatgttccaggggaggaagcaagatcaagagcagtttgctct

SEQ ID NO: 61990 - DNA, 825 bp, Homo sapiens
  misc_feature (133)..(133): n is a, c, g, or t
  misc_feature (138)..(138): n is a, c, g, or t
  misc_feature (144)..(144): n is a, c, g, or t
  misc_feature (154)..(156): n is a, c, g, or t
  misc_feature (159)..(161): n is a, c, g, or t
  misc_feature (177)..(177): n is a, c, g, or t
  misc_feature (182)..(182): n is a, c, g, or t
  misc_feature (187)..(187): n is a, c, g, or t
  misc_feature (189)..(189): n is a, c, g, or t
  misc_feature (191)..(191): n is a, c, g, or t
  misc_feature (212)..(212): n is a, c, g, or t
  misc_feature (226)..(226): n is a, c, g, or t
ctcactgcaacctccaccagccgggttcaagcgattctcctgccgcagcctcctatgtcggacgtgggatacagaatgagcatccatctcaagaaaaaaaaaaaaaaaaaactgtataggggccgggcgtttngtttntttttnttatcccatnnnttnnntttttctgttttttgnttttnttgtntntnttttttttttttctctttttntttgtgtgtggttntggttggtgaatcgctggagcccgggaggtggaggcttcagtaagccaagattatgccattgcactccagcctgggtgacagagtgagacctcatctcaagaacacaacataccgttggactcccaaagtgctaggcctcctctcacataggaaggccccatctctatgaaataaaaaacttagctgagcatagtgatacacgcctgcagtgctagctacttgaaggccgaggcaggagggttgcttgacctcaggagtttgagggcacagtaagtcaagattgcaacactgcactccagcctgggcaacaaagcaagactctgtctcaaaaaagagagcagggcaggcgcagtggcccacgcctgtaatcccaagaactttgggagggtgagatgggaggatcgcttgagctcaggaatttgagagaccaatctgggcaacagggcgatcctgtctctaccaaattttttttaattttatttatttatttatttttttgaggctcagtctcgcactgtcactcaggctgcagtgcagtggcgctatcttggctcactacaagctctgcctcccgggttcatgccattcttctgcctca

SEQ ID NO: 61991 - DNA, 4584 bp, Homo sapiens
ggaggggcgtgccctggagttgggggcggggcgaggcgggctcctccccggcgggcgggcccgggcgcggcgcggtggcctcgcggtgcctaggctggggctgccggaccgtgaggctgtgagtcgcgcggacggagccggacaaaagcgggcggcggcggcaggatgaacagcatcaagaacgtgccggcgcgggtgctgagccgcaggccgggccacagcctggaggccgagcgcgagcagttcgacaagacccaggccatcagcatcagcaaagccatcaacacccaggaggcccccgtgaaggagaagcacgcccggcgcatcattctgggcacacaccacgagaagggggctttcaccttctggtcctatgccattgggctgccgctgcccagcagctccattctcagctggaagttctgccacgtcctccacaaggtccttcgagacgggcaccccaatgtgctgcatgactgccagcggtaccgcagcaacatccgggagattggagacctgtggggacatttgcatgaccgctacggacagctggtgaatgtctacaccaagctgctgctgaccaagatctccttccacctcaagcatccccagtttcccgcgggcctggaggtgacagatgaggtactggagaaggcagctgggaccgatgtcaacaacatcttccagctcactgtggagatgtttgattacatggattgtgagctgaagctttctgaatcagttttccgacagctcaacacggccatcgccgtatcccagatgtcctcaggccagtgccgcctggcccccctcatccaggtcatccaggactgcagccacctctaccactacacggtcaagctcctgttcaagctacactcttgtctccctgcggacaccctgcaaggccacagggaccggttccacgagcagtttcacagcctcaggaacttcttccgcagagcctccgacatgctgtacttcaagcggctcatccagatcccccggctgcccgagggaccccctaacttcctgcgggcctcagccctggctgagcacatcaagccggtggtggtgatccccgaggaggccccggaagatgaggagccggagaatctcattgagatcagcacagggccccccgcgggggagccagtggtggtggctgacctcttcgatcagacgtttggaccccccaatgggtctgtgaaggacgacagggacctccagattgagagcttgaagagagaggtggaaatgctccgctctgaactggagaagatcaagctggaggcccagcggtacatcgcgcagctgaagagccaggtgaatgcactggagggtgagctggaggagcagcggaagcagaagcagaaggccctggtggataatgagcagctccgccacgagctggcccagctgagggctgcccagctggagggcgagcggagccagggcctgcgtgaggaggctgagaggaaggccagtgccacggaggcgcgctacaacaagctgaaggaaaagcacagtgagctcgtccatgtgcacgcggagctgctcagaaagaacgcggacacagccaagcagctgacggtgacgcagcaaagccaggaggaggtggcgcgggtgaaggagcagctggccttccaggtggagcaggtgaagcgggagtcggagttgaagctagaggagaagagcgaccagctggagaagctcaagagggagctggaggccaaggccggagagctggcccgcgcgcaggaggccctgagccacacagagcagagcaagtcggagctgagctcacggctggacacgctgagtgcggagaaggatgctctgagtggagctgtgcggcagcgggaggcagacctgctggcggcgcagagcctggtgcgcgagacagaggcggcgctgagccgggagcagcagcgcagctcccaggagcagggcgagttgcagggccggctggcagagagggagtctcaggagcaggggctgcggcagaggctgctggacgagcagttcgcagtgttgcggggcgctgctgccgaggccgcgggcatcctgcaggatgccgtgagcaagctggacgaccccctgcacctgcgctgtaccagctccccagactacctggtgagcagggcccaggaggccttggatgccgtgagcaccctggaggagggccacgcccagtacctgacctccttggcagacgcctccgccctggtggcagctctgacccgcttctcccacctggctgcggataccatcatcaatggcggtgccacctcgcacctggctcccaccgaccctgccgaccgcctcatagacacctgcagggagtgcggggcccgggctctggagctcatggggcagctgcaggaccagcaggctctgcggcacatgcaggccagcctggtgcggacacccctgcagggcatccttcagctgggccaggaactgaaacccaagagcctagatgtgcggcaggaggagctgggggccgtggtcgacaaggagatggcggccacatccgcagccattgaagatgctgtgcggaggattgaggacatgatgaaccaggcacgccacgccagctcgggggtgaagctggaggtgaacgagaggatcctcaactcctgcacagacctgatgaaggctatccggctcctggtgacgacatccactagcctgcagaaggagatcgtggagagcggcaggggggcagccacgcagcaggaattttacgccaagaactcgcgctggaccgaaggcctcatctcggcctccaaggctgtgggctggggagccacacagctggtggaggcagctgacaaggtggtgcttcacacgggcaagtatgaggagctcatcgtctgctcccacgagatcgcagccagcacggcccagctggtggcggcctccaaggtgaaggccaacaagcacagcccccacctgagccgcctgcaggaatgttctcgcacagtcaatgagagggctgccaatgtggtggcctccaccaagtcaggccaggagcagattgaggacagagacaccatggatttctccggcctgtccctcatcaagctgaagaagcaggagatggagacgcaggtgcgtgtcctggagctggagaagacgctggaggctgaacgcatgcggctgggggagttgcggaagcaacactacgtgctggctggggcatcaggcagccctggagaggaggtggccatccggcccagcactgccccccgaagtgtaaccaccaagaaaccacccctggcccagaagcccagcgtggcccccagacaggaccaccagcttgacaaaaaggatggcatctacccagctcaactcgtgaactactaggccccccaggggtccagcagggtggctggtgacaggcctgggcctctgcaactgccctgacaggaccgagaggccttgcccctccacctggtgcccaagcctcccgccccaccgtctggatcaatgtcctcaaggcccctggcccttactgagcctgcagggtcctgggccatgtgggtggtgcttctggatgtgagtctcttatttatctgcagaaggaactttggggtgcagccaggacccggtaggcctgagcctcaactcttcagaaaatagtgtttttaatattcctcttcagaaaatagtgtttttaatattccgagctagagctcttcttcctacgtttgtagtcagcacactgggaaaccgggccagcgtggggctccctgccttctggactcctgaaggtcgtggatggatggaaggcacacagcccgtgccggctgatgggacgagggtcaggcatcctgtctgtggccttctggggcaccgattctaccaggccctccagctgcgtggtctccgcagaccaggctctgtgtgggctagaggaatgtcgcccattactcctcaggcctggccctcgggcctccgtgatgggagccccccaggaggggtcagatgctggaaggggccgctttctggggagtgaggtgagacatagcggcccaggcgctgccttcactcctggagtttccatttccagctggaatctgcagccacccccatttcctgttttccattcccccgttctggccgcgccccactgcccacctgaaggggtggtttccagccctccggagagtgggcttggccctaggccctccagctcagccagaaaaagcccagaaacccaggtgctggaccagggccctcagggaggggaccctgcggctagagtgggctaggccctggctttgcccgtcagatttgaacgaatgtgtgtcccttgagcccaaggagagcggcaggaggggtgggaccaggctgggaggacagagccagcagctgccatgccctcctgctccccccaccccagccctagccctttagcctttcaccctgtgctctggaaaggctaccaaatactggccaaggtcaggaggagcaaaaatgagccagcaccagcgccttggctttgtgttagcatttcctcctgaagtgttctgttggcaataaaatgcactttgactgttaaaattgtcactgatg

SEQ ID NO: 61992 - DNA, 420 bp, Homo sapiens
gcagggggcacactggtgtgtgggagctggcttagggccctgcttcacagttggaccaccttggacaggttgcccagctcccaagggctcacgttcttcctcctgccccttttgcacagttttccgacagctcaacacggccatcgccgtatcccagatgtcctcaggccagtgccgcctggcccccctcatccaggtcatccaggactgcagccacctctaccactacacggtcaagctcctgttcaagctacactcttgtgagtggcccagggcaacccctggcccggaaggctgtgtttatatggcttagacattcactgtcaaaaaggaaaatcgaaaaattagaggtttattcatttaaaaatggcagtaataaacccactgcccattaatagaaataacatatattttatgaaa

SEQ ID NO: 61993 - DNA, 3865 bp, Homo sapiens
catgcgttcgcggacgcgtggggttttccgacagctcaacacggccatcgccgtatcccagatgtcctcaggccagtgccgcctggcccccctcatccaggtcatccaggactgcagccacctctaccactacacggtcaagctcctgttcaagctacactcttgtctccctgcggacaccctgcaaggccacagggaccggttccacgagcagtttcacagcctcaggaacttcttccgcagagcctccgacatgctgtacttcaagcggctcatccagatcccccggctgcccgagggaccccctaacttcctgcgggcctcagccctggctgagcacatcaagccggtggtggtgatccccgaggaggccccggaagatgaggagccggagaatctcattgagatcagcacagggccccccgcgggggagccagtggtggtggctgacctcttcgatcagacgtttggaccccccaatgggtctgtgaaggacgacagggacctccagattgagagcttgaagagagaggtggaaatgctccgctctgaactggagaagatcaagctggaggcccagcggtacatcgcgcagctgaagagccaggtgaatgcactggagggtgagctggaggagcagcggaagcagaagcagaaggccctggtggataatgagcagctccgccacgagctggcccagctgagggctgcccagctggagggcgagcggagccagggcctgcgtgaggaggctgagaggaaggccagtgccacggaggcgcgctacaacaagctgaaggaaaagcacagtgagctcgtccatgtgcacgcggagctgctcagaaagaacgcggacacagccaagcagctgacggtgacgcagcaaagccaggaggaggtggcgcgggtgaaggagcagctggccttccaggtggagcaggtgaagcgggagtcggagttgaagctagaggagaagagcgaccagctggagaagctcaagagggagctggaggccaaggccggagagctggcccgcgcgcaggaggccctgagccacacagagcagagcaagtcggagctgagctcacggctggacacgctgagtgcggagaaggatgctctgagtggagctgtgcggcagcgggaggcagacctgctggcggcgcagagcctggtgcgcgagacagaggcggcgctgagccgggagcagcagcgcagctcccaggagcagggcgagttgcagggccggctggcagagagggagtctcaggagcaggggctgcggcagaggctgctggacgagcagttcgcagtgttgcggggcgctgctgccgaggccgcgggcatcctgcaggatgccgtgagcaagctggacgaccccctgcacctgcgctgtaccagctccccagactacctggtgagcagggcccaggaggccttggatgccgtgagcaccctggaggagggccacgcccagtacctgacctccttggcagacgcctccgccctggtggcagctctgacccgcttctcccacctggctgcggataccatcatcaatggcggtgccacctcgcacctggctcccaccgaccctgccgaccgcctcatagacacctgcagggagtgcggggcccgggctctggagctcatggggcagctgcaggaccagcaggctctgcggcacatgcaggccagcctggtgcggacacccctgcagggcatccttcagctgggccaggaactgaaacccaagagcctagatgtgcggcaggaggagctgggggccgtggtcgacaaggagatggcggccacatccgcagccattgaagatgctgtgcggaggattgaggacatgatgaaccaggcacgccacgccagctcgggggtgaagctggaggtgaacgagaggatcctcaactcctgcacagacctgatgaaggctatccggctcctggtgacgacatccactagcctgcagaaggagatcgtggagagcggcaggggggcagccacgcagcaggaattttacgccaagaactcgcgctggaccgaaggcctcatctcggcctccaaggctgtgggctggggagccacacagctggtggaggcagctgacaaggtggtgcttcacacgggcaagtatgaggagctcatcgtctgctcccacgagatcgcagccagcacggcccagctggtggcggcctccaaggtgaaggccaacaagcacagcccccacctgagccgcctgcaggaatgttctcgcacagtcaatgagagggctgccaatgtggtggcctccaccaagtcaggccaggagcagattgaggacagagacaccatggatttctccggcctgtccctcatcaagctgaagaagcaggagatggagacgcaggtgcgtgtcctggagctggagaagacgctggaggctgaacgcatgcggctgggggagttgcggaagcaacactacgtgctggctggggcatcaggcagccctggagaggaggtggccatccggcccagcactgccccccgaagtgtaaccaccaagaaaccacccctggcccagaagcccagcgtggcccccagacaggaccaccagcttgacaaaaaggatggcatctacccagctcaactcgtgaactactaggccccccaggggtccagcagggtggctggtgacaggcctgggcctctgcaactgccctgacaggaccgagaggccttgcccctccacctggtgcccaagcctcccgccccaccgtctggatcaatgtcctcaaggcccctggcccttactgagcctgcagggtcctgggccatgtgggtggtgcttctggatgtgagtctcttatttatctgcagaaggaactttggggtgcagccaggacccggtaggcctgagcctcaactcttcagaaaatagtgtttttaatattcctcttcagaaaatagtgtttttaatattccgagctagagctcttcttcctacgtttgtagtcagcacactgggaaaccgggccagcgtggggctccctgccttctggactcctgaaggtcgtggatggatggaaggcacacagcccgtgccggctgatgggacgagggtcaggcatcctgtctgtggccttctggggcaccgattctaccaggccctccagctgcgtggtctccgcagaccaggctctgtgtgggctagaggaatgtcgcccattactcctcaggcctggccctcgggcctccgtgatgggagccccccaggaggggtcagatgctggaaggggccgctttctggggagtgaggtgagacatagcggcccaggcgctgccttcactcctggagtttccatttccagctggaatctgcagccacccccatttcctgttttccattcccccgttctggccgcgccccactgcccacctgaaggggtggtttccagccctccggagagtgggcttggccctaggccctccagctcagccagaaaaagcccagaaacccaggtgctggaccagggccctcagggaggggaccctgcggctagagtgggctaggccctggctttgcccgtcagatttgaacgaatgtgtgtcccttgagcccaaggagagcggcaggaggggtgggaccaggctgggaggacagagccagcagctgccatgccctcctgctccccccaccccagccctagccctttagcctttcaccctgtgctctggaaaggctaccaaatactggccaaggtcaggaggagcaaaaatgagccagcaccagcgccttggctttgtgttagcatttcctcctgaagtgttctgttggcaataaaatgcactttgactgttaaaattgtcactgatg

SEQ ID NO: 61994 - DNA, 3300 bp, Homo sapiens
ggtgaaggcaggacaacttgaagtggggaaggggccttccagtcttagatagataagagacacatggttgcattcttttgagcttctgatgagcctcttccaaaaggaggcaatcagatatgtgtttctctcagtgagcagaggggagactttcaatagactgggagccaggccctgcgtgaggaggctgagaggaaggccagtgccacggaggcgcgctacaacaagctgaaggaaaagcacagtgagctcgtccatgtgcacgcggagctgctcagaaagaacgcggacacagccaagcagctgacggtgacgcagcaaagccaggaggaggtggcgcgggtgaaggagcagctggccttccaggtggagcaggtgaagcgggagtcggagttgaagctagaggagaagagcgaccagctggagaagctcaagagggagctggaggccaaggccggagagctggcccgcgcgcaggaggccctgagccacacagagcagagcaagtcggagctgagctcacggctggacacgctgagtgcggagaaggatgctctgagtggagctgtgcggcagcgggaggcagacctgctggcggcgcagagcctggtgcgcgagacagaggcggcgctgagccgggagcagcagcgcagctcccaggagcagggcgagttgcagggccggctggcagagagggagtctcaggagcaggggctgcggcagaggctgctggacgagcagttcgcagtgttgcggggcgctgctgccgaggccgcgggcatcctgcaggatgccgtgagcaagctggacgaccccctgcacctgcgctgtaccagctccccagactacctggtgagcagggcccaggaggccttggatgccgtgagcaccctggaggagggccacgcccagtacctgacctccttggcagacgcctccgccctggtggcagctctgacccgcttctcccacctggctgcggataccatcatcaatggcggtgccacctcgcacctggctcccaccgaccctgccgaccgcctcatagacacctgcagggagtgcggggcccgggctctggagctcatggggcagctgcaggaccagcaggctctgcggcacatgcaggccagcctggtgcggacacccctgcagggcatccttcagctgggccaggaactgaaacccaagagcctagatgtgcggcaggaggagctgggggccgtggtcgacaaggagatggcggccacatccgcagccattgaagatgctgtgcggaggattgaggacatgatgaaccaggcacgccacgccagctcgggggtgaagctggaggtgaacgagaggatcctcaactcctgcacagacctgatgaaggctatccggctcctggtgacgacatccactagcctgcagaaggagatcgtggagagcggcaggggggcagccacgcagcaggaattttacgccaagaactcgcgctggaccgaaggcctcatctcggcctccaaggctgtgggctggggagccacacagctggtggaggcagctgacaaggtggtgcttcacacgggcaagtatgaggagctcatcgtctgctcccacgagatcgcagccagcacggcccagctggtggcggcctccaaggtgaaggccaacaagcacagcccccacctgagccgcctgcaggaatgttctcgcacagtcaatgagagggctgccaatgtggtggcctccaccaagtcaggccaggagcagattgaggacagagacaccatggatttctccggcctgtccctcatcaagctgaagaagcaggagatggagacgcaggtgcgtgtcctggagctggagaagacgctggaggctgaacgcatgcggctgggggagttgcggaagcaacactacgtgctggctggggcatcaggcagccctggagaggaggtggccatccggcccagcactgccccccgaagtgtaaccaccaagaaaccacccctggcccagaagcccagcgtggcccccagacaggaccaccagcttgacaaaaaggatggcatctacccagctcaactcgtgaactactaggccccccaggggtccagcagggtggctggtgacaggcctgggcctctgcaactgccctgacaggaccgagaggccttgcccctccacctggtgcccaagcctcccgccccaccgtctggatcaatgtcctcaaggcccctggcccttactgagcctgcagggtcctgggccatgtgggtggtgcttctggatgtgagtctcttatttatctgcagaaggaactttggggtgcagccaggacccggtaggcctgagcctcaactcttcagaaaatagtgtttttaatattcctcttcagaaaatagtgtttttaatattccgagctagagctcttcttcctacgtttgtagtcagcacactgggaaaccgggccagcgtggggctccctgccttctggactcctgaaggtcgtggatggatggaaggcacacagcccgtgccggctgatgggacgagggtcaggcatcctgtctgtggccttctggggcaccgattctaccaggccctccagctgcgtggtctccgcagaccaggctctgtgtgggctagaggaatgtcgcccattactcctcaggcctggccctcgggcctccgtgatgggagccccccaggaggggtcagatgctggaaggggccgctttctggggagtgaggtgagacatagcggcccaggcgctgccttcactcctggagtttccatttccagctggaatctgcagccacccccatttcctgttttccattcccccgttctggccgcgccccactgcccacctgaaggggtggtttccagccctccggagagtgggcttggccctaggccctccagctcagccagaaaaagcccagaaacccaggtgctggaccagggccctcagggaggggaccctgcggctagagtgggctaggccctggctttgcccgtcagatttgaacgaatgtgtgtcccttgagcccaaggagagcggcaggaggggtgggaccaggctgggaggacagagccagcagctgccatgccctcctgctccccccaccccagccctagccctttagcctttcaccctgtgctctggaaaggctaccaaatactggccaaggtcaggaggagcaaaaatgagccagcaccagcgccttggctttgtgttagcatttcctcctgaagtgttctgttggcaataaaatgcactttgactgttaaaattgtcactgatg

SEQ ID NO: 61995 - DNA, 4809 bp, Homo sapiens
ggaggggcgtgccctggagttgggggcggggcgaggcgggctcctccccggcgggcgggcccgggcgcggcgcggtggcctcgcggtgcctaggctggggctgccggaccgtgaggctgtgagtcgcgcggacggagccggacaaaagcgggcggcggcggcaggatgaacagcatcaagaacgtgccggcgcgggtgctgagccgcaggccgggccacagcctggaggccgagcgcgagcagttcgacaagacccaggccatcagcatcagcaaagccatcaacacccaggaggcccccgtgaaggagaagcacgcccggcgcatcattctgggcacacaccacgagaagggggctttcaccttctggtcctatgccattgggctgccgctgcccagcagctccattctcagctggaagttctgccacgtcctccacaaggtccttcgagacgggcaccccaatgtgctgcatgactgccagcggtaccgcagcaacatccgggagattggagacctgtggggacatttgcatgaccgctacggacagctggtgaatgtctacaccaagctgctgctgaccaagatctccttccacctcaagcatccccagtttcccgcgggcctggaggtgacagatgaggtactggagaaggcagctgggaccgatgtcaacaacatcttccagctcactgtggagatgtttgattacatggattgtgagctgaagctttctgaatcagttttccgacagctcaacacggccatcgccgtatcccagatgtcctcaggccagtgccgcctggcccccctcatccaggtcatccaggactgcagccacctctaccactacacggtcaagctcctgttcaagctacactcttgtctccctgcggacaccctgcaaggccacagggaccggttccacgagcagtttcacagcctcaggaacttcttccgcagagcctccgacatgctgtacttcaagcggctcatccagatcccccggctgcccgagggaccccctaacttcctgcgggcctcagccctggctgagcacatcaagccggtggtggtgatccccgaggaggccccggaagatgaggagccggagaatctcattgagatcagcacagggccccccgcgggggagccagtggtggtggctgacctcttcgatcagacgtttggaccccccaatgggtctgtgaaggacgacagggacctccagattgagagcttgaagagagaggtggaaatgctccgctctgaactggagaagatcaagctggaggcccagcggtacatcgcgcagctgaagagccaggtgaatgcactggagggtgagctggaggagcagcggaagcagaagcagaaggccctggtggataatgagcagctccgccacgagctggcccagctgagggctgcccagctggagggcgagcggagccagggcctgcgtgaggaggctgagaggaaggccagtgccacggaggcgcgctacaacaagctgaaggaaaagcacagtgagctcgtccatgtgcacgcggagctgctcagaaagaacgcggacacagccaagcagctgacggtgacgcagcaaagccaggaggaggtggcgcgggtgaaggagcagctggccttccaggtggagcaggtgaagcgggagtcggagttgaagctagaggagaagagcgaccagctggagaagctcaagagggagctggaggccaaggccggagagctggcccgcgcgcaggaggccctgagccacacagagcagagcaagtcggagctgagctcacggctggacacgctgagtgcggagaaggatgctctgagtggagctgtgcggcagcgggaggcagacctgctggcggcgcagagcctggtgcgcgagacagaggcggcgctgagccgggagcagcagcgcagctcccaggagcagggcgagttgcagggccggctggcagagagggagtctcaggagcaggggctgcggcagaggctgctggacgagcagttcgcagtgttgcggggcgctgctgccgaggccgcgggcatcctgcaggatgccgtgagcaagctggacgaccccctgcacctgcgctgtaccagctccccagactacctggtgagcagggcccaggaggccttggatgccgtgagcaccctggaggagggccacgcccagtacctgacctccttggcagacgcctccgccctggtggcagctctgacccgcttctcccacctggctgcggataccatcatcaatggcggtgccacctcgcacctggctcccaccgaccctgccgaccgcctcatagacacctgcagggagtgcggggcccgggctctggagctcatggggcagctgcaggaccagcaggctctgcggcacatgcaggccagcctggtgcggacacccctgcagggcatccttcagctgggccaggaactgaaacccaagagcctagatgtgcggcaggaggagctgggggccgtggtcgacaaggagatggcggccacatccgcagccattgaagatgctgtgcggaggattgaggacatgatgaaccaggcacgccacgccagctcgggggtgaagctggaggtgaacgagaggatcctcaactcctgcacagacctgatgaaggtgaggggctgtgacccgggggggtctgcacctggagggccaccagtcattgctgtcttggtctcggcaggctatccggctcctggtgacgacatccactagcctgcagaaggagatcgtggagagcggcaggggggcagccacgcagcaggaattttacgccaagaactcgcgctggaccgaaggcctcatctcggcctccaaggctgtgggctggggagccacacagctggtgtaggttgccctgggtgggggggggcagggggctgcttcctgccagttggagcagtttggggttcaacagggtgcagggagtagagggggtgtggagtggtgccagccgtccgtggggtcagagaccctggccctgactggcccttgacccgcagggaggcagctgacaaggtggtgcttcacacgggcaagtatgaggagctcatcgtctgctcccacgagatcgcagccagcacggcccagctggtggcggcctccaaggtgaaggccaacaagcacagcccccacctgagccgcctgcaggaatgttctcgcacagtcaatgagagggctgccaatgtggtggcctccaccaagtcaggccaggagcagattgaggacagagacaccatggatttctccggcctgtccctcatcaagctgaagaagcaggagatggagacgcaggtgcgtgtcctggagctggagaagacgctggaggctgaacgcatgcggctgggggagttgcggaagcaacactacgtgctggctggggcatcaggcagccctggagaggaggtggccatccggcccagcactgccccccgaagtgtaaccaccaagaaaccacccctggcccagaagcccagcgtggcccccagacaggaccaccagcttgacaaaaaggatggcatctacccagctcaactcgtgaactactaggccccccaggggtccagcagggtggctggtgacaggcctgggcctctgcaactgccctgacaggaccgagaggccttgcccctccacctggtgcccaagcctcccgccccaccgtctggatcaatgtcctcaaggcccctggcccttactgagcctgcagggtcctgggccatgtgggtggtgcttctggatgtgagtctcttatttatctgcagaaggaactttggggtgcagccaggacccggtaggcctgagcctcaactcttcagaaaatagtgtttttaatattcctcttcagaaaatagtgtttttaatattccgagctagagctcttcttcctacgtttgtagtcagcacactgggaaaccgggccagcgtggggctccctgccttctggactcctgaaggtcgtggatggatggaaggcacacagcccgtgccggctgatgggacgagggtcaggcatcctgtctgtggccttctggggcaccgattctaccaggccctccagctgcgtggtctccgcagaccaggctctgtgtgggctagaggaatgtcgcccattactcctcaggcctggccctcgggcctccgtgatgggagccccccaggaggggtcagatgctggaaggggccgctttctggggagtgaggtgagacatagcggcccaggcgctgccttcactcctggagtttccatttccagctggaatctgcagccacccccatttcctgttttccattcccccgttctggccgcgccccactgcccacctgaaggggtggtttccagccctccggagagtgggcttggccctaggccctccagctcagccagaaaaagcccagaaacccaggtgctggaccagggccctcagggaggggaccctgcggctagagtgggctaggccctggctttgcccgtcagatttgaacgaatgtgtgtcccttgagcccaaggagagcggcaggaggggtgggaccaggctgggaggacagagccagcagctgccatgccctcctgctccccccaccccagccctagccctttagcctttcaccctgtgctctggaaaggctaccaaatactggccaaggtcaggaggagcaaaaatgagccagcaccagcgccttggctttgtgttagcatttcctcctgaagtgttctgttggcaataaaatgcactttgactgttaaaattgtcactgatg

SEQ ID NO: 61996 - DNA, 1965 bp, Homo sapiens
gtgaacgagaggatcctcaactcctgcacagacctgatgaaggctatccggctcctggtgacgacatccactagcctgcagaaggagatcgtggagagcggcaggggggcagccacgcagcaggaattttacgccaagaactcgcgctggaccgaaggcctcatctcggcctccaaggctgtgggctggggagccacacagctggtggaggcagctgacaaggtggtgcttcacacgggcaagtatgaggagctcatcgtctgctcccacgagatcgcagccagcacggcccagctggtggcggcctccaaggtgaaggccaacaagcacagcccccacctgagccgcctgcaggaatgttctcgcacagtcaatgagagggctgccaatgtggtggcctccaccaagtcaggccaggagcagattgaggacagagacaccatggatttctccggcctgtccctcatcaagctgaagaagcaggagatggagacgcaggtgcgtgtcctggagctggagaagacgctggaggctgaacgcatgcggctgggggagttgcggaagcaacactacgtgctggctggggcatcaggcagccctggagaggaggtggccatccggcccagcactgccccccgaagtgtaaccaccaagaaaccacccctggcccagaagcccagcgtggcccccagacaggaccaccagcttgacaaaaaggatggcatctacccagctcaactcgtgaactactaggccccccaggggtccagcagggtggctggtgacaggcctgggcctctgcaactgccctgacaggaccgagaggccttgcccctccacctggtgcccaagcctcccgccccaccgtctggatcaatgtcctcaaggcccctggcccttactgagcctgcagggtcctgggccatgtgggtggtgcttctggatgtgagtctcttatttatctgcagaaggaactttggggtgcagccaggacccggtaggcctgagcctcaactcttcagaaaatagtgtttttaatattcctcttcagaaaatagtgtttttaatattccgagctagagctcttcttcctacgtttgtagtcagcacactgggaaaccgggccagcgtggggctccctgccttctggactcctgaaggtcgtggatggatggaaggcacacagcccgtgccggctgatgggacgagggtcaggcatcctgtctgtggccttctggggcaccgattctaccaggccctccagctgcgtggtctccgcagaccaggctctgtgtgggctagaggaatgtcgcccattactcctcaggcctggccctcgggcctccgtgatgggagccccccaggaggggtcagatgctggaaggggccgctttctggggagtgaggtgagacatagcggcccaggcgctgccttcactcctggagtttccatttccagctggaatctgcagccacccccatttcctgttttccattcccccgttctggccgcgccccactgcccacctgaaggggtggtttccagccctccggagagtgggcttggccctaggccctccagctcagccagaaaaagcccagaaacccaggtgctggaccagggccctcagggaggggaccctgcggctagagtgggctaggccctggctttgcccgtcagatttgaacgaatgtgtgtcccttgagcccaaggagagcggcaggaggggtgggaccaggctgggaggacagagccagcagctgccatgccctcctgctccccccaccccagccctagccctttagcctttcaccctgtgctctggaaaggctaccaaatactggccaaggtcaggaggagcaaaaatgagccagcaccagcgccttggctttgtgttagcatttcctcctgaagtgttctgttggcaataaaatgcactttgactgttaaaattgtcactgatg

SEQ ID NO: 61997 - DNA, 1803 bp, Homo sapiens
cggacgcgtgggtcgacccacgcgttcggagccacacagctggtggaggcagctgacaaggtggtgcttcacacgggcaagtatgaggagctcatcgtctgctcccacgagatcgcagccagcacggcccagctggtggcggcctccaaggtgaaggccaacaagcacagcccccacctgagccgcctgcaggaatgttctcgcacagtcaatgagagggctgccaatgtggtggcctccaccaagtcaggccaggagcagattgaggacagagacaccatggatttctccggcctgtccctcatcaagctgaagaagcaggagatggagacgcaggtgcgtgtcctggagctggagaagacgctggaggctgaacgcatgcggctgggggagttgcggaagcaacactacgtgctggctggggcatcaggcagccctggagaggaggtggccatccggcccagcactgccccccgaagtgtaaccaccaagaaaccacccctggcccagaagcccagcgtggcccccagacaggaccaccagcttgacaaaaaggatggcatctacccagctcaactcgtgaactactaggccccccaggggtccagcagggtggctggtgacaggcctgggcctctgcaactgccctgacaggaccgagaggccttgcccctccacctggtgcccaagcctcccgccccaccgtctggatcaatgtcctcaaggcccctggcccttactgagcctgcagggtcctgggccatgtgggtggtgcttctggatgtgagtctcttatttatctgcagaaggaactttggggtgcagccaggacccggtaggcctgagcctcaactcttcagaaaatagtgtttttaatattcctcttcagaaaatagtgtttttaatattccgagctagagctcttcttcctacgtttgtagtcagcacactgggaaaccgggccagcgtggggctccctgccttctggactcctgaaggtcgtggatggatggaaggcacacagcccgtgccggctgatgggacgagggtcaggcatcctgtctgtggccttctggggcaccgattctaccaggccctccagctgcgtggtctccgcagaccaggctctgtgtgggctagaggaatgtcgcccattactcctcaggcctggccctcgggcctccgtgatgggagccccccaggaggggtcagatgctggaaggggccgctttctggggagtgaggtgagacatagcggcccaggcgctgccttcactcctggagtttccatttccagctggaatctgcagccacccccatttcctgttttccattcccccgttctggccgcgccccactgcccacctgaaggggtggtttccagccctccggagagtgggcttggccctaggccctccagctcagccagaaaaagcccagaaacccaggtgctggaccagggccctcagggaggggaccctgcggctagagtgggctaggccctggctttgcccgtcagatttgaacgaatgtgtgtcccttgagcccaaggagagcggcaggaggggtgggaccaggctgggaggacagagccagcagctgccatgccctcctgctccccccaccccagccctagccctttagcctttcaccctgtgctctggaaaggctaccaaatactggccaaggtcaggaggagcaaaaatgagccagcaccagcgccttggctttgtgttagcatttcctcctgaagtgttctgttggcaataaaatgcactttgactgttaaaattgtcactgatg

SEQ ID NO: 61998 - DNA, 2805 bp, Homo sapiens
ggaggggcgtgccctggagttgggggcggggcgaggcgggctcctccccggcgggcgggcccgggcgcggcgcggtggcctcgcggtgcctaggctggggctgccggaccgtgaggctgtgagtcgcgcggacggagccggacaaaagcgggcggcggcggcaggatgaacagcatcaagaacgtgccggcgcgggtgctgagccgcaggccgggccacagcctggaggccgagcgcgagcagttcgacaagacccaggccatcagcatcagcaaagccatcaacacccaggaggcccccgtgaaggagaagcacgcccggcgcatcattctgggcacacaccacgagaagggggctttcaccttctggtcctatgccattgggctgccgctgcccagcagctccattctcagctggaagttctgccacgtcctccacaaggtccttcgagacgggcaccccaatgtgctgcatgactgccagcggtaccgcagcaacatccgggagattggagacctgtggggacatttgcatgaccgctacggacagctggtgaatgtctacaccaagctgctgctgaccaagatctccttccacctcaagcatccccagtttcccgcgggcctggaggtgacagatgaggtactggagaaggcagctgggaccgatgtcaacaacatcttccagctcactgtggagatgtttgattacatggattgtgagctgaagctttctgaatcagttttccgacagctcaacacggccatcgccgtatcccagatgtcctcaggccagtgccgcctggcccccctcatccaggtcatccaggactgcagccacctctaccactacacggtcaagctcctgttcaagctacactcttgtctccctgcggacaccctgcaaggccacagggaccggttccacgagcagtttcacagcctcaggaacttcttccgcagagcctccgacatgctgtacttcaagcggctcatccagatcccccggctgcccgagggaccccctaacttcctgcgggcctcagccctggctgagcacatcaagccggtggtggtgatccccgaggaggccccggaagatgaggagccggagaatctcattgagatcagcacagggccccccgcgggggagccagtggtggtggctgacctcttcgatcagacgtttggaccccccaatgggtctgtgaaggacgacagggacctccagattgagagcttgaagagagaggtggaaatgctccgctctgaactggagaagatcaagctggaggcccagcggtacatcgcgcagctgaagagccaggtgaatgcactggagggtgagctggaggagcagcggaagcagaagcagaaggccctggtggataatgagcagctccgccacgagctggcccagctgagggctgcccagctggagggcgagcggagccagggcctgcgtgaggaggctgagaggaaggccagtgccacggaggcgcgctacaacaagctgaaggaaaagcacagtgagctcgtccatgtgcacgcggagctgctcagaaagaacgcggacacagccaagcagctgacggtgacgcagcaaagccaggaggaggtggcgcgggtgaaggagcagctggccttccaggtggagcaggtgaagcgggagtcggagttgaagctagaggagaagagcgaccagctggagaagctcaagagggagctggaggccaaggccggagagctggcccgcgcgcaggaggccctgagccacacagagcagagcaagtcggagctgagctcacggctggacacgctgagtgcggagaaggatgctctgagtggagctgtgcggcagcgggaggcagacctgctggcggcgcagagcctggtgcgcgagacagaggcggcgctgagccgggagcagcagcgcagctcccaggagcagggcgagttgcagggccggctggcagagagggagtctcaggagcaggggctgcggcagaggctgctggacgagcagttcgcagtgttgcggggcgctgctgccgaggccgcgggcatcctgcaggatgccgtgagcaagctggacgaccccctgcacctgcgctgtaccagctccccagactacctggtgagcagggcccaggaggccttggatgccgtgagcaccctggaggagggccacgcccagtacctgacctccttggcagacgcctccgccctggtggcagctctgacccgcttctcccacctggctgcggataccatcatcaatggcggtgccacctcgcacctggctcccaccgaccctgccgaccgcctcatagacacctgcagggagtgcggggcccgggctctggagctcatggggcagctgcaggaccagcaggctctgcggcacatgcaggccagcctggtgcggacacccctgcagggcatccttcagctgggccaggaactgaaacccaagagcctagatgtgcggcaggaggagctgggggccgtggtcgacaaggagatggcggccacatccgcagccattgaagatgctgtgcggaggattgaggacatgatgaaccaggcacgccacgccagctcgggggtgaagctggaggtgaacgagaggatcctcaactcctgcacagacctgatgaaggctatccggctcctggtgacgacatccactagcctgcagaaggagatcgtggagagcggcaggggggcagccacgcagcaggaattttacgccaagaactcgcgctggaccgaaggtcaaccctcacccgaaggtcaaccctca

SEQ ID NO: 61999 - DNA, 1316 bp, Homo sapiens
ggaggggcgtgccctggagttgggggcggggcgaggcgggctcctccccggcgggcgggcccgggcgcggcgcggtggcctcgcggtgcctaggctggggctgccggaccgtgaggctgtgagtcgcgcggacggagccggacaaaagcgggcggcggcggcaggatgaacagcatcaagaacgtgccggcgcgggtgctgagccgcaggccgggccacagcctggaggccgagcgcgagcagttcgacaagacccaggccatcagcatcagcaaagccatcaacacccaggaggcccccgtgaaggagaagcacgcccggcgcatcattctgggcacacaccacgagaagggggctttcaccttctggtcctatgccattgggctgccgctgcccagcagctccattctcagctggaagttctgccacgtcctccacaaggtccttcgagacgggcaccccaatgtgctgcatgactgccagcggtaccgcagcaacatccgggagattggagacctgtggggacatttgcatgaccgctacggacagctggtgaatgtctacaccaagctgctgctgaccaagatctccttccacctcaagcatccccagtttcccgcgggcctggaggtgacagatgaggtactggagaaggcagctgggaccgatgtcaacaacatcttccagctcactgtggagatgtttgattacatggattgtgagctgaagctttctgaatcaggtgagccctaaagaggggatgcgggggtctgagtgtattgctaagtcccccgagatgggacgagaagaaaaaagaagacatgagtgatcagacccactgatcactatgaaatgaccctggcccgcccccgtggctcacatctgtaatcccagcattttgggaggccgaggcaggcagattgcttgaggtcaagggttcaagaccagcctggcccacatggtgaaaccctgtctctactaaaaaaatataaaaattagcccggcgtggtggcgcacgcctgtattcccagctacttgggaggctgaggcacggagaatcacttgaacctgggcggcggagatcatgccgctacactccagcctgggccacagagtgagtctccgtcttaaaaaaaaaaaaagaaagaaaaagaaatgcccctgcccctcctggggtcactgcacctccagggataggtaatggggcctcctggcccctccaaagcatggcaggccccagcgggtacatccaggatacaggttcagccatctcttccatccagtgagcgagcaccaccaattcagccccaagacag

SEQ ID NO: 62000 - DNA, 828 bp, Homo sapiens
ggaggggcgtgccctggagttgggggcggggcgaggcgggctcctccccggcgggcgggcccgggcgcggcgcggtggcctcgcggtgcctaggctggggctgccggaccgtgaggctgtgagtcgcgcggacggagccggacaaaagcgggcggcggcggcaggatgaacagcatcaagaacgtgccggcgcgggtgctgagccgcaggccgggccacagcctggaggccgagcgcgagcagttcgacaagacccaggccatcagcatcagcaaagccatcaacacccaggaggcccccgtgaaggagaagcacgcccggcgcatcattctgggcacacaccacgagaagggggctttcaccttctggtcctatgccattgggctgccgctgcccagcagctccattctcagctggaagttctgccacgtcctccacaaggtccttcgagacgggcaccccaatgtgctgcatgactgccagcggtaccgcagcaacatccgggagattggagacctgtggggacatttgcatgaccgctacggacagctggtgaatgtctacaccaagctgctgctgaccaagatctccttccacctcaagcatccccagtttcccgcgggcctggaggtgacagatgaggtactggagaaggcagctgggaccgatgtcaacaacatcttccagctcactgtggagatgtttgattacatggattgtgagctgaagctttctgaatcaggctctctcctgtcactgcagagatttgcaagtggtcccatcacaggcaaggcaggagcaggacctgaggggccagggcacaggtct

SEQ ID NO: 62001 - DNA, 3961 bp, Homo sapiens
gcagggggcacactggtgtgtgggagctggcttagggccctgcttcacagttggaccaccttggacaggttgcccagctcccaagggctcacgttcttcctcctgccccttttgcacagttttccgacagctcaacacggccatcgccgtatcccagatgtcctcaggccagtgccgcctggcccccctcatccaggtcatccaggactgcagccacctctaccactacacggtcaagctcctgttcaagctacactcttgtctccctgcggacaccctgcaaggccacagggaccggttccacgagcagtttcacagcctcaggaacttcttccgcagagcctccgacatgctgtacttcaagcggctcatccagatcccccggctgcccgagggaccccctaacttcctgcgggcctcagccctggctgagcacatcaagccggtggtggtgatccccgaggaggccccggaagatgaggagccggagaatctcattgagatcagcacagggccccccgcgggggagccagtggtggtggctgacctcttcgatcagacgtttggaccccccaatgggtctgtgaaggacgacagggacctccagattgagagcttgaagagagaggtggaaatgctccgctctgaactggagaagatcaagctggaggcccagcggtacatcgcgcagctgaagagccaggtgaatgcactggagggtgagctggaggagcagcggaagcagaagcagaaggccctggtggataatgagcagctccgccacgagctggcccagctgagggctgcccagctggagggcgagcggagccagggcctgcgtgaggaggctgagaggaaggccagtgccacggaggcgcgctacaacaagctgaaggaaaagcacagtgagctcgtccatgtgcacgcggagctgctcagaaagaacgcggacacagccaagcagctgacggtgacgcagcaaagccaggaggaggtggcgcgggtgaaggagcagctggccttccaggtggagcaggtgaagcgggagtcggagttgaagctagaggagaagagcgaccagctggagaagctcaagagggagctggaggccaaggccggagagctggcccgcgcgcaggaggccctgagccacacagagcagagcaagtcggagctgagctcacggctggacacgctgagtgcggagaaggatgctctgagtggagctgtgcggcagcgggaggcagacctgctggcggcgcagagcctggtgcgcgagacagaggcggcgctgagccgggagcagcagcgcagctcccaggagcagggcgagttgcagggccggctggcagagagggagtctcaggagcaggggctgcggcagaggctgctggacgagcagttcgcagtgttgcggggcgctgctgccgaggccgcgggcatcctgcaggatgccgtgagcaagctggacgaccccctgcacctgcgctgtaccagctccccagactacctggtgagcagggcccaggaggccttggatgccgtgagcaccctggaggagggccacgcccagtacctgacctccttggcagacgcctccgccctggtggcagctctgacccgcttctcccacctggctgcggataccatcatcaatggcggtgccacctcgcacctggctcccaccgaccctgccgaccgcctcatagacacctgcagggagtgcggggcccgggctctggagctcatggggcagctgcaggaccagcaggctctgcggcacatgcaggccagcctggtgcggacacccctgcagggcatccttcagctgggccaggaactgaaacccaagagcctagatgtgcggcaggaggagctgggggccgtggtcgacaaggagatggcggccacatccgcagccattgaagatgctgtgcggaggattgaggacatgatgaaccaggcacgccacgccagctcgggggtgaagctggaggtgaacgagaggatcctcaactcctgcacagacctgatgaaggctatccggctcctggtgacgacatccactagcctgcagaaggagatcgtggagagcggcaggggggcagccacgcagcaggaattttacgccaagaactcgcgctggaccgaaggcctcatctcggcctccaaggctgtgggctggggagccacacagctggtggaggcagctgacaaggtggtgcttcacacgggcaagtatgaggagctcatcgtctgctcccacgagatcgcagccagcacggcccagctggtggcggcctccaaggtgaaggccaacaagcacagcccccacctgagccgcctgcaggaatgttctcgcacagtcaatgagagggctgccaatgtggtggcctccaccaagtcaggccaggagcagattgaggacagagacaccatggatttctccggcctgtccctcatcaagctgaagaagcaggagatggagacgcaggtgcgtgtcctggagctggagaagacgctggaggctgaacgcatgcggctgggggagttgcggaagcaacactacgtgctggctggggcatcaggcagccctggagaggaggtggccatccggcccagcactgccccccgaagtgtaaccaccaagaaaccacccctggcccagaagcccagcgtggcccccagacaggaccaccagcttgacaaaaaggatggcatctacccagctcaactcgtgaactactaggccccccaggggtccagcagggtggctggtgacaggcctgggcctctgcaactgccctgacaggaccgagaggccttgcccctccacctggtgcccaagcctcccgccccaccgtctggatcaatgtcctcaaggcccctggcccttactgagcctgcagggtcctgggccatgtgggtggtgcttctggatgtgagtctcttatttatctgcagaaggaactttggggtgcagccaggacccggtaggcctgagcctcaactcttcagaaaatagtgtttttaatattcctcttcagaaaatagtgtttttaatattccgagctagagctcttcttcctacgtttgtagtcagcacactgggaaaccgggccagcgtggggctccctgccttctggactcctgaaggtcgtggatggatggaaggcacacagcccgtgccggctgatgggacgagggtcaggcatcctgtctgtggccttctggggcaccgattctaccaggccctccagctgcgtggtctccgcagaccaggctctgtgtgggctagaggaatgtcgcccattactcctcaggcctggccctcgggcctccgtgatgggagccccccaggaggggtcagatgctggaaggggccgctttctggggagtgaggtgagacatagcggcccaggcgctgccttcactcctggagtttccatttccagctggaatctgcagccacccccatttcctgttttccattcccccgttctggccgcgccccactgcccacctgaaggggtggtttccagccctccggagagtgggcttggccctaggccctccagctcagccagaaaaagcccagaaacccaggtgctggaccagggccctcagggaggggaccctgcggctagagtgggctaggccctggctttgcccgtcagatttgaacgaatgtgtgtcccttgagcccaaggagagcggcaggaggggtgggaccaggctgggaggacagagccagcagctgccatgccctcctgctccccccaccccagccctagccctttagcctttcaccctgtgctctggaaaggctaccaaatactggccaaggtcaggaggagcaaaaatgagccagcaccagcgccttggctttgtgttagcatttcctcctgaagtgttctgttggcaataaaatgcactttgactgttaaaattgtcactgatg

SEQ ID NO: 62002 - DNA, 4654 bp, Homo sapiens
ggaggggcgtgccctggagttgggggcggggcgaggcgggctcctccccggcgggcgggcccgggcgcggcgcggtggcctcgcggtgcctaggctggggctgccggaccgtgaggctgtgagtcgcgcggacggagccggacaaaagcgggcggcggcggcaggatgaacagcatcaagaacgtgccggcgcgggtgctgagccgcaggccgggccacagcctggaggccgagcgcgagcagttcgacaagacccaggccatcagcatcagcaaagccatcaacacccaggaggcccccgtgaaggagaagcacgcccggcgcatcattctgggcacacaccacgagaagggggctttcaccttctggtcctatgccattgggctgccgctgcccagcagctccattctcagctggaagttctgccacgtcctccacaaggtccttcgagacgggcaccccaatgtgctgcatgactgccagcggtaccgcagcaacatccgggagattggagacctgtggggacatttgcatgaccgctacggacagctggtgaatgtctacaccaagctgctgctgaccaagatctccttccacctcaagcatccccagtttcccgcgggcctggaggtgacagatgaggtactggagaaggcagctgggaccgatgtcaacaacatcttccagctcactgtggagatgtttgattacatggattgtgagctgaagctttctgaatcagttttccgacagctcaacacggccatcgccgtatcccagatgtcctcaggccagtgccgcctggcccccctcatccaggtcatccaggactgcagccacctctaccactacacggtcaagctcctgttcaagctacactcttgtctccctgcggacaccctgcaaggccacagggaccggttccacgagcagtttcacagcctcaggaacttcttccgcagagcctccgacatgctgtacttcaagcggctcatccagatcccccggctgcccgagggaccccctaacttcctgcgggcctcagccctggctgagcacatcaagccggtggtggtgatccccgaggaggccccggaagatgaggagccggagaatctcattgagatcagcacagggccccccgcgggggagccagtggtggtggctgacctcttcgatcagacgtttggaccccccaatgggtctgtgaaggacgacagggacctccagattgagagcttgaagagagaggtggaaatgctccgctctgaactggagaagatcaagctggaggcccagcggtacatcgcgcagctgaagagccaggtgaatgcactggagggtgagctggaggagcagcggaagcagaagcagaaggccctggtggataatgagcagctccgccacgagctggcccagctgagggctgcccagctggagggcgagcggagccagggcctgcgtgaggaggctgagaggaaggccagtgccacggaggcgcgctacaacaagctgaaggaaaagcacagtgagctcgtccatgtgcacgcggagctgctcagaaagaacgcggacacagccaagcagctgacggtgacgcagcaaagccaggaggaggtggcgcgggtgaaggagcagctggccttccaggtggagcaggtgaagcgggagtcggagttgaagctagaggagaagagcgaccagctggagaagctcaagagggagctggaggccaaggccggagagctggcccgcgcgcaggaggccctgagccacacagagcagagcaagtcggagctgagctcacggctggacacgctgagtgcggagaaggatgctctgagtggagctgtgcggcagcgggaggcagacctgctggcggcgcagagcctggtgcgcgagacagaggcggcgctgagccgggagcagcagcgcagctcccaggagcagggcgagttgcagggccggctggcagagagggagtctcaggagcaggggctgcggcagaggctgctggacgagcagttcgcagtgttgcggggcgctgctgccgaggccgcgggcatcctgcaggatgccgtgagcaagctggacgaccccctgcacctgcgctgtaccagctccccagactacctggtgagcagggcccaggaggccttggatgccgtgagcaccctggaggagggccacgcccagtacctgacctccttggcagacgcctccgccctggtggcagctctgacccgcttctcccacctggctgcggataccatcatcaatggcggtgccacctcgcacctggctcccaccgaccctgccgaccgcctcatagacacctgcagggagtgcggggcccgggctctggagctcatggggcagctgcaggaccagcaggctctgcggcacatgcaggccagcctggtgcggacacccctgcagggcatccttcagctgggccaggaactgaaacccaagagcctagatgtgcggcaggaggagctgggggccgtggtcgacaaggagatggcggccacatccgcagccattgaagatgctgtgcggaggattgaggacatgatgaaccaggcacgccacgccagctcgggggtgaagctggaggtgaacgagaggatcctcaactcctgcacagacctgatgaaggtgaggggctgtgacccgggggggtctgcacctggagggccaccagtcattgctgtcttggtctcggcaggctatccggctcctggtgacgacatccactagcctgcagaaggagatcgtggagagcggcaggggggcagccacgcagcaggaattttacgccaagaactcgcgctggaccgaaggcctcatctcggcctccaaggctgtgggctggggagccacacagctggtggaggcagctgacaaggtggtgcttcacacgggcaagtatgaggagctcatcgtctgctcccacgagatcgcagccagcacggcccagctggtggcggcctccaaggtgaaggccaacaagcacagcccccacctgagccgcctgcaggaatgttctcgcacagtcaatgagagggctgccaatgtggtggcctccaccaagtcaggccaggagcagattgaggacagagacaccatggatttctccggcctgtccctcatcaagctgaagaagcaggagatggagacgcaggtgcgtgtcctggagctggagaagacgctggaggctgaacgcatgcggctgggggagttgcggaagcaacactacgtgctggctggggcatcaggcagccctggagaggaggtggccatccggcccagcactgccccccgaagtgtaaccaccaagaaaccacccctggcccagaagcccagcgtggcccccagacaggaccaccagcttgacaaaaaggatggcatctacccagctcaactcgtgaactactaggccccccaggggtccagcagggtggctggtgacaggcctgggcctctgcaactgccctgacaggaccgagaggccttgcccctccacctggtgcccaagcctcccgccccaccgtctggatcaatgtcctcaaggcccctggcccttactgagcctgcagggtcctgggccatgtgggtggtgcttctggatgtgagtctcttatttatctgcagaaggaactttggggtgcagccaggacccggtaggcctgagcctcaactcttcagaaaatagtgtttttaatattcctcttcagaaaatagtgtttttaatattccgagctagagctcttcttcctacgtttgtagtcagcacactgggaaaccgggccagcgtggggctccctgccttctggactcctgaaggtcgtggatggatggaaggcacacagcccgtgccggctgatgggacgagggtcaggcatcctgtctgtggccttctggggcaccgattctaccaggccctccagctgcgtggtctccgcagaccaggctctgtgtgggctagaggaatgtcgcccattactcctcaggcctggccctcgggcctccgtgatgggagccccccaggaggggtcagatgctggaaggggccgctttctggggagtgaggtgagacatagcggcccaggcgctgccttcactcctggagtttccatttccagctggaatctgcagccacccccatttcctgttttccattcccccgttctggccgcgccccactgcccacctgaaggggtggtttccagccctccggagagtgggcttggccctaggccctccagctcagccagaaaaagcccagaaacccaggtgctggaccagggccctcagggaggggaccctgcggctagagtgggctaggccctggctttgcccgtcagatttgaacgaatgtgtgtcccttgagcccaaggagagcggcaggaggggtgggaccaggctgggaggacagagccagcagctgccatgccctcctgctccccccaccccagccctagccctttagcctttcaccctgtgctctggaaaggctaccaaatactggccaaggtcaggaggagcaaaaatgagccagcaccagcgccttggctttgtgttagcatttcctcctgaagtgttctgttggcaataaaatgcactttgactgttaaaattgtcactgatg

SEQ ID NO: 62003 - DNA, 4478 bp, Homo sapiens
ggaggggcgtgccctggagttgggggcggggcgaggcgggctcctccccggcgggcgggcccgggcgcggcgcggtggcctcgcggtgcctaggctggggctgccggaccgtgaggctgtgagtcgcgcggacggagccggacaaaagcgggcggcggcggcaggatgaacagcatcaagaacgtgccggcgcgggtgctgagccgcaggccgggccacagcctggaggccgagcgcgagcagttcgacaagacccaggccatcagcatcagcaaagccatcaacacccaggaggcccccgtgaaggagaagcacgcccggcgcatcattctgggcacacaccacgagaagggggctttcaccttctggtcctatgccattgggctgccgctgcccagcagctccattctcagctggaagttctgccacgtcctccacaaggtccttcgagacgggcaccccaatgtgctgcatgactgccagcggtaccgcagcaacatccgggagattggagacctgtggggacatttgcatgaccgctacggacagctggtgaatgtctacaccaagctgctgctgaccaagatctccttccacctcaagcatccccagtttcccgcgggcctggaggtgacagatgaggtactggagaaggcagctgggaccgatgtcaacaacatcttccagctcactgtggagatgtttgattacatggattgtgagctgaagctttctgaatcagttttccgacagctcaacacggccatcgccgtatcccagatgtcctcaggccagtgccgcctggcccccctcatccaggtcatccaggactgcagccacctctaccactacacggtcaagctcctgttcaagctacactcttgtctccctgcggacaccctgcaaggccacagggaccggttccacgagcagtttcacagcctcaggaacttcttccgcagagcctccgacatgctgtacttcaagcggctcatccagatcccccggctgcccgagggaccccctaacttcctgcgggcctcagccctggctgagcacatcaagccggtggtggtgatccccgaggaggccccggaagatgaggagccggagaatctcattgagatcagcacagggccccccgcgggggagccagtggtggtggctgacctcttcgatcagacgtttggaccccccaatgggtctgtgaaggacgacagggacctccagattgagagcttgaagagagaggtggaaatgctccgctctgaactggagaagatcaagctggaggcccagcggtacatcgcgcagctgaagagccaggtgaatgcactggagggtgagctggaggagcagcggaagcagaagcagaaggccctggtggataatgagcagctccgccacgagctggcccagctgagggctgcccagctggagggcgagcggagccagggcctgcgtgaggaggctgagaggaaggccagtgccacggaggcgcgctacaacaagctgaaggaaaagcacagtgagctcgtccatgtgcacgcggagctgctcagaaagaacgcggacacagccaagcagctgacggtgacgcagcaaagccaggaggaggtggcgcgggtgaaggagcagctggccttccaggtggagcaggtgaagcgggagtcggagttgaagctagaggagaagagcgaccagctggagaagctcaagagggagctggaggccaaggccggagagctggcccgcgcgcaggaggccctgagccacacagagcagagcaagtcggagctgagctcacggctggacacgctgagtgcggagaaggatgctctgagtggagctgtgcggcagcgggaggcagacctgctggcggcgcagagcctggtgcgcgagacagaggcggcgctgagccgggagcagcagcgcagctcccaggagcagggcgagttgcagggccggctggcagagagggagtctcaggagcaggggctgcggcagaggctgctggacgagcagttcgcagtgttgcggggcgctgctgccgaggccgcgggcatcctgcaggatgccgtgagcaagctggacgaccccctgcacctgcgctgtaccagctccccagactacctggtgagcagggcccaggaggccttggatgccgtgagcaccctggaggagggccacgcccagtacctgacctccttggcagacgcctccgccctggtggcagctctgacccgcttctcccacctggctgcggataccatcatcaatggcggtgccacctcgcacctggctcccaccgaccctgccgaccgcctcatagacacctgcagggagtgcggggcccgggctctggagctcatggggcagctgcaggaccagcaggctctgcggcacatgcaggccagcctggtgcggacacccctgcagggcatccttcagctgggccaggaactgaaacccaagagcctagatgtgcggcaggaggagctgggggccgtggtcgacaaggagatggcggccacatccgcagccattgaagatgctgtgcggaggattgaggacatgatgaaccaggcacgccacgccagctcgggggtgaagctggaggtgaacgagaggatcctcaactcctgcacagacctgatgaaggctatccggctcctggtgacgacatccactagcctgcagaaggagatcgtggagagcggcaggggggcagccacgcagcaggaattttacgccaagaactcgcgctggaccgaaggcctcatctcggcctccaaggctgtgggctggggagccacacagctggtggaggcagctgacaaggtggtgcttcacacgggcaagtatgaggagctcatcgtctgctcccacgagatcgcagccagcacggcccagctggtggcggcctccaaggtgaaggccaacaagcacagcccccacctgagccgcctgcaggaatgttctcgcacagtcaatgagagggctgccaatgtggtggcctccaccaagtcaggccaggagcagattgaggacagagacaccatggatttctccggcctgtccctcatcaagctgaagaagcaggagatggagacgcaggtgcgtgtcctggagctggagaagacgctggaggctgaacgcatgcggctgggggagttgcggaagcaacactacgtgctggctggggcatcaggcagccctggagaggaggtggccatccggcccagcactgccccccgaagtgtaaccaccaagaaaccacccctggcccagaagcccagcgtggcccccagacaggaccaccagcttgacaaaaaggatggcatctacccagctcaactcgtgaactactaggccccccaggggtccagcagggtggctggtgacaggcctgggcctctgcaactgccctgacaggaccgagaggccttgcccctccacctggtgcccaagcctcccgccccaccgtctggatcaatgtcctcaaggcccctggcccttactgagcctgcagggtcctgggccatgtgggtggtgcttctggatgtgagtctcttatttatctgcagaaggaactttggggtgcagccaggacccgtcagcacactgggaaaccgggccagcgtggggctccctgccttctggactcctgaaggtcgtggatggatggaaggcacacagcccgtgccggctgatgggacgagggtcaggcatcctgtctgtggccttctggggcaccgattctaccaggccctccagctgcgtggtctccgcagaccaggctctgtgtgggctagaggaatgtcgcccattactcctcaggcctggccctcgggcctccgtgatgggagccccccaggaggggtcagatgctggaaggggccgctttctggggagtgaggtgagacatagcggcccaggcgctgccttcactcctggagtttccatttccagctggaatctgcagccacccccatttcctgttttccattcccccgttctggccgcgccccactgcccacctgaaggggtggtttccagccctccggagagtgggcttggccctaggccctccagctcagccagaaaaagcccagaaacccaggtgctggaccagggccctcagggaggggaccctgcggctagagtgggctaggccctggctttgcccgtcagatttgaacgaatgtgtgtcccttgagcccaaggagagcggcaggaggggtgggaccaggctgggaggacagagccagcagctgccatgccctcctgctccccccaccccagccctagccctttagcctttcaccctgtgctctggaaaggctaccaaatactggccaaggtcaggaggagcaaaaatgagccagcaccagcgccttggctttgtgttagcatttcctcctgaagtgttctgttggcaataaaatgcactttgactgttaaaattgtcactgatg

SEQ ID NO: 62004 - DNA, 4530 bp, Homo sapiens
ggaggggcgtgccctggagttgggggcggggcgaggcgggctcctccccggcgggcgggcccgggcgcggcgcggtggcctcgcggtgcctaggctggggctgccggaccgtgaggctgtgagtcgcgcggacggagccggacaaaagcgggcggcggcggcaggatgaacagcatcaagaacgtgccggcgcgggtgctgagccgcaggccgggccacagcctggaggccgagcgcgagcagttcgacaagacccaggccatcagcatcagcaaagccatcaacacccaggaggcccccgtgaaggagaagcacgcccggcgcatcattctgggcacacaccacgagaagggggctttcaccttctggtcctatgccattgggctgccgctgcccagcagctccattctcagctggaagttctgccacgtcctccacaaggtccttcgagacgggcaccccaatgtgctgcatgactgccagcggtaccgcagcaacatccgggagattggagacctgtggggacatttgcatgaccgctacggacagctggtgaatgtctacaccaagctgctgctgaccaagatctccttccacctcaagcatccccagtttcccgcgggcctggaggtgacagatgaggtactggagaaggcagctgggaccgatgtcaacaacatcttccagctcactgtggagatgtttgattacatggattgtgagctgaagctttctgaatcagttttccgacagctcaacacggccatcgccgtatcccagatgtcctcaggccagtgccgcctggcccccctcatccaggtcatccaggactgcagccacctctaccactacacggtcaagctcctgttcaagctacactcttgtctccctgcggacaccctgcaaggccacagggaccggttccacgagcagtttcacagcctcaggaacttcttccgcagagcctccgacatgctgtacttcaagcggctcatccagatcccccggctgcccgagggaccccctaacttcctgcgggcctcagccctggctgagcacatcaagccggtggtggtgatccccgaggaggccccggaagatgaggagccggagaatctcattgagatcagcacagggccccccgcgggggagccagtggtggtggctgacctcttcgatcagacgtttggaccccccaatgggtctgtgaaggacgacagggacctccagattgagagcttgaagagagaggtggaaatgctccgctctgaactggagaagatcaagctggaggcccagcggtacatcgcgcagctgaagagccaggtgaatgcactggagggtgagctggaggagcagcggaagcagaagcagaaggccctggtggataatgagcagctccgccacgagctggcccagctgagggctgcccagctggagggcgagcggagccagggcctgcgtgaggaggctgagaggaaggccagtgccacggaggcgcgctacaacaagctgaaggaaaagcacagtgagctcgtccatgtgcacgcggagctgctcagaaagaacgcggacacagccaagcagctgacggtgacgcagcaaagccaggaggaggtggcgcgggtgaaggagcagctggccttccaggtggagcaggtgaagcgggagtcggagttgaagctagaggagaagagcgaccagctggagaagctcaagagggagctggaggccaaggccggagagctggcccgcgcgcaggaggccctgagccacacagagcagagcaagtcggagctgagctcacggctggacacgctgagtgcggagaaggatgctctgagtggagctgtgcggcagcgggaggcagacctgctggcggcgcagagcctggtgcgcgagacagaggcggcgctgagccgggagcagcagcgcagctcccaggagcagggcgagttgcagggccggctggcagagagggagtctcaggagcaggggctgcggcagaggctgctggacgagcagttcgcagtgttgcggggcgctgctgccgaggccgcgggcatcctgcaggatgccgtgagcaagctggacgaccccctgcacctgcgctgtaccagctccccagactacctggtgagcagggcccaggaggccttggatgccgtgagcaccctggaggagggccacgcccagtacctgacctccttggcagacgcctccgccctggtggcagctctgacccgcttctcccacctggctgcggataccatcatcaatggcggtgccacctcgcacctggctcccaccgaccctgccgaccgcctcatagacacctgcagggagtgcggggcccgggctctggagctcatggggcagctgcaggaccagcaggctctgcggcacatgcaggccagcctggtgcggacacccctgcagggcatccttcagctgggccaggaactgaaacccaagagcctagatgtgcggcaggaggagctgggggccgtggtcgacaaggagatggcggccacatccgcagccattgaagatgctgtgcggaggattgaggacatgatgaaccaggcacgccacgccagctcgggggtgaagctggaggtgaacgagaggatcctcaactcctgcacagacctgatgaaggctatccggctcctggtgacgacatccactagcctgcagaaggagatcgtggagagcggcaggggggcagccacgcagcaggaattttacgccaagaactcgcgctggaccgaaggcctcatctcggcctccaaggctgtgggctggggagccacacagctggtggaggcagctgacaaggtggtgcttcacacgggcaagtatgaggagctcatcgtctgctcccacgagatcgcagccagcacggcccagctggtggcggcctccaaggtgaaggccaacaagcacagcccccacctgagccgcctgcaggaatgttctcgcacagtcaatgagagggctgccaatgtggtggcctccaccaagtcaggccaggagcagattgaggacagagacaccatggatttctccggcctgtccctcatcaagctgaagaagcaggagatggagacgcaggtgcgtgtcctggagctggagaagacgctggaggctgaacgcatgcggctgggggagttgcggaagcaacactacgtgctggctggggcatcaggcagccctggagaggaggtggccatccggcccagcactgccccccgaagtgtaaccaccaagaaaccacccctggcccagaagcccagcgtggcccccagacaggaccaccagcttgacaaaaaggatggcatctacccagctcaactcgtgaactactaggccccccaggggtccagcagggtggctggtgacaggcctgggcctctgcaactgccctgacaggaccgagaggccttgcccctccacctggtgcccaagcctcccgccccaccgtctggatcaatgtcctcaaggcccctggcccttactgagcctgcagggtcctgggccatgtgggtggtgcttctggatgtgagtctcttatttatctgcagaaggaactttggggtgcagccaggacccggtaggcctgagcctcaactcttcagaaaatagtgtttttaatattcctcttcagaaaatagtgtttttaatattccgagctagagctcttcttcctacgtttgtagtcagcacactgggaaaccgggccagcgtggggctccctgccttctggactcctgaaggtcgtggatggatggaaggcacacagcccgtgccggctgatgggacgagggtcaggcatcctgtctgtggccttctggggcaccgattctaccaggccctccagctgcgtggtctccgcagaccaggctctgtgtgggctagaggaatgtcgcccattactcctcaggcctggccctcgggcctccgtgatgggagccccccaggaggggtcagatgctggaaggggccgctttctggggagtgaggtgagacatagcggcccaggcgctgccttcactcctggagtttccatttccagctggaatctgcagccacccccatttcctgttttccattcccccgttctggccgcgccccactgcccacctgaaggggtggtttccagccctccggagagtgggcttggccctaggccctccagctcagccagagctagagtgggctaggccctggctttgcccgtcagatttgaacgaatgtgtgtcccttgagcccaaggagagcggcaggaggggtgggaccaggctgggaggacagagccagcagctgccatgccctcctgctccccccaccccagccctagccctttagcctttcaccctgtgctctggaaaggctaccaaatactggccaaggtcaggaggagcaaaaatgagccagcaccagcgccttggctttgtgttagcatttcctcctgaagtgttctgttggcaataaaatgcactttgactgttaaaattgtcactgatg

SEQ ID NO: 62005 - DNA, 2279 bp, Homo sapiens
ggaggggcgtgccctggagttgggggcggggcgaggcgggctcctccccggcgggcgggcccgggcgcggcgcggtggcctcgcggtgcctaggctggggctgccggaccgtgaggctgtgagtcgcgcggacggagccggacaaaagcgggcggcggcggcaggatgaacagcatcaagaacgtgccggcgcgggtgctgagccgcaggccgggccacagcctggaggccgagcgcgagcagttcgacaagacccaggccatcagcatcagcaaagccatcaacacccaggaggcccccgtgaaggagaagcacgcccggcgcatcattctgggcacacaccacgagaagggggctttcaccttctggtcctatgccattgggctgccgctgcccagcagctccattctcagctggaagttctgccacgtcctccacaaggtccttcgagacgggcaccccaatgtgctgcatgactgccagcggtaccgcagcaacatccgggagattggagacctgtggggacatttgcatgaccgctacggacagctggtgaatgtctacaccaagctgctgctgaccaagatctccttccacctcaagcatccccagtttcccgcgggcctggaggtgacagatgaggtactggagaaggcagctgggaccgatgtcaacaacatcttccagctcactgtggagatgtttgattacatggattgtgagctgaagctttctgaatcagttttccgacagctcaacacggccatcgccgtatcccagatgtcctcaggccagtgccgcctggcccccctcatccaggtcatccaggactgcagccacctctaccactacacggtcaagctcctgttcaagctacactcttgtctccctgcggacaccctgcaaggccacagggaccggttccacgagcagtttcacagcctcaggaacttcttccgcagagcctccgacatgctgtacttcaagcggctcatccagatcccccggctgcccgagggaccccctaacttcctgcgggcctcagccctggctgagcacatcaagccggtggtggtgatccccgaggaggccccggaagatgaggagccggagaatctcattgagatcagcacagggccccccgcgggggagccagtggtggtggctgacctcttcgatcagacgtttggaccccccaatgggtctgtgaaggacgacagggacctccagattgagagcttgaagagagaggtggaaatgctccgctctgaactggagaagatcaagctggaggcccagcggtacatcgcgcagctgaagagccaggtgaatgcactggagggtgagctggaggagcagcggaagcagaagcagaaggccctggtggataatgagcagctccgccacgagctggcccagctgagggctgcccagctggagggcgagcggagccagggcctgcgtgaggaggctgagaggaaggccagtgccacggaggcgcgctacaacaagctgaaggaaaagcacagtgagctcgtccatgtgcacgcggagctgctcagaaagaacgcggacacagccaagcagctgacggtgacgcagcaaagccaggaggaggtggcgcgggtgaaggagcagctggccttccaggtggagcaggtgaagcgggagtcggagttgaagctagaggagaagagcgaccagctggagaagctcaagagggagctggaggccaaggccggagagctggcccgcgcgcaggaggccctgagccacacagagcagagcaagtcggagctgagctcacggctggacacgctgagtgcggagaaggatgctctgagtggagctgtgcggcagcgggaggcagacctgctggcggcgcagagcctggtgcgcgagacagaggcggcgctgagccgggagcagcagcgcagctcccaggagcagggcgagttgcagggccggctggcagagagggtatggcctccccagatgcagcagcaccactgagttcactgccgtctggcaaccatcgatctgtctccgtcatctgcctgttctagagatttcatgtaaacgggatcatacacgatgcatccttttgtgtccggcttcttcactcagcatcacgttgtcaagggtcaccacatcatagcctgtgtcattacctcattccttttatggctgagtcgtactctgccgtgtggacagaccacattgtgtttatctgttcatcacttggtggacattgggtttgttgcaactttctggctgtt

SEQ ID NO: 62006 - DNA, 878 bp, Homo sapiens
ggggccccaggtgcctggctgtgaccactgaccccccacctttaacccctgcagcttgacaaaaaggatggcatctacccagctcaactcgtgaactactaggccccccaggggtccagcagggtggctggtgacaggcctgggcctctgcaactgccctgacaggaccgagaggccttgcccctccacctggtgcccaagcctcccgccccaccgtctggatcaatgtcctcaaggcccctggcccttactgagcctgcagggtcctgggccatgtgggtggtgcttctggatgtgagtctcttatttatctgcagaaggaactttggggtgcagccaggacccggtaggcctgagcctcaactcttcagaaaatagtgtttttaatattcctcttcagaaaatagtgtttttaatattccgagctagagctcttcttcctacgtttgtagtcagcacactgggaaaccgggccagcgtggggctccctgccttctggactcctgaaggtcgtggatggatggaaggcacacagcccgtgccggctgatgggacgagggtcaggcatcctgtctgtggccttctggggcaccgattctaccaggccctccagctgcgtggtctccgcagaccaggctctgtgtgggctagaggaatgtcgcccattactcctcaggcctggccctcgggcctccgtgatgggagccccccaggaggggtcagatgctggaaggggccgctttctggggagtgaggtgagacatagcggcccaggcgctgccttcactcctggagtttccatttccagctggaatctgcagccacccccatttcctgttttccattcccccgttctggccgcgccccactgcccacct

SEQ ID NO: 62007 - DNA, 431 bp, Homo sapiens
gtaaagataagaagcaggacttgccaccgcattgtaagagaaagtttaccagcatcaattaattaaaatagaaggcagccaatcggcattgggcacaagggaatgatgcttgtattggagcatgatgaagagatgtcagctttgtctcagcaccaacatcactattaacacttgctatctgtcaccaatcagcaatctgttcctgatgtaatcgagagttccaaagcacagctcaattcttccacctctctgagaagagtggtgtgtaggccttctgacagtgggagaaagttgcactctttgggactcagtttcttctcaaaactcattcagaaatcatcacgtgtcactgttagctaggtccaggatgtttgaataagaattgtggttatattatagtaaattgtgtaaaaaatcagttagttatgggt

SEQ ID NO: 62008 - DNA, 467 bp, Homo sapiens
ggtgaattaaaagtgcagagtctgtatgtagcacagtgtcagtttgggagggaaggaaggcagcatcaaatcgttgttgaggttttgatgatgtgaagctctttagtctacctttctcctttccttaatatctaaagggagaaattccaagttgttatgtcttgagcagagcacatgacacctccttattaaccagcactactttttagctataggttgaaatttggctcgtggttcttcaagattttaagaaatagtaaataggagagttaaggatttggtatgtgaaaatatcaaacctgaatctagatgcatgaatctgatcaagcatctagagctcactactaatttactggaaatacagggggcagaggaatatgttaaattacacctcaagggtacaattaccaaataccatctgtgggaaactgcaagacaacccagtttcttccaataaatgaattgcc

SEQ ID NO: 62009 - DNA, 322 bp, Homo sapiens
atattacattgatgtcagtctttaaagatggagtaggactttgcaggcagcaacgaaagggaaggacatttcagaagcagaaataccatttgttaagggatgacagccaagaaatattaaagcatatttggaaagtattgaaaatctctgtgtggctagaactttagatgaagaatcagatacatctggagaaggagattgaaccagatgatcataaagaacattttatttaggccatggtaaggcttgggcactgtggagcccatgaaggtttttggacaagggagttgccttaggaaggagtatgaagccataaacaaat

SEQ ID NO: 62010 - DNA, 270 bp, Homo sapiens
tcaagtctcaacattctttcaatctaaaacagtcctcccaccagccctccttccccagccctttttaaatccatagcattgaagagaccaggtcattgtcttatagaatatccttcattttagatttgcctgattgtgtcttcattccctaaacttcctataaaccagcagttggatttaaagccttgataagacccaggtggaggatttttggcaagaacacattccagttgacactgtgtacttacttacttcatgttgtaactcata

SEQ ID NO: 62011 - DNA, 620 bp, Homo sapiens
aacaactccagacgcgctgccttaagagctgtaacactcaccgcgaaggtctgcagcttcactcctgatccagcgagaccagagaccacgaacccaccagaaggaagaaactccgaacacatctgaacatcacaagggacagactccagatgcgccaccttaagagctgtaacactcaccgcgagggtccgcagcttcattcttgaagtcagtgagaccaagaacccaccaattccggacacaggatgactacagttaacaatgatttattgtacatttcaaaatagctagaagagaagatttgacatgtttctaactcaaagaaatgccaaatgttgagctgatggatatcctgattaccctgatttgatcatcacacattgcatgcatgtattagaacatcacatgtacctataaatatgtatattattatgtatcaatttttttaaaaaagaaacaaatgtctattatgagttcttagcactgagtagatgcccaatgaccataagctatcattattaacaccagtttgttgatacattataaatacaagaaattatgttcctccataccacatacatagaagatacttaaaaatacattcaccaaaaaaaaaaact

SEQ ID NO: 62012 - DNA, 514 bp, Homo sapiens
tggaggactattctgccattaggaaaattacctttgaattccactaacgatacaatgcaagatattgagatgctttcatacatgaacatataccactgtctttggggaaacaaggttttttttcactaagcatttaaaatgcacaatggcccaaaattgatggacatataactgctggaagtttgcaaaagtttggcagaatgtagttcagtgtgtgcatacgtgtgctggggagtagagcgtaggtgtacatgcaggaaaagctccttgagtcagtcagagctatattttaagggcttgctggtgagtatcttcactaacaaagtgagacaaggttgaaccacaattcctggcaataagaaaacaataagaaatgtgtttcttacaggtgtgaggcactgtgcctcacacctataatcccagcaatttgagaggctgagatgggtggattgcttgaggctaagagtttgagaccaacctggacaacactgtgaaaccttgtctttaccaaaaa

SEQ ID NO: 62013 - DNA, 476 bp, Homo sapiens
tcaatttcatttagttctgctctgatcttggttatttcctttcttctgctgggtttgggtttggtttgttctagttccctagttccttgagttgtgaccttagattgtctgtttgtgctctttcagaatttttgatgtaggcatttagggcaatgaactatcctcttagcaccaccttagctgtatcccagaggttttgataggttgggtcattattgtctttcagttcaagaattttttaatttccatcttgattttgtttttgacccatagctcattcaggagcaggttatttaatttccaaaccctaagtgttcccccagaaaactgctagaactgattatataattcagcaaagtttcaagatactggatgaatgtacacagatcagtagctcttctatgcatctacagtgaccaagcagagaatcaaatcaagaactcaaccacttttacaacagctgcaaaaaaaataaa

SEQ ID NO: 62014 - DNA, 615 bp, Homo sapiens
ttctcgttaaagtgtattccatttcttttgtgctttcatattgaccattgtgtgttaatcctttcaattggaagaagagggagacagtgccagttattgcaaactttcacagtccacaggcccgatatgtagccttcaccacccacaggttctgccacttctggggcattatattccatcaagatccaggcacccgccatccacataccagccctggaactcgtcccttctcccagacttggaaacgccacctctgcctgaccaatgtcgagccacttcctcatcttgatacatcagccactatcctttccatctttcaggcaactccagcttaatttctcgatggccttgcccttctaaaaggccgttctcttttcccagatgactttttcctatcccctccacagtaactcccctcatccttccagtctcaattcaattgttccttggtggggtggggcggggggagccttcttaaaccctcctccctcacaactgcatgaggtcccttgtctctaatataagctcctgtagcaccatggcacttatcccagttgagattttaaatatatttctgtgtatttgattaaagtttctctcctccaaaaaaaaaaa

SEQ ID NO: 62015 - DNA, 365 bp, Homo sapiens
cagtagagacggggtttcactgtgttagccaggatggtctcaatctcctgacctcgtgatccacccgcctcggcctcccaaagtgctaggattacaggcgtgggccaccgtgcctgtcccagtttcctcatttttaaatgaaagagctggaaatacctttaaaaggttgagggtctaatgaatcatcttcatgtacattcatagatagcattggctttcattgtgattatggtttttggtgagggcacatgggcttttaatacctggtcagtgatatagttaggaattgcagtttgtgacactttggccaaataatcatcaggaattgtgagtgatgctggtgaataatagctgtagtcagattt

SEQ ID NO: 62016 - DNA, 539 bp, Homo sapiens
actggtttcagatgctaagcctttactatacatgtctataattttatgacactagggtagtataagtacttagtaatatttatggtcctcactcatttctccctgcacattccatgcatgtaggtaatttttctacaacaaatagcttattcttttataaggaatgggaatggaaaggggtaattatcatttagttgcttggtactgtacttttatgtatgcaagggcagacctcttgccccacctttcaaaacagcattcctaaacatcacagtgcacccagagctgctgaacgagggcatgtgtgctgacccgaattattagcacatccatctgtccagcaacactatgaaatattttccatttttcacattacacatcttttatgtgaaaacacacacacccataatggcagctttaatcaacagggtagctgtggataagaattaacattgaccataatgatttcctttcacgtgttaatctaattctaaaattagtaacaataaaatagtgtggttaaataaatattttaaaaa

SEQ ID NO: 62017 - DNA, 872 bp, Homo sapiens
gtatttttagtagagatggggtttcaccacattggccaggctggtctcaaactcctgacctcaagtgatccacctaccttggcctaccgaggtgctggaattacaggtgtgagccaccgcgcctggcctaatactgctttattacaacgttatctgtgggtcggatccttttatattggttaacagatgaccctgactcagaataatctttttcaatggctttttgagggaagcttgtgaagttctggtgaatcttctttttcacttcactttcagtgagctgaaagtaaccaaactaaatacatgtattgtgtaaagggacaggacaagacagccttaaaaaattgaatatagttggtgagacaactcagaagtacaggtttgagcatcccttattcaaaatgcttgagaagtgttttgggttctggaatatttgcattaatgcttgccagttgagcatcccaggtccggaaatccagagtgctccaatgagcctttcccctgagtgtcacatctgtattggcactcaaaaagtttcatattttggagcatttcagatttcagatttgggatgcttcatctatattgacagctgcaagaacagaaaggaagaagagattatttttgtgggagaacagtttctcccatagtgtttcctgtggaatgctagtgtctcataaagtcttctaaaaaaaagaaaaaaaaaaatcaaatgtttggaagccattttgtgttactgtgtgactttcttttactcaaaaacagcaccataaaatttctgacaagtactataggtaaagaaatccctttatacttaacctagtattttctacctttccccatctaaaataaaatttttataccactttcta

SEQ ID NO: 62018 - DNA, 1071 bp, Homo sapiens
gtatttttagtagagatggggtttcaccacattggccaggctggtctcaaactcctgacctcaagtgatccacctaccttggcctaccgaggtgctggaattacaggtgtgagccaccgcgcctggcctaatactgctttattacaacgttatctgtgggtcggatccttttatattggttaacagatgaccctgactcagaataatctttttcaatggctttttgagggaagcttgtgaagttctggtgaatcttctttttcacttcactttcagtgagctgaaagtaaccaaactaaatacatgtattgtgtaaagggacaggacaagacagccttaaaaaattgaatatagttggtgagacaactcagaagtacaggtttgagcatcccttattcaaaatgcttgagaagtgttttgggttctggaatatttgcattaatgcttgccagttgagcatcccaggtccggaaatccagagtgctccaatgagcctttcccctgagtgtcacatctgtattggcactcaaaaagtttcatattttggagcatttcagatttcagatttgggatgcttcatctatattgacagctgcaagaacagaaaggaagaagagattatttttgtgggagaacagtttctcccatagtgtttcctgtggaatgctagtgtctcataaagtcttctaaaaaaaagaaaaaaaaaaatcaaatgtttggaagccattttgtgttactgtgtgactttcttttactcaaaaacagcaccataaaatttctgacaagtactataggtaaagaaatccctttatacttaacctagtattttctacctttccccatctaaaataaaatttttataccactttctaattatgttgtgtgtgcccactttccccatacctactgctaccatcttagagtaggcaattttctcaagaggattattccaagaacaccctaatgttttcctgcttccagtcttctttcctcaaatttattccacactcttaagaattgaagatgtaaatctgtcactcgcctgaataaagcttcagtggcctctgactt

SEQ ID NO: 62019 - DNA, 940 bp, Homo sapiens
gtatttttagtagagatggggtttcaccacattggccaggctggtctcaaactcctgacctcaagtgatccacctaccttggcctaccgaggtgctggaattacaggtgtgagccaccgcgcctggcctaatactgctttattacaacgttatctgtgggtcggatccttttatattggttaacagatgaccctgactcagaataatctttttcaatggctttttgagggaagcttgtgaagttctggtgaatcttctttttcacttcactttcagtgagctgaaagtaaccaaactaaatacatgtattgtgtaaagggacaggacaagacagccttaaaaaattgaatatagttggtgagacaactcagaagtacaggtttgagcatcccttattcaaaatgcttgagaagtgttttgggttctggaatatttgcattaatgttcatctatattgacagctgcaagaacagaaaggaagaagagattatttttgtgggagaacagtttctcccatagtgtttcctgtggaatgctagtgtctcataaagtcttctaaaaaaaagaaaaaaaaaaatcaaatgtttggaagccattttgtgttactgtgtgactttcttttactcaaaaacagcaccataaaatttctgacaagtactataggtaaagaaatccctttatacttaacctagtattttctacctttccccatctaaaataaaatttttataccactttctaattatgttgtgtgtgcccactttccccatacctactgctaccatcttagagtaggcaattttctcaagaggattattccaagaacaccctaatgttttcctgcttccagtcttctttcctcaaatttattccacactcttaagaattgaagatgtaaatctgtcactcgcctgaataaagcttcagtggcctctgactt

SEQ ID NO: 62020 - DNA, 723 bp, Homo sapiens
taaagctccagtagttaagacaccatatggcattggttctggagtagacaagtaggccagtggaagaaagctttatatacaaagaatcttggtccaccactgaggcagcattgatgtcaccaggcaaaggagatactggggttgcggaatctgggatattgactattcctaagatgaaaaaacaaattgagttcctaactcataccatagtcaaaaataaattgcagatgaatgggtaaataatatgtggtacacacatacaatgtaatattattcaacattaaaaaggaagggaattctgacacatgctaccacatggatgaacattctgctcagtgaaataaaccagatgcagacagacaaatactacattccgcttacatgagtacttagagtagtcaaactcatgggagacagaaagtagaatcacctggacaccgtggttcacacctggcatcccagcactttgggaggccaaggttggaggattgtttgagcccaggagtttgagagtagcctgggtaacatagtgtgatcctgtcactacaaaaaattaatgaaaaaattttaaaattagctgggcgtagtggcatgtgcctagttacagctattcaggaggctgaggcgggaggatcagttgagtctgcagtgagccagggtcaaggcactgcactccagcctgggggactgagcaagaccctgcctcaagggaaaaaaaaaaaa

SEQ ID NO: 62021 - DNA, 242 bp, Homo sapiens
atgtcctttctgcagatcaagccactgctgccggggggagggagcggggctggcccgagagcctggcccccctcagtttctccatctttgtatctgtcggtttctatggagtgcggtttttaatctgctccacgacgctctgtctcttgctgagttctggtccctccctatgggagattcaggttccaatcccaactctgtccccaaaacaaagtgctggggatgtgcttggccctcaaggc

SEQ ID NO: 62022 - DNA, 661 bp, Homo sapiens
cggggcggagcctagggaagcaaattctcctggcggcctccgttcagacgcggcagctgtgacccacctgcctcctccgcagagcaatggcggtgtctgccgggtccgcgcggacctcgcccagctcagataaagtacagaaagacaaggctgaactgatctcagggcccaggcaggacagccgaatagggaaactcttgggttttgagtggacagatttgtccagttggcggaggctggtgaccctgctgaatcgaccaacggaccctgcaagcttagctgtctttcgttttctttttgggttcttgatggtgctagacattccccaggagcgggggctcagctctctggaccggaaataccttgatgggctggatgtgtgccgcttccccttgctggatgccctacgcccactgccacttgactggatgtatcttgtctacaccatcatgtttctgggtgaggggaactgtgggaaatattgactggcctgccagaaacacagaaatagaagcatgctggtgaatggtcaaagtctttggcaccttatttcacttctgctgtgatcaatttcatgctgttgacctgtgtgtcacttaagctgtgatcccataattctttttaaaatattaaaataacatttaattttcaaaaagtttta

SEQ ID NO: 62023 - DNA, 3255 bp, Homo sapiens
cggggcggagcctagggaagcaaattctcctggcggcctccgttcagacgcggcagctgtgacccacctgcctcctccgcagagcaatggcggtgtctgccgggtccgcgcggacctcgcccagctcagataaagtacagaaagacaaggctgaactgatctcagggcccaggcaggacagccgaatagggaaactcttgggttttgagtggacagatttgtccagttggcggaggctggtgaccctgctgaatcgaccaacggaccctgcaagcttagctgtctttcgttttctttttgggttcttgatggtgctagacattccccaggagcgggggctcagctctctggaccggaaataccttgatgggctggatgtgtgccgcttccccttgctggatgccctacgcccactgccacttgactggatgtatcttgtctacaccatcatgtttctgggggcactgggcatgatgctgggcctgtgctaccggataagctgtgtgttattcctgctgccatactggtatgtgtttctcctggacaagacatcatggaacaaccactcctatctgtatgggttgttggcctttcagctaacattcatggatgcaaaccactactggtctgtggacggtctgctgaatgcccataggaggaatgcccacgtgcccctttggaactatgcagtgctccgtggccagatcttcattgtgtacttcattgcgggtgtgaaaaagctggatgcagactgggttgaaggctattccatggaatatttgtcccggcactggctcttcagtcccttcaaactgctgttgtctgaggagctgactagcctgctggtcgtgcactggggtgggctgctgcttgacctctcagctggtttcctgctcttttttgatgtctcaagatccattggcctgttctttgtgtcctacttccactgcatgaattcccagcttttcagcattggtatgttctcctacgtcatgctggccagcagccctctcttctgctcccctgagtggcctcggaagctggtgtcctactgcccccgaaggttgcaacaactgttgcccctcaaggcagcccctcagcccagtgtttcctgtgtgtataagaggagccggggcaaaagtggccagaagccagggctgcgccatcagctgggagctgccttcaccctgctctacctcctggagcagctattcctgccctattctcattttctcacccagggctataacaactggacaaatgggctgtatggctattcctgggacatgatggtgcactcccgctcccaccagcacgtgaagatcacctaccgtgatggccgcactggcgaactgggctaccttaaccctggggtatttacacagagtcggcgatggaaggatcatgcagacatgctgaagcaatatgccacttgcctgagccgcctgcttcccaagtataatgtcactgagccccagatctactttgatatttgggtctccatcaatgaccgcttccagcagaggatttttgaccctcgtgtggacatcgtgcaggccgcttggtcaccctttcagcgcacatcctgggtgcaaccactcttgatggacctgtctccctggagggccaagttacaggaaatcaagagcagcctagacaaccacactgaggtggtcttcattgcagatttccctggactgcacttggagaattttgtgagtgaagacctgggcaacactagcatccagctgctgcagggggaagtgactgtggagcttgtggcagaacagaagaaccagactcttcgagagggagaaaaaatgcagttgcctgctggtgagtaccataaggtgtatacgacatcacctagcccttcttgctacatgtacgtctatgtcaacactacagagcttgcactggagcaagacctggcatatctgcaagaattaaaggaaaaggtggagaatggaagtgaaacagggcctctacccccagagctgcagcctctgttggaaggggaagtaaaagggggccctgagccaacacctctggttcagacctttcttagacgccaacaaaggctccaggagattgaacgccggcgaaatactcctttccatgagcgattcttccgcttcttgttgcgaaagctctatgtctttcgccgcagcttcctgatgacttgtatctcacttcgaaatctgatattaggccgtccttccctggagcagctggcccaggaggtgacttatgcaaacttgagaccctttgaggcagttggagaactgaatccctcaaacacggattcttcacattctaatcctcctgagtcaaatcctgatcctgtccactcagagttctgaagggggccagatgttgggtgcagatgtagaagcagccagtcacagacccattctatgcaatggacatttatttgaaaaaaattctcaaaagttttttttttttttttgggggggcggggttctaaagctgtttttaactccgagattacaacttagaggaaccaaggaaataaagcaaataagatttaacaacccaagattaagaggccaggaagaggttagacgcaatgtgaaactgtcctcctaggataaggtttaaagtggctttttgggggctgggtgccgtggctcacgcctgtaatcccagcattttgggaggctgaggtgggcagatcacttgaggccaggagttcgagaccagcctggccaacatggcaaaaccccttctctactaaaaatacaaaaattagccagacgtggtggtgggtgcctgtaatccaactacccaggaggctgaggcatgagaatcgcttgggcccaggaggtggaggttgcagtgagccgagatcgagccactgcactcctgggcaacagagcaagacttcgtctcaaaataaataaataaagtggctcttggggaaaagcaatttaatgtaccacgatgaatagctaactgttcccaagtgtttgctatgtgcaacacaccgcgtgagcagtgttacctgcattattacattaggctgagaggtaaaataatttgcccgaagacatacagctagtgacgaatggactgatggtttgaacttaacgtctatttgacttaaggtcctgcaccctgccacttgtaattttcagaatcactgataatctgaaataatgcagcttaaaacatgttttcttaattaaaagtataattggatggtggtcaggttgtaaatgcacacaaagtaat

SEQ ID NO: 62024 - DNA, 3325 bp, Homo sapiens
tgaagtgaaaatggcgtgagggtgtgagagaggtttgggttaggaaacatgtttttagtgctatttccaaccaggggtcgcaaactcagcagcctgtagaaacaggggtgggaggtggggcggcagctgtgacccacctgcctcctccgcagagcaatggcggtgtctgccgggtccgcgcggacctcgcccagctcagataaagtacagaaagacaaggctgaactgatctcagggcccaggcaggacagccgaatagggaaactcttgggttttgagtggacagatttgtccagttggcggaggctggtgaccctgctgaatcgaccaacggaccctgcaagcttagctgtctttcgttttctttttgggttcttgatggtgctagacattccccaggagcgggggctcagctctctggaccggaaataccttgatgggctggatgtgtgccgcttccccttgctggatgccctacgcccactgccacttgactggatgtatcttgtctacaccatcatgtttctgggggcactgggcatgatgctgggcctgtgctaccggataagctgtgtgttattcctgctgccatactggtatgtgtttctcctggacaagacatcatggaacaaccactcctatctgtatgggttgttggcctttcagctaacattcatggatgcaaaccactactggtctgtggacggtctgctgaatgcccataggaggaatgcccacgtgcccctttggaactatgcagtgctccgtggccagatcttcattgtgtacttcattgcgggtgtgaaaaagctggatgcagactgggttgaaggctattccatggaatatttgtcccggcactggctcttcagtcccttcaaactgctgttgtctgaggagctgactagcctgctggtcgtgcactggggtgggctgctgcttgacctctcagctggtttcctgctcttttttgatgtctcaagatccattggcctgttctttgtgtcctacttccactgcatgaattcccagcttttcagcattggtatgttctcctacgtcatgctggccagcagccctctcttctgctcccctgagtggcctcggaagctggtgtcctactgcccccgaaggttgcaacaactgttgcccctcaaggcagcccctcagcccagtgtttcctgtgtgtataagaggagccggggcaaaagtggccagaagccagggctgcgccatcagctgggagctgccttcaccctgctctacctcctggagcagctattcctgccctattctcattttctcacccagggctataacaactggacaaatgggctgtatggctattcctgggacatgatggtgcactcccgctcccaccagcacgtgaagatcacctaccgtgatggccgcactggcgaactgggctaccttaaccctggggtatttacacagagtcggcgatggaaggatcatgcagacatgctgaagcaatatgccacttgcctgagccgcctgcttcccaagtataatgtcactgagccccagatctactttgatatttgggtctccatcaatgaccgcttccagcagaggatttttgaccctcgtgtggacatcgtgcaggccgcttggtcaccctttcagcgcacatcctgggtgcaaccactcttgatggacctgtctccctggagggccaagttacaggaaatcaagagcagcctagacaaccacactgaggtggtcttcattgcagatttccctggactgcacttggagaattttgtgagtgaagacctgggcaacactagcatccagctgctgcagggggaagtgactgtggagcttgtggcagaacagaagaaccagactcttcgagagggagaaaaaatgcagttgcctgctggtgagtaccataaggtgtatacgacatcacctagcccttcttgctacatgtacgtctatgtcaacactacagagcttgcactggagcaagacctggcatatctgcaagaattaaaggaaaaggtggagaatggaagtgaaacagggcctctacccccagagctgcagcctctgttggaaggggaagtaaaagggggccctgagccaacacctctggttcagacctttcttagacgccaacaaaggctccaggagattgaacgccggcgaaatactcctttccatgagcgattcttccgcttcttgttgcgaaagctctatgtctttcgccgcagcttcctgatgacttgtatctcacttcgaaatctgatattaggccgtccttccctggagcagctggcccaggaggtgacttatgcaaacttgagaccctttgaggcagttggagaactgaatccctcaaacacggattcttcacattctaatcctcctgagtcaaatcctgatcctgtccactcagagttctgaagggggccagatgttgggtgcagatgtagaagcagccagtcacagacccattctatgcaatggacatttatttgaaaaaaattctcaaaagttttttttttttttttgggggggcggggttctaaagctgtttttaactccgagattacaacttagaggaaccaaggaaataaagcaaataagatttaacaacccaagattaagaggccaggaagaggttagacgcaatgtgaaactgtcctcctaggataaggtttaaagtggctttttgggggctgggtgccgtggctcacgcctgtaatcccagcattttgggaggctgaggtgggcagatcacttgaggccaggagttcgagaccagcctggccaacatggcaaaaccccttctctactaaaaatacaaaaattagccagacgtggtggtgggtgcctgtaatccaactacccaggaggctgaggcatgagaatcgcttgggcccaggaggtggaggttgcagtgagccgagatcgagccactgcactcctgggcaacagagcaagacttcgtctcaaaataaataaataaagtggctcttggggaaaagcaatttaatgtaccacgatgaatagctaactgttcccaagtgtttgctatgtgcaacacaccgcgtgagcagtgttacctgcattattacattaggctgagaggtaaaataatttgcccgaagacatacagctagtgacgaatggactgatggtttgaacttaacgtctatttgacttaaggtcctgcaccctgccacttgtaattttcagaatcactgataatctgaaataatgcagcttaaaacatgttttcttaattaaaagtataattggatggtggtcaggttgtaaatgcacacaaagtaat

SEQ ID NO: 62025 - DNA, 1616 bp, Homo sapiens
  misc_feature (43)..(43): n is a, c, g, or t
  misc_feature (51)..(51): n is a, c, g, or t
  misc_feature (54)..(54): n is a, c, g, or t
agtgatctagaggagctgtgctccatggtgccaggtcttcatngcagattnccntggactgcacttggagaattttgtgagtgaagacctgggcaacactagcatccagctgctgcagggggaagtgactgtggagcttgtggcagaacagaagaaccagactcttcgagagggagaaaaaatgcagttgcctgctggtgagtaccataaggtgtatacgacatcacctagcccttcttgctacatgtacgtctatgtcaacactacagagcttgcactggagcaagacctggcatatctgcaagaattaaaggaaaaggtggagaatggaagtgaaacagggcctctacccccagagctgcagcctctgttggaaggggaagtaaaagggggccctgagccaacacctctggttcagacctttcttagacgccaacaaaggctccaggagattgaacgccggcgaaatactcctttccatgagcgattcttccgcttcttgttgcgaaagctctatgtctttcgccgcagcttcctgatgacttgtatctcacttcgaaatctgatattaggccgtccttccctggagcagctggcccaggaggtgacttatgcaaacttgagaccctttgaggcagttggagaactgaatccctcaaacacggattcttcacattctaatcctcctgagtcaaatcctgatcctgtccactcagagttctgaagggggccagatgttgggtgcagatgtagaagcagccagtcacagacccattctatgcaatggacatttatttgaaaaaaattctcaaaagttttttttttttttttgggggggcggggttctaaagctgtttttaactccgagattacaacttagaggaaccaaggaaataaagcaaataagatttaacaacccaagattaagaggccaggaagaggttagacgcaatgtgaaactgtcctcctaggataaggtttaaagtggctttttgggggctgggtgccgtggctcacgcctgtaatcccagcattttgggaggctgaggtgggcagatcacttgaggccaggagttcgagaccagcctggccaacatggcaaaaccccttctctactaaaaatacaaaaattagccagacgtggtggtgggtgcctgtaatccaactacccaggaggctgaggcatgagaatcgcttgggcccaggaggtggaggttgcagtgagccgagatcgagccactgcactcctgggcaacagagcaagacttcgtctcaaaataaataaataaagtggctcttggggaaaagcaatttaatgtaccacgatgaatagctaactgttcccaagtgtttgctatgtgcaacacaccgcgtgagcagtgttacctgcattattacattaggctgagaggtaaaataatttgcccgaagacatacagctagtgacgaatggactgatggtttgaacttaacgtctatttgacttaaggtcctgcaccctgccacttgtaattttcagaatcactgataatctgaaataatgcagcttaaaacatgttttcttaattaaaagtataattggatggtggtcaggttgtaaatgcacacaaagtaat

SEQ ID NO: 62026 - DNA, 1590 bp, Homo sapiens
  misc_feature (27)..(27): n is a, c, g, or t
cttatttttgctgcattgcatattgcnctttgctgcgcttttataaattttttatttaatggctttgcagcactagcatccagctgctgcagggggaagtgactgtggagcttgtggcagaacagaagaaccagactcttcgagagggagaaaaaatgcagttgcctgctggtgagtaccataaggtgtatacgacatcacctagcccttcttgctacatgtacgtctatgtcaacactacagagcttgcactggagcaagacctggcatatctgcaagaattaaaggaaaaggtggagaatggaagtgaaacagggcctctacccccagagctgcagcctctgttggaaggggaagtaaaagggggccctgagccaacacctctggttcagacctttcttagacgccaacaaaggctccaggagattgaacgccggcgaaatactcctttccatgagcgattcttccgcttcttgttgcgaaagctctatgtctttcgccgcagcttcctgatgacttgtatctcacttcgaaatctgatattaggccgtccttccctggagcagctggcccaggaggtgacttatgcaaacttgagaccctttgaggcagttggagaactgaatccctcaaacacggattcttcacattctaatcctcctgagtcaaatcctgatcctgtccactcagagttctgaagggggccagatgttgggtgcagatgtagaagcagccagtcacagacccattctatgcaatggacatttatttgaaaaaaattctcaaaagttttttttttttttttgggggggcggggttctaaagctgtttttaactccgagattacaacttagaggaaccaaggaaataaagcaaataagatttaacaacccaagattaagaggccaggaagaggttagacgcaatgtgaaactgtcctcctaggataaggtttaaagtggctttttgggggctgggtgccgtggctcacgcctgtaatcccagcattttgggaggctgaggtgggcagatcacttgaggccaggagttcgagaccagcctggccaacatggcaaaaccccttctctactaaaaatacaaaaattagccagacgtggtggtgggtgcctgtaatccaactacccaggaggctgaggcatgagaatcgcttgggcccaggaggtggaggttgcagtgagccgagatcgagccactgcactcctgggcaacagagcaagacttcgtctcaaaataaataaataaagtggctcttggggaaaagcaatttaatgtaccacgatgaatagctaactgttcccaagtgtttgctatgtgcaacacaccgcgtgagcagtgttacctgcattattacattaggctgagaggtaaaataatttgcccgaagacatacagctagtgacgaatggactgatggtttgaacttaacgtctatttgacttaaggtcctgcaccctgccacttgtaattttcagaatcactgataatctgaaataatgcagcttaaaacatgttttcttaattaaaagtataattggatggtggtcaggttgtaaatgcacacaaagtaat

SEQ ID NO: 62027 - DNA, 3030 bp, Homo sapiens
  misc_feature (19)..(19): n is a, c, g, or t
  misc_feature (26)..(26): n is a, c, g, or t
atcaggctagtacgaggcngggtgtnagagcaatggcggtgtctgccgggtccgcgcggacctcgcccagctcagggttcttgatggtgctagacattccccaggagcgggggctcagctctctggaccggaaataccttgatgggctggatgtgtgccgcttccccttgctggatgccctacgcccactgccacttgactggatgtatcttgtctacaccatcatgtttctgggggcactgggcatgatgctgggcctgtgctaccggataagctgtgtgttattcctgctgccatactggtatgtgtttctcctggacaagacatcatggaacaaccactcctatctgtatgggttgttggcctttcagctaacattcatggatgcaaaccactactggtctgtggacggtctgctgaatgcccataggaggaatgcccacgtgcccctttggaactatgcagtgctccgtggccagatcttcattgtgtacttcattgcgggtgtgaaaaagctggatgcagactgggttgaaggctattccatggaatatttgtcccggcactggctcttcagtcccttcaaactgctgttgtctgaggagctgactagcctgctggtcgtgcactggggtgggctgctgcttgacctctcagctggtttcctgctcttttttgatgtctcaagatccattggcctgttctttgtgtcctacttccactgcatgaattcccagcttttcagcattggtatgttctcctacgtcatgctggccagcagccctctcttctgctcccctgagtggcctcggaagctggtgtcctactgcccccgaaggttgcaacaactgttgcccctcaaggcagcccctcagcccagtgtttcctgtgtgtataagaggagccggggcaaaagtggccagaagccagggctgcgccatcagctgggagctgccttcaccctgctctacctcctggagcagctattcctgccctattctcattttctcacccagggctataacaactggacaaatgggctgtatggctattcctgggacatgatggtgcactcccgctcccaccagcacgtgaagatcacctaccgtgatggccgcactggcgaactgggctaccttaaccctggggtatttacacagagtcggcgatggaaggatcatgcagacatgctgaagcaatatgccacttgcctgagccgcctgcttcccaagtataatgtcactgagccccagatctactttgatatttgggtctccatcaatgaccgcttccagcagaggatttttgaccctcgtgtggacatcgtgcaggccgcttggtcaccctttcagcgcacatcctgggtgcaaccactcttgatggacctgtctccctggagggccaagttacaggaaatcaagagcagcctagacaaccacactgaggtggtcttcattgcagatttccctggactgcacttggagaattttgtgagtgaagacctgggcaacactagcatccagctgctgcagggggaagtgactgtggagcttgtggcagaacagaagaaccagactcttcgagagggagaaaaaatgcagttgcctgctggtgagtaccataaggtgtatacgacatcacctagcccttcttgctacatgtacgtctatgtcaacactacagagcttgcactggagcaagacctggcatatctgcaagaattaaaggaaaaggtggagaatggaagtgaaacagggcctctacccccagagctgcagcctctgttggaaggggaagtaaaagggggccctgagccaacacctctggttcagacctttcttagacgccaacaaaggctccaggagattgaacgccggcgaaatactcctttccatgagcgattcttccgcttcttgttgcgaaagctctatgtctttcgccgcagcttcctgatgacttgtatctcacttcgaaatctgatattaggccgtccttccctggagcagctggcccaggaggtgacttatgcaaacttgagaccctttgaggcagttggagaactgaatccctcaaacacggattcttcacattctaatcctcctgagtcaaatcctgatcctgtccactcagagttctgaagggggccagatgttgggtgcagatgtagaagcagccagtcacagacccattctatgcaatggacatttatttgaaaaaaattctcaaaagttttttttttttttttgggggggcggggttctaaagctgtttttaactccgagattacaacttagaggaaccaaggaaataaagcaaataagatttaacaacccaagattaagaggccaggaagaggttagacgcaatgtgaaactgtcctcctaggataaggtttaaagtggctttttgggggctgggtgccgtggctcacgcctgtaatcccagcattttgggaggctgaggtgggcagatcacttgaggccaggagttcgagaccagcctggccaacatggcaaaaccccttctctactaaaaatacaaaaattagccagacgtggtggtgggtgcctgtaatccaactacccaggaggctgaggcatgagaatcgcttgggcccaggaggtggaggttgcagtgagccgagatcgagccactgcactcctgggcaacagagcaagacttcgtctcaaaataaataaataaagtggctcttggggaaaagcaatttaatgtaccacgatgaatagctaactgttcccaagtgtttgctatgtgcaacacaccgcgtgagcagtgttacctgcattattacattaggctgagaggtaaaataatttgcccgaagacatacagctagtgacgaatggactgatggtttgaacttaacgtctatttgacttaaggtcctgcaccctgccacttgtaattttcagaatcactgataatctgaaataatgcagcttaaaacatgttttcttaattaaaagtataattggatggtggtcaggttgtaaatgcacacaaagtaat

SEQ ID NO: 62028 - DNA, 3003 bp, Homo sapiens
cggtgtctagccggggcttccgcgcccggaaccctcgagcgcagctcaggttcttgatggtgctagacattccccaggagcgggggctcagctctctggaccggaaataccttgatgggctggatgtgtgccgcttccccttgctggatgccctacgcccactgccacttgactggatgtatcttgtctacaccatcatgtttctgggggcactgggcatgatgctgggcctgtgctaccggataagctgtgtgttattcctgctgccatactggtatgtgtttctcctggacaagacatcatggaacaaccactcctatctgtatgggttgttggcctttcagctaacattcatggatgcaaaccactactggtctgtggacggtctgctgaatgcccataggaggaatgcccacgtgcccctttggaactatgcagtgctccgtggccagatcttcattgtgtacttcattgcgggtgtgaaaaagctggatgcagactgggttgaaggctattccatggaatatttgtcccggcactggctcttcagtcccttcaaactgctgttgtctgaggagctgactagcctgctggtcgtgcactggggtgggctgctgcttgacctctcagctggtttcctgctcttttttgatgtctcaagatccattggcctgttctttgtgtcctacttccactgcatgaattcccagcttttcagcattggtatgttctcctacgtcatgctggccagcagccctctcttctgctcccctgagtggcctcggaagctggtgtcctactgcccccgaaggttgcaacaactgttgcccctcaaggcagcccctcagcccagtgtttcctgtgtgtataagaggagccggggcaaaagtggccagaagccagggctgcgccatcagctgggagctgccttcaccctgctctacctcctggagcagctattcctgccctattctcattttctcacccagggctataacaactggacaaatgggctgtatggctattcctgggacatgatggtgcactcccgctcccaccagcacgtgaagatcacctaccgtgatggccgcactggcgaactgggctaccttaaccctggggtatttacacagagtcggcgatggaaggatcatgcagacatgctgaagcaatatgccacttgcctgagccgcctgcttcccaagtataatgtcactgagccccagatctactttgatatttgggtctccatcaatgaccgcttccagcagaggatttttgaccctcgtgtggacatcgtgcaggccgcttggtcaccctttcagcgcacatcctgggtgcaaccactcttgatggacctgtctccctggagggccaagttacaggaaatcaagagcagcctagacaaccacactgaggtggtcttcattgcagatttccctggactgcacttggagaattttgtgagtgaagacctgggcaacactagcatccagctgctgcagggggaagtgactgtggagcttgtggcagaacagaagaaccagactcttcgagagggagaaaaaatgcagttgcctgctggtgagtaccataaggtgtatacgacatcacctagcccttcttgctacatgtacgtctatgtcaacactacagagcttgcactggagcaagacctggcatatctgcaagaattaaaggaaaaggtggagaatggaagtgaaacagggcctctacccccagagctgcagcctctgttggaaggggaagtaaaagggggccctgagccaacacctctggttcagacctttcttagacgccaacaaaggctccaggagattgaacgccggcgaaatactcctttccatgagcgattcttccgcttcttgttgcgaaagctctatgtctttcgccgcagcttcctgatgacttgtatctcacttcgaaatctgatattaggccgtccttccctggagcagctggcccaggaggtgacttatgcaaacttgagaccctttgaggcagttggagaactgaatccctcaaacacggattcttcacattctaatcctcctgagtcaaatcctgatcctgtccactcagagttctgaagggggccagatgttgggtgcagatgtagaagcagccagtcacagacccattctatgcaatggacatttatttgaaaaaaattctcaaaagttttttttttttttttgggggggcggggttctaaagctgtttttaactccgagattacaacttagaggaaccaaggaaataaagcaaataagatttaacaacccaagattaagaggccaggaagaggttagacgcaatgtgaaactgtcctcctaggataaggtttaaagtggctttttgggggctgggtgccgtggctcacgcctgtaatcccagcattttgggaggctgaggtgggcagatcacttgaggccaggagttcgagaccagcctggccaacatggcaaaaccccttctctactaaaaatacaaaaattagccagacgtggtggtgggtgcctgtaatccaactacccaggaggctgaggcatgagaatcgcttgggcccaggaggtggaggttgcagtgagccgagatcgagccactgcactcctgggcaacagagcaagacttcgtctcaaaataaataaataaagtggctcttggggaaaagcaatttaatgtaccacgatgaatagctaactgttcccaagtgtttgctatgtgcaacacaccgcgtgagcagtgttacctgcattattacattaggctgagaggtaaaataatttgcccgaagacatacagctagtgacgaatggactgatggtttgaacttaacgtctatttgacttaaggtcctgcaccctgccacttgtaattttcagaatcactgataatctgaaataatgcagcttaaaacatgttttcttaattaaaagtataattggatggtggtcaggttgtaaatgcacacaaagtaat

SEQ ID NO: 62029 - DNA, 2673 bp, Homo sapiens
tctcgggtctcatggatggtcctcatggatgcaaccactactggtctgtggacggtctgctgaatgcccataggaggaatgcccacgtgcccctttggaactatgcagtgctccgtggccagatcttcattgtgtacttcattgcgggtgtgaaaaagctggatgcagactgggttgaaggctattccatggaatatttgtcccggcactggctcttcagtcccttcaaactgctgttgtctgaggagctgactagcctgctggtcgtgcactggggtgggctgctgcttgacctctcagctggtttcctgctcttttttgatgtctcaagatccattggcctgttctttgtgtcctacttccactgcatgaattcccagcttttcagcattggtatgttctcctacgtcatgctggccagcagccctctcttctgctcccctgagtggcctcggaagctggtgtcctactgcccccgaaggttgcaacaactgttgcccctcaaggcagcccctcagcccagtgtttcctgtgtgtataagaggagccggggcaaaagtggccagaagccagggctgcgccatcagctgggagctgccttcaccctgctctacctcctggagcagctattcctgccctattctcattttctcacccagggctataacaactggacaaatgggctgtatggctattcctgggacatgatggtgcactcccgctcccaccagcacgtgaagatcacctaccgtgatggccgcactggcgaactgggctaccttaaccctggggtatttacacagagtcggcgatggaaggatcatgcagacatgctgaagcaatatgccacttgcctgagccgcctgcttcccaagtataatgtcactgagccccagatctactttgatatttgggtctccatcaatgaccgcttccagcagaggatttttgaccctcgtgtggacatcgtgcaggccgcttggtcaccctttcagcgcacatcctgggtgcaaccactcttgatggacctgtctccctggagggccaagttacaggaaatcaagagcagcctagacaaccacactgaggtggtcttcattgcagatttccctggactgcacttggagaattttgtgagtgaagacctgggcaacactagcatccagctgctgcagggggaagtgactgtggagcttgtggcagaacagaagaaccagactcttcgagagggagaaaaaatgcagttgcctgctggtgagtaccataaggtgtatacgacatcacctagcccttcttgctacatgtacgtctatgtcaacactacagagcttgcactggagcaagacctggcatatctgcaagaattaaaggaaaaggtggagaatggaagtgaaacagggcctctacccccagagctgcagcctctgttggaaggggaagtaaaagggggccctgagccaacacctctggttcagacctttcttagacgccaacaaaggctccaggagattgaacgccggcgaaatactcctttccatgagcgattcttccgcttcttgttgcgaaagctctatgtctttcgccgcagcttcctgatgacttgtatctcacttcgaaatctgatattaggccgtccttccctggagcagctggcccaggaggtgacttatgcaaacttgagaccctttgaggcagttggagaactgaatccctcaaacacggattcttcacattctaatcctcctgagtcaaatcctgatcctgtccactcagagttctgaagggggccagatgttgggtgcagatgtagaagcagccagtcacagacccattctatgcaatggacatttatttgaaaaaaattctcaaaagttttttttttttttttgggggggcggggttctaaagctgtttttaactccgagattacaacttagaggaaccaaggaaataaagcaaataagatttaacaacccaagattaagaggccaggaagaggttagacgcaatgtgaaactgtcctcctaggataaggtttaaagtggctttttgggggctgggtgccgtggctcacgcctgtaatcccagcattttgggaggctgaggtgggcagatcacttgaggccaggagttcgagaccagcctggccaacatggcaaaaccccttctctactaaaaatacaaaaattagccagacgtggtggtgggtgcctgtaatccaactacccaggaggctgaggcatgagaatcgcttgggcccaggaggtggaggttgcagtgagccgagatcgagccactgcactcctgggcaacagagcaagacttcgtctcaaaataaataaataaagtggctcttggggaaaagcaatttaatgtaccacgatgaatagctaactgttcccaagtgtttgctatgtgcaacacaccgcgtgagcagtgttacctgcattattacattaggctgagaggtaaaataatttgcccgaagacatacagctagtgacgaatggactgatggtttgaacttaacgtctatttgacttaaggtcctgcaccctgccacttgtaattttcagaatcactgataatctgaaataatgcagcttaaaacatgttttcttaattaaaagtataattggatggtggtcaggttgtaaatgcacacaaagtaat

SEQ ID NO: 62030 - DNA, 2016 bp, Homo sapiens
cggacgcgtgggtgcccattctggctagaaaaaaatgggcagcaggcagggatctcgttgtgccattggcagtgcatgacatgtcttggaagttgataatgatgaggtgggactaatatgggggtttggggcaggtatttacacagagtcggcgatggaaggatcatgcagacatgctgaagcaatatgccacttgcctgagccgcctgcttcccaagtataatgtcactgagccccagatctactttgatatttgggtctccatcaatgaccgcttccagcagaggatttttgaccctcgtgtggacatcgtgcaggccgcttggtcaccctttcagcgcacatcctgggtgcaaccactcttgatggacctgtctccctggagggccaagttacaggaaatcaagagcagcctagacaaccacactgaggtggtcttcattgcagatttccctggactgcacttggagaattttgtgagtgaagacctgggcaacactagcatccagctgctgcagggggaagtgactgtggagcttgtggcagaacagaagaaccagactcttcgagagggagaaaaaatgcagttgcctgctggtgagtaccataaggtgtatacgacatcacctagcccttcttgctacatgtacgtctatgtcaacactacagagcttgcactggagcaagacctggcatatctgcaagaattaaaggaaaaggtggagaatggaagtgaaacagggcctctacccccagagctgcagcctctgttggaaggggaagtaaaagggggccctgagccaacacctctggttcagacctttcttagacgccaacaaaggctccaggagattgaacgccggcgaaatactcctttccatgagcgattcttccgcttcttgttgcgaaagctctatgtctttcgccgcagcttcctgatgacttgtatctcacttcgaaatctgatattaggccgtccttccctggagcagctggcccaggaggtgacttatgcaaacttgagaccctttgaggcagttggagaactgaatccctcaaacacggattcttcacattctaatcctcctgagtcaaatcctgatcctgtccactcagagttctgaagggggccagatgttgggtgcagatgtagaagcagccagtcacagacccattctatgcaatggacatttatttgaaaaaaattctcaaaagttttttttttttttttgggggggcggggttctaaagctgtttttaactccgagattacaacttagaggaaccaaggaaataaagcaaataagatttaacaacccaagattaagaggccaggaagaggttagacgcaatgtgaaactgtcctcctaggataaggtttaaagtggctttttgggggctgggtgccgtggctcacgcctgtaatcccagcattttgggaggctgaggtgggcagatcacttgaggccaggagttcgagaccagcctggccaacatggcaaaaccccttctctactaaaaatacaaaaattagccagacgtggtggtgggtgcctgtaatccaactacccaggaggctgaggcatgagaatcgcttgggcccaggaggtggaggttgcagtgagccgagatcgagccactgcactcctgggcaacagagcaagacttcgtctcaaaataaataaataaagtggctcttggggaaaagcaatttaatgtaccacgatgaatagctaactgttcccaagtgtttgctatgtgcaacacaccgcgtgagcagtgttacctgcattattacattaggctgagaggtaaaataatttgcccgaagacatacagctagtgacgaatggactgatggtttgaacttaacgtctatttgacttaaggtcctgcaccctgccacttgtaattttcagaatcactgataatctgaaataatgcagcttaaaacatgttttcttaattaaaagtataattggatggtggtcaggttgtaaatgcacacaaagtaat

SEQ ID NO: 62031 - DNA, 1830 bp, Homo sapiens
cggggcggagcctagggaagcaaattctcctggcggcctccgttcagacgcggcagctgtgacccacctgcctcctccgcagagcaatggcggtgtctgccgggtccgcgcggacctcgcccagctcagataaagtacagaaagacaaggctgaactgatctcagggcccaggcaggacagccgaatagggaaactcttgggttttgagtggacagatttgtccagttggcggaggctggtgaccctgctgaatcgaccaacggaccctgcaagcttagctgtctttcgttttctttttgggttcttgatggtgctagacattccccaggagcgggggctcagctctctggaccggaaataccttgatgggctggatgtgtgccgcttccccttgctggatgccctacgcccactgccacttgactggatgtatcttgtctacaccatcatgtttctgggggcactgggcatgatgctgggcctgtgctaccggataagctgtgtgttattcctgctgccatactggtatgtgtttctcctggacaagacatcatggaacaaccactcctatctgtatgggttgttggcctttcagctaacattcatggatgcaaaccactactggtctgtggacggtctgctgaatgcccataggaggaatgcccacgtgcccctttggaactatgcagtgctccgtggccagatcttcattgtgtacttcattgcgggtgtgaaaaagctggatgcagactgggttgaaggctattccatggaatatttgtcccggcactggctcttcagtcccttcaaactgctgttgtctgaggagctgactagcctgctggtcgtgcactggggtgggctgctgcttgacctctcagctggtttcctgctcttttttgatgtctcaagatccattggcctgttctttgtgtcctacttccactgcatgaattcccagcttttcagcattggtatgttctcctacgtcatgctggccagcagccctctcttctgctcccctgagtggcctcggaagctggtgtcctactgcccccgaaggttgcaacaactgttgcccctcaaggcagcccctcagcccagtgtttcctgtgtgtataagaggagccggggcaaaagtggccagaagccagggctgcgccatcagctgggagctgccttcaccctgctctacctcctggagcagctattcctgccctattctcattttctcacccagggctataacaactggacaaatgggctgtatggctattcctgggacatgatggtgcactcccgctcccaccagcacgtgaagatcacctaccgtgatggccgcactggcgaactgggctaccttaaccctggggtatttacacagagtcggcgatggaaggatcatgcagacatgctgaagcaatatgccacttgcctgagccgcctgcttcccaagtataatgtcactgagccccagatctactttgatatttgggtctccatcaatgaccgcttccagcagaggtgggcaaggggagcagagagtgggaaaaaatgaagcacagttctttttaccaagatgaacagcccttgcttcctggtattgtcttgcttaaaaagctgtccttcctctagtgcatgtcccccttgatctggttgtgggcatagctggttgcttccagcagggggcaccatcatccaggagaaaagtgagttgacttgttcttttagacactgttgacataataccttctcaggtagctactaacccccattatacccagtgctccagatctcttctgccttctttctctgccctggactggcaa

SEQ ID NO: 62032 - DNA, 1515 bp, Homo sapiens
cggggcggagcctagggaagcaaattctcctggcggcctccgttcagacgcggcagctgtgacccacctgcctcctccgcagagcaatggcggtgtctgccgggtccgcgcggacctcgcccagctcagataaagtacagaaagacaaggctgaactgatctcagggcccaggcaggacagccgaatagggaaactcttgggttttgagtggacagatttgtccagttggcggaggctggtgaccctgctgaatcgaccaacggaccctgcaagcttagctgtctttcgttttctttttgggttcttgatggtgctagacattccccaggagcgggggctcagctctctggaccggaaataccttgatgggctggatgtgtgccgcttccccttgctggatgccctacgcccactgccacttgactggatgtatcttgtctacaccatcatgtttctgggggcactgggcatgatgctgggcctgtgctaccggataagctgtgtgttattcctgctgccatactggtatgtgtttctcctggacaagacatcatggaacaaccactcctatctgtatgggttgttggcctttcagctaacattcatggatgcaaaccactactggtctgtggacggtctgctgaatgcccataggaggaatgcccacgtgcccctttggaactatgcagtgctccgtggccagatcttcattgtgtacttcattgcgggtgtgaaaaagctggatgcagactgggttgaaggctattccatggaatatttgtcccggcactggctcttcagtcccttcaaactgctgttgtctgaggagctgactagcctgctggtcgtgcactggggtgggctgctgcttgacctctcagctggtttcctgctcttttttgatgtctcaagatccattggcctgttctttgtgtcctacttccactgcatgaattcccagcttttcagcattggtatgttctcctacgtcatgctggccagcagccctctcttctgctcccctgagtggcctcggaagctggtgtcctactgcccccgaaggttgcaacaactgttgcccctcaaggcagcccctcagcccagtgtttcctgtgtgtataagaggagccggggcaaaagtggccagaagccagggctgcgccatcagctgggagctgccttcaccctgctctacctcctggagcagctattcctgccctattctcattttctcacccagggctataacaactggacaaatgggctgtatggctattcctgggacatgatggtgcactcccgctcccaccagcacgtgaagatcacctaccgtgatggccgcactggcgaactgggctaccttaaccctggggtatttacacagagtcggcgatggaaggatcatgcagacatgctgaagcaatatgccacttgcctgagccgcctgcttcccaagtatcaaagtagatctggggctcagtgacattatacttgggaagcaggcggctcaggca

SEQ ID NO: 62033 - DNA, 1952 bp, Homo sapiens
cggggcggagcctagggaagcaaattctcctggcggcctccgttcagacgcggcagctgtgacccacctgcctcctccgcagagcaatggcggtgtctgccgggtccgcgcggacctcgcccagctcagataaagtacagaaagacaaggctgaactgatctcagggcccaggcaggacagccgaatagggaaactcttgggttttgagtggacagatttgtccagttggcggaggctggtgaccctgctgaatcgaccaacggaccctgcaagcttagctgtctttcgttttctttttgggttcttgatggtgctagacattccccaggagcgggggctcagctctctggaccggaaataccttgatgggctggatgtgtgccgcttccccttgctggatgccctacgcccactgccacttgactggatgtatcttgtctacaccatcatgtttctgggggcactgggcatgatgctgggcctgtgctaccggataagctgtgtgttattcctgctgccatactggtatgtgtttctcctggacaagacatcatggaacaaccactcctatctgtatgggttgttggcctttcagctaacattcatggatgcaaaccactactggtctgtggacggtctgctgaatgcccataggaggaatgcccacgtgcccctttggaactatgcagtgctccgtggccagatcttcattgtgtacttcattgcgggtgtgaaaaagctggatgcagactgggttgaaggctattccatggaatatttgtcccggcactggctcttcagtcccttcaaactgctgttgtctgaggagctgactagcctgctggtcgtgcactggggtgggctgctgcttgacctctcagctggtttcctgctcttttttgatgtctcaagatccattggcctgttctttgtgtcctacttccactgcatgaattcccagcttttcagcattggtatgttctcctacgtcatgctggccagcagccctctcttctgctcccctgagtggcctcggaagctggtgtcctactgcccccgaaggttgcaacaactgttgcccctcaaggcagcccctcagcccagtgtttcctgtgtgtataagaggagccggggcaaaagtggccagaagccagggctgcgccatcagctgggagctgccttcaccctgctctacctcctggagcagctattcctgccctattctcattttctcacccagggctataacaactggacaaatgggctgtatggctattcctgggacatgatggtgcactcccgctcccaccagcacgtgaagatcacctaccgtgatggccgcactggcgaactgggctaccttaaccctggggtgagatgtctgatgctgacaatttactgttcttcagagcccccttgtgctttggggtctggttttgtcttacacacaccataaagcaaaacaaatttgagtctgctttgccttttctcaagagccagattgaactatcttttatgtgggttgagatagggcaatgcattcatttccttgaactgatgggagaagatgcgcgcagtctggctcccatcaggtagtttctcttatgcctggagaacttcctttaacatttcttttagagcacgtctgctggctacagattttagtttagtttagttttcctgcatctgagaatgtctttatgaccttaattcctaaaagatatttttgctgaatatagaatttcagactgatagtcttttttttttccccctccagcacttcggaagatgcttggatggtttctgatgggacgaagaccgcgtctggctcccatcagagagccatccctcagacttccagggtggccctactagcacctcaatcgacaacatggatggaacccctgtacgggatgaacggagtgggacacccaccaggatgagatgatgg

SEQ ID NO: 62034 - DNA, 560 bp, Homo sapiens
tgaagtgaaaatggcgtgagggtgtgagagaggtttgggttaggaaacatgtttttagtgctatttccaaccaggggtcgcaaactcagcagcctgtagaaacaggggtgggaggtggggcggcagctgtgacccacctgcctcctccgcagagcaatggcggtgtctgccgggtccgcgcggacctcgcccagctcagggttcttgatggtgctagacattccccaggagcgggggctcagctctctggaccggaaataccttgatgggctggatgtgtgccgcttccccttgctggatgccctacgcccactgccacttgactggatgtatcttgtctacaccatcatgtttctgggtgaggggaactgtgggaaatattgactggcctgccagaaacacagaaatagaagcatgctggtgaatggtcaaagtctttggcaccttatttcacttctgctgtgatcaatttcatgctgttgacctgtgtgtcacttaagctgtgatcccataattctttttaaaatattaaaataacatttaattttcaaaaagtttta

SEQ ID NO: 62035 - DNA, 655 bp, Homo sapiens
cgagagggcgtctcgctctgtcgcccaggctgcagtgcagtggtgcaatcttggctcactgcaagctccacctcccgggttcacgccattctccggcatcagcctcccgagtagctgggagccaaggtgggcagatcacttgagcctaggaggccgaggctgcagtgagctaaggtggagccactgcactccagcctaggtgagagcacagaccctgtctcaaaaacaaacaaacaaacaaacaaacaaacaaaacaataacaagtgttggcaaggatgtggagaagaactctcatacattgctggtggaagtgtaaaatggtacagctacttcaatttataggaaaggtccagaatatgcaaatttgtagaagcagaaagtagattcatggttgcttagggctacaaggagggttagggaagaatagggagtgactgctattgggtatagggtttctttcagggggaacacaatattctaaagttagattgtgatgatggttgtacaaccctatgattataccagaaaacatgaactgtacactttaagtggatgaactgtatcatatataaatgattatggcctccttggccccagcagtttttgagcaagctgctttctccaaccagttccacacagaattaatgtggtgat

SEQ ID NO: 62036 - DNA, 660 bp, Homo sapiens
ataccgtcaagttcgctacaggagagattactagatctttccaagaacattgggtctatctcacagtcctaggtgtcaaaaggaaaagagaaaagcaaggtgtcaaaaggaaaaaagaggaaacttgagaaaaataggtgtctaatctctttgttaatagccaatttctaggagccaggtatggactatgtgatttttatggcatctacatataatgttgctttcttcctcacttaagttcagaagcagtaggagaccgaggagtcaagaggtgaggaacaaaatgtcagcttattacagataaagctgtttagagaacgtggcttgggcatgcaggcaaatggaactgctaacactgatcctcagagttggacagccttacctttgcaatcacaggtagatggataaacacagacctctcccctctgactcctgggacagaacatgtcttcacaggtagctgatcccaggttgagagagggctcccctcttcatactcaccaatcattcagtccaggtttgttgctctgatggaggccaccccaacccccagccccttttcaaatgtgcaccacagtagggaatgaggccaggacctgagacctggctgcctggtgggtagaccctggaatgtacaagcaaacagcccctaatgccagg

SEQ ID NO: 62037 - DNA, 600 bp, Homo sapiens
ctgcttccctcaaggtattacccagcctgtattttatagatcactaaaaagcactgagccctgccgctgcagggctggagcggaccaccttgtcctgtatagccatcagacttaattgcaggaaacctaaacagtgttaagtatgcaagctgagagcataaagttattttattaaaagaagaaagcaatggttattaccaaccaggccttgtcacccatttcagatggctctggcaagcaattaacaaagctcctacacttcctctcctcgatgagctggctctgttactgggctggtggtgaaggaactggaagatcctcctctctgcgggccaacgaggcagagcctccttgatttactaccctggcaattcctttacagtcacaaagtggtgggatccagatgaatccccggccaccgccagatcaaacgctaaggtggccaccaggcatggcctcgcgtactcactttcatcctgggcgactgtcgtaagcgttcagtctgtcattgaattattccatcagcttctttgctagagtgggttttctggaatggttctgttttagagaactagttacagtgactccatgagcctgcct

SEQ ID NO: 62038 - DNA, 323 bp, Homo sapiens
aaaagaaaagaaaaaaaagttgtatcaccagatgaggataggtgtgtttcataaaacaggcagtgaactgaagtagctggtacatgtttgaggtgtgtgcagatatacattttgtgtattcctacatggctgggttttgttgggtgcagttttttgcatccatctagagtctctcacagataaaatcatgcataagcaaatgccaagttgtgttgtgctcaaattgttcctttaacgtacaaatcatgttgaaacagttccagcaagcgttatagcagaactgatgattctcttgatctgaattttgaggcccatccaaaaaa

SEQ ID NO: 62039 - DNA, 486 bp, Homo sapiens
tttaagatattcaagaaagttgattcattctcaagtcaaaccttatgaaatcatgtttttggcacctttttctagtttcttaacctcctccaggatccaacagttccaagattgcaatacatcatcagtgtgtctgcgggtaggggaggtagagaacagcggcaggaggagaatagacaggaggggaaaagggagcacctctcttctctacccacttgataaacataatattgaaatttggtcaaatcataagaagtccatcaatcagccacatgaaaagttttccttctctaacagtgttgggggtatttgccaaattactttagaaagaactgaaattgtctaccacagttgaggaaggtaattacatatacaattttcttttcttttctttcttttttttttttttgagacagagtctcactctgttgcccaggctggagtgtagtggcactatcacagcttagcaacctccacctccctggc

SEQ ID NO: 62040 - DNA, 385 bp, Homo sapiens
aaatctgagcagtgcacctgactgttcattgcttggaaggagaaatagccaaatagttgattatataccagttcaagggctgtgacctatggtttggctagatggccaggaacctagaagtaatgtgattggaaaattgtcttcccacataagctaccatgatcccgtaaagaatcatgcttgcttttgcaccaatgattcccccaacaaccgaagtaatatctgatgcatgttcggtactcaaagaaatatgtgtgaacatcatgaatcagttaatggacaaacccactctaatctggcttccttccaaatcatgcacatgaaactgttgcatgtttccaaatccaatagacacatttctctatacatgttattccatttccca

SEQ ID NO: 62041 - DNA, 1614 bp, Homo sapiens
  misc_feature (3)..(3): n is a, c, g, or t
  misc_feature (5)..(5): n is a, c, g, or t
  misc_feature (7)..(7): n is a, c, g, or t
ggnanangggaatcaggttttgaaactgacttccagagctccactgcctccctgcaccatgccctacaacttctgcctgcccagcctgagctgccgcaccagctgctcctcccggccctgtgtgccccccagctgccacggctacaccctgcccggggcctgcaacatccctgccaatgtgagcaactgcaactggttctgcgagggctccttcaatggcagcgagaaggagactatgcagttcctgaacgaccgcctggccagctacctggagaaggtgcgtcagctggagcgggacaacgcggagctggagaacctcatccgggagcggtctcagcagcaggagcccttgctgtgccccagctaccagtcctacttcaagaccattgaggagctccagcagaagatcctgtgcagcaagtctgagaatgccaggctggtggtgcagatcgacaatgccaagctggctgcagatgacttcagaaccaagtaccagacggagcagtccctgcggcagctggtggagtccgacatcaacagcctgcgcaggattctggatgagctgaccctgtgcaggtctgacctggaggcccagatggagtccctgaaggaggagctgctgtccctcaagcagaaccatgagcaggaagtcaacaccttgcgctgccagcttggagaccgcctcaacgtggaggtggacgctgctcccgctgtggacctgaaccaggtcctgaacgagaccaggaatcagtatgaggccctggtggaaaccaaccgcagggaagtggagcaatggttcgccacgcagaccgaggagctgaacaagcaggtggtatccagctcggagcagctgcagtcctaccaggcggagatcatcgagctgagacgcacagtcaatgccctggagatcgagctgcaggcccagcacaacctgcgatactctctggaaaacacgctgacagagagcgaggcccgctacagctcccagctgtcccaggtgcagagcctgatcaccaacgtggagtcccagctggcggagatccgcagtgacctggagcggcagaaccaggagtatcaggtgctgctggacgtgcgggcgcggctggagtgtgagatcaacacataccggagcctgctggagagcgaggactgcaagctgccctccaacccctgcgccaccaccaatgcatgtgaaaagcccattggatcctgtgtcaccaatccttgtggtcctcgttcccgctgtgggccttgcaacacctttgggtactagataccctggggccagcagaagtatagcatgaagacagaactaccatcggtgggccagttctgcctctctgacaaccatcagccaccggaccccaccccgaggcatcaccacaaatcatggtctggaaggagaacaaatgcccagcgtttgggtctgactctgagcctagggctacttgatcctcctcaccccaggtccctctcctgtagtcagtctgagttctgatggtcagaggttggagctgtgacagtggcatacgaggtgttttgttctctctgctgcttctacctttattgcagttccccaaatcgcctaataaactttcctcttgcaaagcagac

SEQ ID NO: 62042 - DNA, 1626 bp, Homo sapiens
tttttcaaaattttaataacttctttccaagattttatatttgttaagcacattgccaatccttagttatttataaacttcaacttaaatgtactgataatcccattacagcaggcagttgcctacagctattacctttatttcttctttagcagtaccttagtttgatctgatagtggcaaggatccctcttcctcaaagagattaggaccttaccccaactccagaggttgcaccttcattgatctgaaacagaagtggtagtttaattctgtatagtctgattagtacgaggcagaactttttgcagtgaaggaaatcaaccatccattctgtctctctattgtggtagctactaaccatatgtgatattgagtacttgatatgtgactactgcaattgagaaattgaatgaaatgaacagaaccctactgagaagggctttcctttcaaattaaaaaatcagagctttgtgtggtaacagtcattgcctctttctcctctttctggccaacagcatgcctaaaggtgcagctgccatcaaacaaccatgaaacagcaaatgtgagaatgaaagttacatttcagagatagaactgaaggaggattaaggggatcctgggtccctgatatggcattgttgaacacccaaatcaagatgagcaattgccaaactccccaattattaaatgagaaaaaataaactccagattgtttaagacactgtttggtttcctgttactttagccatgtatgtttctgactaatatatctgcttatctactcttcaacattttttaagtgtaaaactcttattttagacatgtcagggatgctatttcagaatctaatcatttaaagcaaggagataattccatataacgaaagaagtaatgtcttagtgcagctcagctcctagcattctaagccaacagaggtgaaaaggggacatatttacacagcttaaccataaaaataatactgatttgggggcacaagaggatgtagagaaaaatataaagggaagaccagtattttagtatgctgcaagcatatacttcaactttttattgacaaatatttcaattaatctttttgtcttatatactgtagcccacatatcatcaaagtaacttcattttaattcatttcatagaaccataggattttagacaggactttggagatgattttgttgtacttcattttaagatgaggatatctgaggttcagataaattaacctcttgtgttacagagcatggaccagacccaggatgtcaggggtttccaagtcagcattttttctggtatcctctgctgcatctggctatcttgtgatgttctaattttagagtgacaaaaatgagaaccagttatatgcaaggatcatagcttgttagcagatcagggattataattcagatgttctgatttgtaaaacaatttttaattaaataaaaaggtaaattatattttaatttaaattgtgtttaaattatttaagatgttatttcatttacagtaaatatgagaacgatttcaaaatatttagaatataatataatgccattttgctccctccccctctgcccccatcgttaaaactcttgctgttttccattta

SEQ ID NO: 62043 - DNA, 310 bp, Homo sapiens
tattaaatttactagaatgttacagttacaaatttggtaatgttctttctgaaaaacagcctaattttgcagcctgaaacttgactgaaaatctcaatacttttattcatgatagaaaaataattcctggcttcatctcacaattaactaataattatgttaatataaaataaactgtgccctttctttacagtgatgatcaaagtgattctcccaggccaaaaaatcaaataagaagttaattttaaaaagacaaaacaagccattctacccagtgggcatcttcagtgtactccctctactaattggc

SEQ ID NO: 62044 - DNA, 331 bp, Homo sapiens
actaatcagtaacttatcaattacttgtaatcagtaactaaatctaccatacaccaaatataattgggagcacattagaattactgttcaaactagtcagtataatgtatcatctcaccttctccaaaggtctttttgtctttataataacctattttttattttatatatagttcattctgagaaaagcttaataatatagaatgcttactattttttaaaaggcagaagaggaactcaagaaggaagaaaaaagattttctttctaaactactctgcaggactatagaatgatatctttggtcctaagatttaacagtatattaagagt

SEQ ID NO: 62045 - DNA, 528 bp, Homo sapiens
ctctcgctcctccctttctagttccctttcagacatgcgcagtgcggccgtccctagaggcgggttaacggccgcggacctggcagttctcaggcttctccaagggagaagcccccttgccagggtctcgatttcccgccaaccaacaaaggttcatttgcctcttatggcctgcgcgggagggttgccatgttttttagattaagtactgcacgactactcgcttctgaaactgtcataagaaactgcctcagctccctgcagggtggacacacaagagcagaatctccgtgggacatctctttggagcatcaatattactacagtatttggaagacacaaatttaaataatttctaaggtaaagaatggaacatttaagacaaggctggaaagtcatctgcctttaataactcatctgtgcctcacatgtcagactttctccaagaaaaaaactaaggagaacttatttccattcttataagtagtaaaaataataaatcatatcaagtcaattgaaagtcctgtc

SEQ ID NO: 62046 - DNA, 782 bp, Homo sapiens
agcccgtccctagcggtggggtaaaggtcctgcccttttacacatgcggagtgcacccgttcctaggggtggggctaacgggcctaccgtttcagacatgctcagtgcagcctgtccttaggcgtagggtaatggtgggcgacctggcagttcttgggctccttgggatcccctcgagaagcccccttgttagtgtatgaaaccgtcagttcactgccagtaatgaaaacatcgtgtccttagtcacctgccattagccttttcgaaaccattttttctgttccctaagctgtcacaaatcctcctctgcatcccaggagtgccgcttggtcctcgggctcgcagcgtggcccacacctgggtcgggcctctcacggggacgctcccgccactgtgataaagaggagaaaacgtcacaggggaagggcctgaccctgctgcatccattttttagattaagtactgcacgactactcgcttctgaaactgtcataagaaactgcctcagctccctgcagggtggacacacaagagcagaatctccgtgggacatctctttggagcatcaatattactacagtatttggaagacacaaatttaaataatttctaaggtaaagaatggaacatttaagacaaggctggaaagtcatctgcctttaataactcatctgtgcctcacatgtcagactttctccaagaaaaaaactaaggagaacttatttccattcttataagtagtaaaaataataaatcatatcaagtcaattgaaagtcctgtc

SEQ ID NO: 62047 - DNA, 557 bp, Homo sapiens
gccgcggtttctgtatagaaggaggggatagacgaaaagaaagaaagacccgcccattcgcctcttatggcctgcgcgggagggttgccatggagtgccgcttggtcctcgggctcgcagcgtggcccacacctgggtcgggcctctcacggggacgctcccgccactgtgataaagaggagaaaacgtcacaggggaagggcctgaccctgctgcatccattttttagattaagtactgcacgactactcgcttctgaaactgtcataagaaactgcctcagctccctgcagggtggacacacaagagcagaatctccgtgggacatctctttggagcatcaatattactacagtatttggaagacacaaatttaaataatttctaaggtaaagaatggaacatttaagacaaggctggaaagtcatctgcctttaataactcatctgtgcctcacatgtcagactttctccaagaaaaaaactaaggagaacttatttccattcttataagtagtaaaaataataaatcatatcaagtcaattgaaagtcctgtc

SEQ ID NO: 62048 - DNA, 389 bp, Homo sapiens
gcttcccaggcctcatggtactagtgtggacctcctggctgtgattaatgcagttttttagattaagtactgcacgactactcgcttctgaaactgtcataagaaactgcctcagctccctgcagggtggacacacaagagcagaatctccgtgggacatctctttggagcatcaatattactacagtatttggaagacacaaatttaaataatttctaaggtaaagaatggaacatttaagacaaggctggaaagtcatctgcctttaataactcatctgtgcctcacatgtcagactttctccaagaaaaaaactaaggagaacttatttccattcttataagtagtaaaaataataaatcatatcaagtcaattgaaagtcctgtc

SEQ ID NO: 62049 - DNA, 657 bp, Homo sapiens
ctctcgctcctccctttctagttccctttcagacatgcgcagtgcggccgtccctagaggcgggttaacggccgcggacctggcagttctcaggcttctccaagggagaagcccccttgccagggtctcgatttcccgccaaccaacaaaggttcatttgcctcttatggcctgcgcgggagggttgccatggagtgccgcttggtcctcgggctcgcagcgtggcccacacctgggtcgggcctctcacggggacgctcccgccactgtgataaagaggagaaaacgtcacaggggaagggcctgaccctgctgcatccattttttagattaagtactgcacgactactcgcttctgaaactgtcataagaaactgcctcagctccctgcagggtggacacacaagagcagaatctccgtgggacatctctttggagcatcaatattactacagtatttggaagacacaaatttaaataatttctaaggtaaagaatggaacatttaagacaaggctggaaagtcatctgcctttaataactcatctgtgcctcacatgtcagactttctccaagaaaaaaactaaggagaacttatttccattcttataagtagtaaaaataataaatcatatcaagtcaattgaaagtcctgtc

SEQ ID NO: 62050 - DNA, 3106 bp, Homo sapiens
  misc_feature (3085)..(3085): n is a, c, g, or t
  misc_feature (3094)..(3094): n is a, c, g, or t
ggcacgagggagacacgggagcgcttggcacgcggagccagagccggagctgcagccgcagcgggagccgggggagctcaggggccgcaggagccgggccggagtgagcgcacctcgcggggccctcggggcaggtgggtgagcgccacccggagtcccgcgcgcaactttcagggcgcactcggcggggcggctgcgcggctgccgggactcggcgcgggactgcatggaggccaaggagaagcagcatctgttggacgccaggccggcaatccggtcatacacgggatctctgtggcaggaaggggctggctggattcctctgccccgacctggcctggacttgcaggccattgagctggctgcccagagcaaccatcactgccatgctcagaagggtcctgacagtcactgtgaccccaagaaggggaaggcccagcgccagctgtatgtagcctctgccatctgcctgttgttcatgatcggagaagtcgttgagatcttgggagccctggtctctgtactgtccatctgggtcgtgacgggggtactggtgtacctggctgtggagcggctgatctctggggactatgaaattgacggggggaccatgctgatcacgtcgggctgcgctgtggctgtgaacatcataatggggttgacccttcaccagtctggccatgggcacagccacggcaccaccaaccagcaggaggagaaccccagcgtccgagctgccttcatccatgtgatcggcgactttatgcagagcatgggtgtcctagtggcagcctatattttatacttcaagccagaatacaagtatgtagaccccatctgcaccttcgtcttctccatcctggtcctggggacaaccttgaccatcctgagagatgtgatcctggtgttgatggaagggacccccaagggcgttgacttcacagctgttcgtgatctgctgctgtcggtggagggggtagaagccctgcacagcctgcatatctgggcactgacggtggcccagcctgttctgtctgtccacatcgccattgctcagaatacagacgcccaggctgtgctgaagacagccagcagccgcctccaagggaagttccacttccacaccgtgaccatccagatcgaggactactcggaggacatgaaggactgtcaggcatgccagggcccctcagactgactgctcagccaggcaccaactggggcatgaacaggacctgcaggtggctggactgagtgtcccccaggcccagccaggactttgcctaccccagctgtgttataaaccaggtccccctcctgacctctgccccactccaggaatggagctcttcccagcctcccatctgactacagccagggtggggactcagcgggtataaagctagtgtgaccctgctcttccagctcctgggccagctctggaagggctgtatttgggcctaatcctcagcaactgttctaccactcgcaggggcaaaggtggtgagccacgggacgtccaaggggaggctggccccagcgcgcccatactgcctgcctcatgccccattctcagcctggctggcctttgcctttatgaatctgagcccctccatctgcctatagcaataggcacgggggtgaggaccctcacactctcatttgagcctccctgaggcagggagccaggaggcacctgaggcctatctgtgccttagtcacttcagctatgagccaaatgttccctttcctggaggggagaggcttcttactaggtaagagacaggtttcctctttccttatttcctcagctgtgccaacacaaaaaacaactttggcacaggtggtgggcagggggtagagagatttcagcttgggttctgcactaacagcctccaagccccctggcacttctgttgccctgagagtgtcccaggggattcagagtctccagaaagatatggctgggccaactctgttgcctacctggcctgacccagtcggagcctgacatggtggagggaaagggagacaagtggggctgcactcggtccagaggccagctaggagggaaaccgcagcttcctggggcttgtgtgtgaagattcctgacttaggggtggcttttgtttacaagatgcaagaggggaaacctgtccccgactcatcgagacaacatgcccagttatcagggagtcctgtgtcacaaggtctgtctctgccattgtaagcaagtgccttgggcgagctggcctctgccccacagtctcatctgtacaccgacagggttgatgcctccctcacagggttgagaacaagagccagttggccaagtacctgtggttgttgaagattggttacttttaccatcctggggacagggaactctgtggcccgaggctgcctcactgaggagtcaggtgggcttcccagcctccccaggggcagtgctgagtttgtcttgactgttctggcccaaggtgggaggaggtgggtttggtcacttgcctcccactttaaatctctgtctttccatctgtgaaatgacctctttgtgccttcccagcactgtcatcctgatcgcctgtgttctaggtagatgggtccttcagcccctccaggtctgtgaaaagtctgtggaaagcactggcctggagaggggtggggggttgctggtgggtgctccattccaccacaatctcaggggactcaacctcccctacccaactccccacccccacccaagccatggcaggccccaggaacttgatcctgggctttgccgtatgccaagtccttacacccctctcaagagacagtcattggctgggcacggtggctcatgcctgcaatcccagcaccttgggaggctgaggcaggcagatgacttgaggccaggagttcgagaccagcctggccaatatggcgaaacctcatttctactaaaaatacaaaaactagccaggcgtggtggcttgtgcctgtaatcccagctactcgggaggctgaggcaggagaatcgcttgaaccggggaggcagaggttgcagtgagctgagatcacaccactgcactccagcctgggngacagagcnagactccagctt

SEQ ID NO: 62051 - DNA, 1417 bp, Homo sapiens
ggcacgagggagacacgggagcgcttggcacgcggagccagagccggagctgcagccgcagcgggagccgggggagctcaggggccgcaggagccgggccggagtgagcgcacctcgcggggccctcggggcaggtgggtgagcgccacccggagtcccgcgcgcaactttcagggcgcactcggcggggcggctgcgcggctgccgggactcggcgcgggactgcatggaggccaaggagaagcagcatctgttggacgccaggccggcaatccggtcatacacgggatctctgtggcaggaaggggctggctggattcctctgccccgacctggcctggacttgcaggccattgagctggctgcccagagcaaccatcactgccatgctcagaagggtcctgacagtcactgtgaccccaagaaggggaaggcccagcgccagctgtatgtagcctctgccatctgcctgttgttcatgatcggagaagtcgttgagatcttgggagccctggtctctgtactgtccatctgggtcgtgacgggggtactggtgtacctggctgtggagcggctgatctctggggactatgaaattgacggggggaccatgctgatcacgtcgggctgcgctgtggctgtgaacatcataatggggttgacccttcaccagtctggccatgggcacagccacggcaccaccaaccagcaggaggagaaccccagcgtccgagctgccttcatccatgtgatcggcgactttatgcagagcatgggtgtcctagtggcagcctatattttatacttcaagccagaatacaagtatgtagaccccatctgcaccttcgtcttctccatcctggtcctggggacaaccttgaccatcctgagagatgtgatcctggtgttgatggaagggacccccaagggcgttgacttcacagctgttcgtgatctgctgctgtcggtggagggggtagaagccctgcacagcctgcatatctgggcactgacggtggcccagcctgttctgtctgtccacatcgccattgctcagaatacagacgcccaggctgtgctgaagacagccagcagccgcctccaagggaagttccacttccacaccgtgaccatccagatcgaggactactcggaggacatgaaggactgtcaggcatgccagggcccctcagactgactgctcagccaggcaccaactggggcatgaacaggacctgcaggtggctggactgagtgtcccccaggcccagccaggactttgcctaccccagctgtgttataaaccaggtccccctcctgacctctgccccactccaggaatggagctcttcccagcctcccatctgactacagccagggtggggactcagcgggtataaagctagtgtgaccctgc

SEQ ID NO: 62052 - DNA, 715 bp, Homo sapiens
ggcacgagggagacacgggagcgcttggcacgcggagccagagccggagctgcagccgcagcgggagccgggggagctcaggggccgcaggagccgggccggagtgagcgcacctcgcggggccctcggggcaggtgggtgagcgccacccggagtcccgcgcgcaactttcagggcgcactcggcggggcggctgcgcggctgccgggactcggcgcgggactgcatggaggccaaggagaagcagcatctgttggacgccaggccggcaatccggtcatacacgggatctctgtggcaggaaggggctggctggattcctctgccccgacctggcctggacttgcaggccattgagctggctgcccagagcaaccatcactgccatgctcagaagggtcctgacagtcactgtgaccccaagaaggggaaggcccagcgccagctgtatgtagcctctgccatctgcctgttgttcatgatcggagaagtcgttgagatcttgggagccctggtctctgtactgtccatctgggtcgtgacgggggtactggtgtacctggctgtggagcggctgatctctggggactatgaaattgacggggggaccatgctgatcacgtcgggctgcgctgtggctgtgaacatcataatcggggttgacccttcatacgtcgtctgccacagtgtcctgcctcataagcatcctctagat

SEQ ID NO: 62053 - DNA, 228 bp, Homo sapiens
agcagtagctattatggctattttatttaccctgaaaagcaactgttcatagtatcacaaggcaggcaggggtagggggcaataaaagcatttgtggcaaggatccagttatttgcaggcttctcttctgtctggctttgtttactgtcatgcaggaaaagtgccttcaccagggcacagcagtaaacctgttggctactctagtcctgcctgggttcccaggaaatt

SEQ ID NO: 62054 - DNA, 210 bp, Homo sapiens
  misc_feature (1)..(1): n is a, c, g, or t
nggagaatcactcgaacccgggacgcagaggttgcagtgagccgagatcacgacattgcactccagcctggatgacagagtgagactccatcccaaaaaaaaaaaaaaaatgttatctgttacagtgattttacaaatgtccttctaatcatcctttgtatttccttactagtctaaatagcaaaggatatccttatttctgtgttacaa

SEQ ID NO: 62055 - DNA, 544 bp, Homo sapiens
tccctccacctaaattatcaacacaaaactgtaaaacagagatatttggtcaacctgtatttattgggaattgcttgcaaacatcctgaactatagtaagtgttagaaggcaaacaagaagataagaacaactctagcttgaagaactgtgtgatgtcactgaggagcaaagtggcactcagagaaccactgcagaattatcaaatcctaaacttactgggcagtatgtgatgttagagtttggagaagtgcttgatgaatttgggctggtgtagttgagtacacttctcctgagcaagagcgtgagctgagccatgaagcattggtaggaccctggagacattgagaagtgatgctataaggtatcttaaaagtcaatgaagatgtttgtgctcaagtcaggagcaaatgcatgtttcactttgttggttggtgctgctataacaaaacatcacagactgggtaatttctaaagaacagaaatttatttttcattgttctggagactgggaattttcagacttgggaaatgtcacatgaaggc

SEQ ID NO: 62056 - DNA, 313 bp, Homo sapiens
taaactatagacttccaatagcaagcctctgtgccttcctcttaccactaagcaagcatgggtattaattcctactgaaaggcttatgctatcttttttccagaaatggaagaaaaatgaactatgaaaaagatcattttataggtcagctaccattatgagattgttgaggaaatgatataaaaaacaatttttatcaaattatctttagggcatttatatgtttattttcttactgtgttgatttaggtgactataagaagttgtatcagagcaactgattctggtgaattaaagcaagtatttctaagaa

SEQ ID NO: 62057 - DNA, 309 bp, Homo sapiens
aaaataagtagtttggactaaaatccagttgatctgcgaatggccagttgacctgggtccagtttcccccccgtcccgcccccagcctcaactgcttcagagaagagccatgttcccatttaatgcttgaggaacctgagccagagggataggtggagtcacagaccttgaggaccttggccaagattcttggggtgggggactgggttggtggcctggatgaattcccaattaggaaattacattctaagtcccggctgcctccattccctgtggggtgcgattgtcagtcacagcttggccttctac

SEQ ID NO: 62058 - DNA, 309 bp, Homo sapiens
agaaggtggctgccggggcccctctggctgaaaggaacagcccacctcttgacagataagggaccgcggatccaggttgggtcaccaaaagtgctcacgagccctcatgtgctgcggaggagccccactcacgcttagggcctcgactgggatttgactgggctggaattcccagtcacttccctacaccctgcggctcctaaaagctagccagccgtgtgtctgtctttcgagggaccaggtgaccgcctgtgctgggtgtgaggtgcagcctctccaacaggtcgatgaattatcctccagggcaaa

SEQ ID NO: 62059 - DNA, 356 bp, Homo sapiens
ttaattttaaagcagataatatttcaaatattttctttgaaatagaccatttgtcctgccttgaagtatgttagtacattttaagaaagtcagtgggttaaggagtcagtgctgttagtattcatgcttaaaacacttcccttctacctaccctaataaatgaggggctcaagagaaatatttctaattctctagcgacatggctaatttttttttttaatgtatttttgtatttttagtacagatggagtttcaccatgttggtcaggctggtctcaaactcctgagctcaagtgatctgcctacctcaggctcctgagtcactgagactgtagttgtgtgccaccatgccaggt

SEQ ID NO: 62060 - DNA, 4747 bp, Homo sapiens
ccgagacactgggaccacagcggcagctccgctgaaaactgcattcagccagtcctccggacttctggagcggggacagggcgcagggcatcagcagccaccagcaggacctgggaaatagggattcttctgcctccacttcaggttttagcagcttggtgctaaattgctgtctcaaaatgcagaggatctaatttgcagaggaaaacagccaaagaaggaagaggaggaaaaggaaaaaaaaaggggtatattgtggatgctctacttttcttggaaatgcaaaagattatgcatatttctgtcctcctttctcctgttttatggggactgatttttggtgtctcttctaacagcatacagataggggggctatttcctaggggcgccgatcaagaatacagtgcatttcgagtagggatggttcagttttccacttcggagttcagactgacaccccacatcgacaatttggaggtggcaaacagcttcgcagtcactaatgctttctgctcccagttttcgagaggagtctatgctatttttggattttatgacaagaagtctgtaaataccatcacatcattttgcggaacactccacgtctccttcatcactcccagcttcccaacagatggcacacatccatttgtcattcagatgagacccgacctcaaaggagctctccttagcttgattgaatactatcaatgggacaagtttgcatacctctatgacagtgacagaggcttatcaacactgcaagctgtgctggattctgctgctgaaaagaaatggcaagtgactgctatcaatgtgggaaacattaacaatgacaagaaagatgagatgtaccgatcactttttcaagatctggagttaaaaaaggaacggcgtgtaattctggactgtgaaagggataaagtaaacgacattgtagaccaggttattaccattggaaaacatgttaaagggtaccactacatcattgcaaatctgggatttactgatggagacctattaaaaatccagtttggaggtgcaaatgtctctggatttcagatagtggactatgatgattcgttggtatctaaatttatagaaagatggtcaacactggaagaaaaagaataccctggagctcacacaacaacaattaagtatacttctgctctgacctatgatgccgttcaagtgatgactgaagccttccgcaacctaaggaagcaaagaattgaaatctcccgaagggggaatgcaggagactgtctggcaaacccagcagtgccctggggacaaggtgtagaaatagaaagggccctcaaacaggttcaggttgaaggtctctcaggaaatataaagtttgaccagaatggaaaaagaataaactatacaattaacatcatggagctcaaaactaatgggccccggaagattggctactggagtgaagtggacaaaatggttgttacccttactgagctcccttctggaaatgacacctctgggcttgagaataagactgttgttgtcaccacaattttggaatctccgtatgttatgatgaagaaaaatcatgaaatgcttgaaggcaatgagcgctatgagggctactgtgttgacctggctgcagaaatcgccaaacattgtgggttcaagtacaagttgacaattgttggtgatggcaagtatggggccagggatgcagacacgaaaatttggaatgggatggttggagaacttgtatatgggaaagctgatattgcaattgctccattaactattacccttgtgagagaagaggtgattgacttctcaaagcccttcatgagcctcgggatatctatcatgatcaagaagcctcagaagtccaaaccaggagtgttttcctttcttgatcctttagcctatgagatctggatgtgcattgtttttgcctacattggggtcagtgtagttttattcctggtcagcagatttagcccctacgagtggcacactgaggagtttgaagatggaagagaaacacaaagtagtgaatcaactaatgaatttgggatttttaatagtctctggttttccttgggtgcctttatgcggcaaggatgcgatatttcgccaagatccctctctgggcgcattgttggaggtgtgtggtggttctttaccctgatcataatctcctcctacacggctaacttagctgccttcctgactgtagagaggatggtgtctcccatcgaaagtgctgaggatctttctaagcaaacagaaattgcttatggaacattagactctggctccactaaagagtttttcaggagatctaaaattgcagtgtttgataaaatgtggacctacatgcggagtgcggagccctctgtgtttgtgaggactacggccgaaggggtggctagagtgcggaagtccaaagggaaatatgcctacttgttggagtccacgatgaacgagtacattgagcaaaggaagccttgcgacaccatgaaagttggtggaaacctggattccaaaggctatggcatcgcaacacctaaaggatcctcattaggaaccccagtaaatcttgcagtattgaaactcagtgagcaaggcgtcttagacaagctgaaaaacaaatggtggtacgataaaggtgaatgtggagccaaggactctggaagtaaggaaaagaccagtgccctcagtctgagcaacgttgctggagtattctacatccttgtcgggggccttggtttggcaatgctggtggctttgattgagttctgttacaagtcaagggccgaggcgaaacgaatgaaggtggcaaagaatgcacagaatattaacccatcttcctcgcagaattcacagaattttgcaacttataaggaaggttacaacgtatatggcatcgaaagtgttaaaatttaggggatgaccttgaatgatgccatgaggaacaaggcaaggctgtcaattacaggaagtactggagaaaatggacgtgttatgactccagaatttcccaaagcagtgcatgctgtcccttacgtgagtcctggcatgggaatgaatgtcagtgtgactgatctctcgtgattgataagaaccttttgagtgccttacacaatggttttcttgtgtgtttattgtcaaagtggtgagaggcatccagtatcttgaagacttttctttcagccaagaattcttaaatatgtggagttcatcttgaattgtaaggaatgattaattaaaacacaacatctttttctactcgagttacagacaaagcgtggtggacatgcacagctaacatggaagtactataatttacctgaagtctttgtacagacaacaaacctgtttctgcagccactattgttagtctcttgattcataatgacttaagcacacttgacatcaactgcatcaagatgtgacatgttttataaaaaaaggaaaaaaaacatttaaaactaaaaaatatttttaggtattttcacaaacaaactggcttttaaataaatttgcttccatattggttgaataagacaaaaacaattaaactgagtgggaagtgaataaaaaaaggctttaggtatcgattccatatttttcaaagccaaatatgtaaatgctaaggaaagtaaacaaagaggagattccaatcttgtaatttaatattgttattaaaactttaatgtatcctattctttaacatttggtgttaatataaaattacttggcaatgcttgacatttgaaataaacatttttctattgttttattgcaagtggtccaattaattttgcttagctacagtttggtcataaatcaagtgagtttaaagacactaccaagttgttaggtgcccagagaaaatttctcccttttaaaaaggccaggtgatttttcaaatgtaatcttgcccccaaagtaatatctgaatatctttttgacatgtctaaatatatatatatataaagaaatatttgttaacacaaaagcatttgatctatgtagataaatgctaatagatttaaaaagctaatattaacaaataccagaatacgtgaagttccatttttaaagtgtttgagcttacagaagagaaacattcattttaaatgaagtaaaaaatgccttgaaagtaattctttagatagttgcccattgattaaattccaaaaactaaatatgtttttagctttaaaattataaaagctgtcataaactttatatattatgaattttaaaatatgtttgagtctcctgcaatatagtttcatcccattgacatcaattaaaaataaccctaatatattatttttatatttattcctcaggtggaatggctattttaatatgcccagtgtggataaaatgtcacatttctgtaacttttgactaaagagcctatatttatctagttaatgaatttaaaggatctatctttcccttcataaaatacctcttatttccattaaagccccccaagtttaattaatttaggattttgaatgattattgacatccaatagttatttttaatatttgtattcttgttatttctggaagaaagcctttgtgtagcacttggtattttgcaaagtgcttttaaaacattcttacttaccgtatttcatagaagggaaggaaaaatgtaaggtttaacagtaagcacttgcattgaacatggaggcatgtggtatcatgatattcttcactaaatttagctgtccctaat

SEQ ID NO: 62061 - DNA, 645 bp, Homo sapiens
atggctaatatctgcaggagtagctatttatattttaggagaataatatctgttttgcttcttttgcaatgttttaatcatttatttcatatttactctgttaaaaggaatacacaagatctagctaaagcattgaaaatgttccccattttctttaaggaacgctacagtttacacagataattcctaccctggtgcttacatcggtgaacaattggggaatgtcttgaagagtgttcctcatgtttctgcgagttattcacctttccattcccacccgatactgtgtaaattctttctttccctttgttacatgatttcatgatgatgtcaagttgtctttattctatctaatgaaagatgatctccttaaaaataaggattatttcccttgtttttactccaaatttcagcactggttggcacatagctagtacacaaaaaatgcatattgaatgaataaggaaaaattgaactggatcttcaacacccaggctttggatagatggaagagagatgtggatcagcatgacaagctgttggtgaaatgaaatggagaaaatggtgttcgttataggacagaattttgtgacaaactattttgttgtattttcttttacaaaaaaaaatgggcttagcagtgaa

SEQ ID NO: 62062 - DNA, 2956 bp, Homo sapiens
acatcatgagtggataaacttttatgagtatttgtaaatttcttgaaattgctttcttatgggattcatgtcataaactatttgggcattacaattatgaaagtattccagaaatcagaagttttgacctgtgtgtatgttattaaatttagctactctgtactccttgcccaaaatgtttaatgatttccagtttcattaactagtagatacattgaaaaatataaaattaaatattcccctataagtcaatatttgcataatactgctaacttgtttttttattaggtcattcatttcactttacaaatccatttcatacttgttattagatccctctctgggcgcattgttggaggtgtgtggtggttctttaccctgatcataatctcctcctacacggctaacttagctgccttcctgactgtagagaggatggtgtctcccatcgaaagtgctgaggatctttctaagcaaacagaaattgcttatggaacattagactctggctccactaaagagtttttcaggagatctaaaattgcagtgtttgataaaatgtggacctacatgcggagtgcggagccctctgtgtttgtgaggactacggccgaaggggtggctagagtgcggaagtccaaagggaaatatgcctacttgttggagtccacgatgaacgagtacattgagcaaaggaagccttgcgacaccatgaaagttggtggaaacctggattccaaaggctatggcatcgcaacacctaaaggatcctcattaggaaccccagtaaatcttgcagtattgaaactcagtgagcaaggcgtcttagacaagctgaaaaacaaatggtggtacgataaaggtgaatgtggagccaaggactctggaagtaaggaaaagaccagtgccctcagtctgagcaacgttgctggagtattctacatccttgtcgggggccttggtttggcaatgctggtggctttgattgagttctgttacaagtcaagggccgaggcgaaacgaatgaaggtggcaaagaatgcacagaatattaacccatcttcctcgcagaattcacagaattttgcaacttataaggaaggttacaacgtatatggcatcgaaagtgttaaaatttaggggatgaccttgaatgatgccatgaggaacaaggcaaggctgtcaattacaggaagtactggagaaaatggacgtgttatgactccagaatttcccaaagcagtgcatgctgtcccttacgtgagtcctggcatgggaatgaatgtcagtgtgactgatctctcgtgattgataagaaccttttgagtgccttacacaatggttttcttgtgtgtttattgtcaaagtggtgagaggcatccagtatcttgaagacttttctttcagccaagaattcttaaatatgtggagttcatcttgaattgtaaggaatgattaattaaaacacaacatctttttctactcgagttacagacaaagcgtggtggacatgcacagctaacatggaagtactataatttacctgaagtctttgtacagacaacaaacctgtttctgcagccactattgttagtctcttgattcataatgacttaagcacacttgacatcaactgcatcaagatgtgacatgttttataaaaaaaggaaaaaaaacatttaaaactaaaaaatatttttaggtattttcacaaacaaactggcttttaaataaatttgcttccatattggttgaataagacaaaaacaattaaactgagtgggaagtgaataaaaaaaggctttaggtatcgattccatatttttcaaagccaaatatgtaaatgctaaggaaagtaaacaaagaggagattccaatcttgtaatttaatattgttattaaaactttaatgtatcctattctttaacatttggtgttaatataaaattacttggcaatgcttgacatttgaaataaacatttttctattgttttattgcaagtggtccaattaattttgcttagctacagtttggtcataaatcaagtgagtttaaagacactaccaagttgttaggtgcccagagaaaatttctcccttttaaaaaggccaggtgatttttcaaatgtaatcttgcccccaaagtaatatctgaatatctttttgacatgtctaaatatatatatatataaagaaatatttgttaacacaaaagcatttgatctatgtagataaatgctaatagatttaaaaagctaatattaacaaataccagaatacgtgaagttccatttttaaagtgtttgagcttacagaagagaaacattcattttaaatgaagtaaaaaatgccttgaaagtaattctttagatagttgcccattgattaaattccaaaaactaaatatgtttttagctttaaaattataaaagctgtcataaactttatatattatgaattttaaaatatgtttgagtctcctgcaatatagtttcatcccattgacatcaattaaaaataaccctaatatattatttttatatttattcctcaggtggaatggctattttaatatgcccagtgtggataaaatgtcacatttctgtaacttttgactaaagagcctatatttatctagttaatgaatttaaaggatctatctttcccttcataaaatacctcttatttccattaaagccccccaagtttaattaatttaggattttgaatgattattgacatccaatagttatttttaatatttgtattcttgttatttctggaagaaagcctttgtgtagcacttggtattttgcaaagtgcttttaaaacattcttacttaccgtatttcatagaagggaaggaaaaatgtaaggtttaacagtaagcacttgcattgaacatggaggcatgtggtatcatgatattcttcactaaatttagctgtccctaat

SEQ ID NO: 62063 - DNA, 369 bp, Homo sapiens
tttatacttccttttattcctgttagattcacatatataaaagacatttctatttagaacaagtccagtaaatgtggttctaatttcagattcagacatggctttgaaaataattaaatgctttgctaatagacaagtcatttatccatacacctgtctgctgtaaccttttccagattggctactggagtgaagtggacaaaatggttgttacccttactgagctcccttctggaaatgacacctctgggcttgagaataagactgttgttgtcaccacaattttggtaatttgctacatatgccatgttttactttgtattttcttatggctaatatctgcaggagtagctatttatattttaggag

SEQ ID NO: 62064 - DNA, 692 bp, Homo sapiens
ctttttctttgatccagtgacataaccacgattcctttttcaccatgactccaggtactattactttcctttttttcccttacagaaagctgatattgcaattgctccattaactattacccttgtgagagaagaggtgattgacttctcaaagcccttcatgagcctcgggatatctatcatgatcaagaagcctcagaagtccaaaccaggagtgttttcctttcttgatcctttagcctatgagatctggatgtgcattgtttttgcctacattggggtcagtgtagttttattcctggtcagcagatttagcccctacgagtggcacactgaggagtttgaagatggaagagaaacacaaagtagtgaatcaactaatgaatttgggatttttaatagtctctggttttccttgggtgcctttatgcggcaaggatgcgatatttcgccaaggttggttactcacctgcttcaactttgtgcatttcaggtctcaagtggacattcatggtgtttatggattcaccctaaagaagttaccagctgccgacttcctgtccaagcagtttaagactcttgaaggacatcctcttagcttcggcataagtctgtgaaatatttgaacaatgttctttgaatgttgctcatctatttctctggtgaaattatacacaccatgaagaggctat

SEQ ID NO: 62065 - DNA, 2538 bp, Homo sapiens
ccgagacactgggaccacagcggcagctccgctgaaaactgcattcagccagtcctccggacttctggagcggggacagggcgcagggcatcagcagccaccagcaggacctgggaaatagggattcttctgcctccacttcaggttttagcagcttggtgctaaattgctgtctcaaaatgcagaggatctaatttgcagaggaaaacagccaaagaaggaagaggaggaaaaggaaaaaaaaaggggtatattgtggatgctctacttttcttggaaatgcaaaagattatgcatatttctgtcctcctttctcctgttttatggggactgatttttggtgtctcttctaacagcatacagataggggggctatttcctaggggcgccgatcaagaatacagtgcatttcgagtagggatggttcagttttccacttcggagttcagactgacaccccacatcgacaatttggaggtggcaaacagcttcgcagtcactaatgctttctgctcccagttttcgagaggagtctatgctatttttggattttatgacaagaagtctgtaaataccatcacatcattttgcggaacactccacgtctccttcatcactcccagcttcccaacagatggcacacatccatttgtcattcagatgagacccgacctcaaaggagctctccttagcttgattgaatactatcaatgggacaagtttgcatacctctatgacagtgacagaggcttatcaacactgcaagctgtgctggattctgctgctgaaaagaaatggcaagtgactgctatcaatgtgggaaacattaacaatgacaagaaagatgagatgtaccgatcactttttcaagatctggagttaaaaaaggaacggcgtgtaattctggactgtgaaagggataaagtaaacgacattgtagaccaggttattaccattggaaaacatgttaaagggtaccactacatcattgcaaatctgggatttactgatggagacctattaaaaatccagtttggaggtgcaaatgtctctggatttcagatagtggactatgatgattcgttggtatctaaatttatagaaagatggtcaacactggaagaaaaagaataccctggagctcacacaacaacaattaagtatacttctgctctgacctatgatgccgttcaagtgatgactgaagccttccgcaacctaaggaagcaaagaattgaaatctcccgaagggggaatgcaggagactgtctggcaaacccagcagtgccctggggacaaggtgtagaaatagaaagggccctcaaacaggttcaggttgaaggtctctcaggaaatataaagtttgaccagaatggaaaaagaataaactatacaattaacatcatggagctcaaaactaatgggccccggaagattggctactggagtgaagtggacaaaatggttgttacccttactgagctcccttctggaaatgacacctctgggcttgagaataagactgttgttgtcaccacaattttggaatctccgtatgttatgatgaagaaaaatcatgaaatgcttgaaggcaatgagcgctatgagggctactgtgttgacctggctgcagaaatcgccaaacattgtgggttcaagtacaagttgacaattgttggtgatggcaagtatggggccagggatgcagacacgaaaatttggaatgggatggttggagaacttgtatatgggaaagctgatattgcaattgctccattaactattacccttgtgagagaagaggtgattgacttctcaaagcccttcatgagcctcgggatatctatcatgatcaagaagcctcagaagtccaaaccaggagtgttttcctttcttgatcctttagcctatgagatctggatgtgcattgtttttgcctacattggggtcagtgtagttttattcctggtcagcagatttagcccctacgagtggcacactgaggagtttgaagatggaagagaaacacaaagtagtgaatcaactaatgaatttgggatttttaatagtctctggttttccttgggtgcctttatgcggcaaggatgcgatatttcgccaaggttggttactcacctgcttcaactttgtgcatttcaggtctcaagtggacattcatggtgtttatggattcaccctaaagaagttaccagctgccgacttcctgtccaagcagtttaagactcttgaaggacatcctcttagcttcggcataagtctgtgaaatatttgaacaatgttctttgaatgttgctcatctatttctctggtgaaattatacacaccatgaagaggctataaaatgcataaggttcctatcattccatgccttcttggaggggtaccgtgtttttgctgcatattctcattttacagtcatctgtgtgttgatccacagacctgtatatgggaaaatgggcaacattatttattaactgcaaagtaacaccttgttagataaaacttcgttggcacaca

SEQ ID NO: 62066 - DNA, 343 bp, Homo sapiens
atcaaaaatgtgctagcagcactctacacaacaactattagaactccaagtatgaagaacaattctttcctataactaagattctaagaataaaattaaaaaggaaagaagactctcaatgggggaatctacagcatcaaaagattatttggcaaagcaagataacagctgtggtgtaagaaaagcttaatttcatcgtattatacaaaactgagaaaattaaaactgaatgagagagcagagatcattttctctaatttttagcagccaattttcatgttttgatagggataagttgaatataaaaatataaataaaataattatgtctcaaatgaaatttg

SEQ ID NO: 62067 - DNA, 253 bp, Homo sapiens
agaacgtgcctactggtacagcctgatgaaactgaaataaaaatgacaactaatctggaagacaaccagcaaccaatcaccaatcaaactgaacaaataatgccttctctgccccatttcctcttctgtcaattttaataaaatcatagttctcagtactccttgccatcctggtactcagcactccttgccccaattttaataaaatcaagagaagagaaaatggggcagagaggacattccaggcagcact

SEQ ID NO: 62068 - DNA, 1018 bp, Homo sapiens
ttgtacactaaaaatgacaaaaaactgaggaaaaaattaaacacacaaatgggaaagacatctcatgttcaaggactggaagaccttatattgttaaaatgtacatactatccaaagtaatctactgattcaatgcaatctctatcaaatttcagtgtcattttttgcaaaatgagaaaaagccatcctgaaatcagtaagtaatctcaaaggaccccaaatagccaaaacaaccttgattaagaacaaaactgtaggcttcacactttctgatttcaaaacttgttacaaagctacagtgatcaaaatagtactagcatacagacatgtaaaccaatggaacagaacagacagcccagatataaacccctgtgtatgtggtcaaatgatgagccaagactacgcaatggggaaagaataatctcttcaacaaatagtgctggaaaaactggatgtccacatgcaacagaatgaagatggatccttatcttaaaccataaataaaaaataactaaaaattgattaaagacctaaacataagacctgaaaccataaaactagaaggaaacatagagaagcttcatgatactgaatttggcaatgatttcttggctgcaaaacaaaaagcacaggcaacaaaggcaaaaatagacacagaattacatcaaacttacaaacttctgtgcagcaaggcaagcaatcaaccaaaaccagaatgaaaccaaggaagagtgaaaaggcaacctacagaatgagagaaaatatttgcaaatcatgtattggataggggtttaatatccagaataaaaaaaaaactcctacaactcagtaacaaaacaaaaaccacaaataacacaactttaaaatgagctaaggacttgaatagacatttttacaaagaagatacataaatggccaaaaaaaatatgaaaagctactcaacatcactaatcatcggcaaaactcacatcaaatcacactgaggtatcacctcacaccagttaaaattacctctatc

SEQ ID NO: 62069 - DNA, 221 bp, Homo sapiens
agcaaccagattataaccagtggtttgaaaatatttcctatgaacactttaataatggaggatgcatcattctagatgaagtgaatgagaaaccatacaattggtggagaattgccatttattttgatttgagtttccaaagactgtgcagtatggccaatgaattaaggagaacatcttctaaattacgagattataaatacttttttgctatcagccat

SEQ ID NO: 62070 - DNA, 322 bp, Homo sapiens
ttgctgagtgattttgaacgttgacaccagtgtggagccagtgtgggtgtggggagcagtgccttcctcaggtcccagctggtcctgatatgccacgtagtggatggcatctgtcttggtccatgggcttggtgggaacatgcttctgcttgtgtgttttccatacctgagggctgacgtagcttaaaccacagggcatcatgccaaacactcactgctgggcaggtttatttctggggatgtcagggtactggggtgtaggcactaagcaggatagagttagggtgtctggctagtaaggggttctggacgcctctggggc

SEQ ID NO: 62071 - DNA, 321 bp, Homo sapiens
cccatgtctcttcctcctctgcccctgctctgtccctcccatcctcatcttacaccgggaccaacaggaggcagtagcctccttctgggtctccctgcccaccccctgcgcccatctgtgtggcacacacagccagagggtacccgtgagcacccgagcggtcacgtccctctgctcagaactttcctgccgctctgtctcctgcgggcccacaaggccccatcacctctctgttctcaccccccctggagacctcagagcctttgcacgggctggcccctctgccaggagctcacttcccagtgtctgcacagggctccc

SEQ ID NO: 62072 - DNA, 273 bp, Homo sapiens
cacagcgagttatactgaggctcaggatcagtccgcgaaacgtggacccgggcctgcacgagggttgatgggtgagggtggcgggtgaacttgagtagaggtaaggaaagatcttacggccttcttcctagtcctaaaagcgtccctcgcagcccgcctgcttgctggcagcctcaccctgctggcttccaggagggctttgtcaagcactgcagcggtgttggaaaccttgttgcaaagtccaagcctaagcgagtgggcgagacgcgcaga

SEQ ID NO: 62073 - DNA, 98 bp, Homo sapiens
gcgcaccttcgaacaaagagtagaagatgtccgacttattcgagagcagcatccaaccaaaatcccggtgataatagaacgatacaagggtgagaagc

SEQ ID NO: 62074 - DNA, 6271 bp, Homo sapiens
  misc_feature (61)..(61): n is a, c, g, or t
  misc_feature (2286)..(2286): n is a, c, g, or t
  misc_feature (2941)..(2941): n is a, c, g, or t
  misc_feature (3221)..(3221): n is a, c, g, or t
  misc_feature (3239)..(3239): n is a, c, g, or t
  misc_feature (3241)..(3241): n is a, c, g, or t
  misc_feature (4151)..(4151): n is a, c, g, or t
  misc_feature (4379)..(4379): n is a, c, g, or t
  misc_feature (4971)..(4973): n is a, c, g, or t
ttccagcgtcgactcacggagtccttcggatgagagcgtctgggtgccagacgaggccggngccttgccctcccaagacactgttcttcaagagaaagaccagaagagaaggcaaaaatgaatgttgaagtagtaaaagtcatgccccaggacttagtgacattcaaggatgtggcaatagatttttcccaggaagaatggcaatggatgaaccctgctcagaagcgtttatacaggagtatgatgttggagaactatcagagcctggtatcacttggtctttgcatttctaagccatatgtgatctccttattggagcaagggagagagccttgggagatgacgagtgagatgacaagaagcccattctcagattgggaatctatatatgtgacacaggaattacctctgaagcagttcatgtatgatgatgcatgcatggagggaattactagctatggacttgagtgttccacttttgaagaaaattggaaatgggaagacctttttgagaagcagatgggaagtcatgagatgtttagcaagaaagaaataatcactcataaagaaaccatcactaaggaaacagaattcaaatatactaaatttgggaaatgtatccatctggaaaacatagaagagagtatttataatcacacatcagataaaaaaagcttctccaaaaattctatggtaataaaacacaagaaagtctatgtaggaaagaagctttttaaatgtaatgaatgtgacaaaaccttcacccatagctcatcccttactgttcattttagaattcatactggtgaaaaaccatatgcatgtgaggaatgtggaaaagccttcaagcaaaggcaacaccttgctcaacatcacagaacacatactggagagaaactctttgaatgtaaagaatgtaggaaagccttcaaacaaagtgaacaccttattcagcatcaaagaattcatactggagaaaaaccatataaatgtaaggaatgcagaaaagccttcagacagcctgcacaccttgctcagcatcagagaattcatactggagagaaaccctatgaatgtaaagaatgtggcaaagccttcagtgatggctcgtcttttgctcgacatcagagatgtcacactggcaaaagaccctatgaatgtattgagtgtgggaaggcttttaggtataacacatcttttattcgtcactggaggagttatcatactggagagaagccttttaattgcattgattgtgggaaagccttcagtgttcacataggacttattctgcataggagaattcatacaggagagaaaccttacaaatgtggtgtgtgtggaaaaaccttcagctcgggttcatcccgtactgtacatcagagaattcatacaggagagaaaccttatgaatgtgatatatgtgggaaagattttagccatcatgcatcactcactcagcatcaaagagtacattctggagagaaaccgtatgaatgcaaggaatgtgggaaagcctttaggcagaatgtacaccttgttagtcatttgagaattcatactggtgaaaaaccctatgaatgtaaagaatgtggaaaagcttttagaatcagttcacagctggctactcatcagagaattcatactggagagaagccttatgaatgtattgaatgtggaaatgctttcaaacagagatcacaccttgcccaacatcagaaaactcatacaggagagaaaccttatgagtgtaatgaatgcgggaaagccttcagccaaacttccaatcttactcaacatcaaagaattcatactggagagaaaccctataaatgtactgaatgtggaaaggcttttagtgatagctcatcctgtgctcagcatcaaagactccacactggccaaaggccctatcagtgttttgaatgtgggaaggcgttcagaagaaagttatccttaatttgtcatcaaagaagtcatactggagaagaaccttaagaatgtagtgcatgtggccaagcctttagttatcaccaatcccctactgttaatcagagatgtcccactggataaaaaacatataaatgtaagaaatgtagaaaaaccttcagccaggaggctggcaagatggccgaataggaacagctctgatctgcagttcccagtgagatcaacgcagaaggtgggtgctttctgtatttccagctgaggtacctggctcatctcattgggactggttagacagtgggtgcagcccacggagggtgagctgaagcagggtggggngtaacctcacctgggaagtgcaaggagtcggggatctccctcccctagccaagggaagccatgagggactgtgccatgaggaatggtgcactccggcacagatactacgcttttcccatggtcttcgcaacccacagaccaggagatccccttgggtgcctatgccaccaaggccctgggtttcaagcacaaaactgggcggccattcgggcagacaccgagctagctgtaggagtttttttgatagcccagtggcacctggaatgccagtgaaacagaaccgcttactcccttgttaagggggctgaagccggggagccaagtggttcccatgcccactgagcccagcaagctaagatccactggcttggaattctccctgccagcacagcagtctgaagtcaacctgggatgatcaagcttggtggggggaggggcgccaaccattaccaaagcttgaataggtggttttcccctcacagcgtaaacaaagccatggggaagttccagctgagcagagccctccacagctcagcaaagcctctgtagccagactgcctctctagattcctcctctctgggcagcgcatctttgaaaaaagtgcagataaaaccctcatctccctgggacaaagcacgtgggggaaaggggtgnctgtgggcacagcttcagcagacttaaacattcctgcctgccagctctgaagagagcagcagttcttccagcacagcgcttgagctctgctaagggacagactgcctcctcaagtgggtccctgacccccatgcctcctgacggggagacacctcccagcaggggtccacagacacctcatacaggagagctctggctggcatctggtgggtgcccctctgggacaaagcttccagaggaaggaacaggcagcaatctttgctgttctgcagcctccacnggtgatacccaggcagananggtctggagtggacctccagcaaactccagcagacctgcagccgaggggcctcactgttagaaggaaaactaacaggaatataatcaacatcaacaaaggacatccacacagaaaccccatctgaaggttaccagcatcaaagaccaaaggtagataaattcacgaagatgaggagaaaccagtgcaaaaagcctgaaaattccaaaaaccagaatgcctcttctcctccaaaggatcacaactccttgccggcaagggaacaaaactggatagagaatgagtttgacaaattgacagaagtaggcttcagaaggtgggaaataacaaactcctctgagctaaaggagcatgttctaacccaatgcaaggaagctaagaaccttgaaaaaaggttagaggaattgctaactagaataaccagtttagagaagaacataaatgacctgatggagctgaaaaacacagcatgagaacttcgtgaagcatacagaagaaaaaccttcagccagattgaatgctttacagggaagaattcatactgcagagcggtcttaacaatgtaaagaatgtgcaaatgtcctcagacaagatgcacaccttgctcattagtgagttcatttcaggcagccagctcttcctcacccactacatcaccaagtcctgtggatatatctgctaaatatttttggaatttatccacttcttttggttccccagtccaaaacacagtcatttcacctggactatttcaatcattacacaggtgtccaaccttttgtcttccctgggccacattggaagaagaaaaattgtcttgtgccacacatacaatacactaacattaacaatagctgatgagctaagaaaaaaaaaaagtctgtgcatagttttagtgatacaccacctccnataagcaaaaaagtcctcacattcaatgggttgcatacccatgaattctaaaacttcatcctcttttgtccctttcgagttaacattacagccacagtgacctttcaaaaatgcaaattaagttactcttaaaactctagttaaaatacttgatgtacataaagtgcttagcaaaatgaccaactcatactaagtgcttagtaaatgttagataagtattctccaganttgatgtaaattatttttaaacagtgcattcttgaaagcagtatggcagtcataaaaattttggaaccaaaacagtatctttttttaagctaaaaaaaagttttaaatggtgtctttctatgttgcccagggtggtctcaaactcctgtgctcaagtgaccctcccacctcattctcaagtggctgcaattacaggcaaccagcctgacttaaaacagtatcttaaggtagatggtgattagcacatgtagtatgcttaacatttaatattataataagacatcacagcggctgtctcatgattaaggctgtgttcccttgttggtgaggaaattaattatgacttgataaatagaacatgttttaagaagtggctatatagctctggataaaacgaacaaaagaattagaattcctgcggggaatatatacaagactttatttagtcaagtaaaaaaaaatcactaatgtttaactgaagaaagagaaattgaataatatagttctatttcaacatgtgggttcacagatttattctaaccttccaagtaaagttgttccactagtaaagttgttctggagtatatttttnnnaaaaaaaacacttaaaatgttccacttctttcatgaggctaagtcaactctgatatcaaaccaaggggaaagaaatgaaattataggtgagtttacttagttatatacaaaaggaaattattagcctctgctgatggagaacagaggctgtgaataaatggagatccataacatgatcctacatgaatgtttcaatattgtaatcctgtaagttacttttacattgacagttctgaaattcatgttgagtgttaattaggcaggaatcagaagggaggttttgtagaaggtcgtatccatgggttttttatatttgaaaagtgttttcgatgtatcattgggggagattaaatgtctttgacagttgtccaactagaaataaagtcagcatcccatttgactccttacacagaagttcattctatactcattacagatgtaagaggttaagatggtagaggagaatgtagagtatttctgtgcctttaggttcaggaggtctttgataagcaggacaaggtccagaagccatgaagagagaatgacaggactgtgtagaagatttaaacctttttcatggcgtaagatactgtatgcaaagttaaaaggcatatgacaggctgagagatatcttaaacatacattagaaaggatatagcccttgaaaaagggctgttggaaagcagcaaggataaggtgcacagtcttgcagagcatgtcaacaaaatttattggatgaagaaattaaaatggttaaatagaagaagttctcaacctcactaatgatcagataagtgcagattgtaaaagtcctcatccccaccaacacaaaccagcagaaattttatgtgaatgtgaagtttggataatatccagtattgtcgcaggtgtgagaaaccgtattttcaaatattgagagggtaaattagaggaaagccattttagagggcaatgtggtgttacctgtcagcattttgaatataattaccctttgccacaattctacacctagtcagttatgttctcaaaaagcacaagtgcagaaatatagatgcataagcaaatgtgttgcagaattgtgaaaaatttggaaaaaatgtttagtgctattaaagttatgggttacttaagttacagaaaatcagtttagtagatcactgtgtagttacggaaaatgagatggatctctactcaaagatgtcttgcagtttatgaactgagatgtaacttcatgactaacatgatgacatcgttattaactacataaactttataaagcttaaaaaatgcattcatag

SEQ ID NO: 62075 - DNA, 5923 bp, Homo sapiens
  misc_feature (61)..(61): n is a, c, g, or t
  misc_feature (2286)..(2286): n is a, c, g, or t
  misc_feature (2941)..(2941): n is a, c, g, or t
  misc_feature (3221)..(3221): n is a, c, g, or t
  misc_feature (3239)..(3239): n is a, c, g, or t
  misc_feature (3241)..(3241): n is a, c, g, or t
  misc_feature (4151)..(4151): n is a, c, g, or t
  misc_feature (4379)..(4379): n is a, c, g, or t
  misc_feature (4971)..(4973): n is a, c, g, or t
ttccagcgtcgactcacggagtccttcggatgagagcgtctgggtgccagacgaggccggngccttgccctcccaagacactgttcttcaagagaaagaccagaagagaaggcaaaaatgaatgttgaagtagtaaaagtcatgccccaggacttagtgacattcaaggatgtggcaatagatttttcccaggaagaatggcaatggatgaaccctgctcagaagcgtttatacaggagtatgatgttggagaactatcagagcctggtatcacttggtctttgcatttctaagccatatgtgatctccttattggagcaagggagagagccttgggagatgacgagtgagatgacaagaagcccattctcagattgggaatctatatatgtgacacaggaattacctctgaagcagttcatgtatgatgatgcatgcatggagggaattactagctatggacttgagtgttccacttttgaagaaaattggaaatgggaagacctttttgagaagcagatgggaagtcatgagatgtttagcaagaaagaaataatcactcataaagaaaccatcactaaggaaacagaattcaaatatactaaatttgggaaatgtatccatctggaaaacatagaagagagtatttataatcacacatcagataaaaaaagcttctccaaaaattctatggtaataaaacacaagaaagtctatgtaggaaagaagctttttaaatgtaatgaatgtgacaaaaccttcacccatagctcatcccttactgttcattttagaattcatactggtgaaaaaccatatgcatgtgaggaatgtggaaaagccttcaagcaaaggcaacaccttgctcaacatcacagaacacatactggagagaaactctttgaatgtaaagaatgtaggaaagccttcaaacaaagtgaacaccttattcagcatcaaagaattcatactggagaaaaaccatataaatgtaaggaatgcagaaaagccttcagacagcctgcacaccttgctcagcatcagagaattcatactggagagaaaccctatgaatgtaaagaatgtggcaaagccttcagtgatggctcgtcttttgctcgacatcagagatgtcacactggcaaaagaccctatgaatgtattgagtgtgggaaggcttttaggtataacacatcttttattcgtcactggaggagttatcatactggagagaagccttttaattgcattgattgtgggaaagccttcagtgttcacataggacttattctgcataggagaattcatacaggagagaaaccttacaaatgtggtgtgtgtggaaaaaccttcagctcgggttcatcccgtactgtacatcagagaattcatacaggagagaaaccttatgaatgtgatatatgtgggaaagattttagccatcatgcatcactcactcagcatcaaagagtacattctggagagaaaccgtatgaatgcaaggaatgtgggaaagcctttaggcagaatgtacaccttgttagtcatttgagaattcatactggtgaaaaaccctatgaatgtaaagaatgtggaaaagcttttagaatcagttcacagctggctactcatcagagaattcatactggagagaagccttatgaatgtattgaatgtggaaatgctttcaaacagagatcacaccttgcccaacatcagaaaactcatacaggagagaaaccttatgagtgtaatgaatgcgggaaagccttcagccaaacttccaatcttactcaacatcaaagaattcatactggagagaaaccctataaatgtactgaatgtggaaaggcttttagtgatagctcatcctgtgctcagcatcaaagactccacactggccaaaggccctatcagtgttttgaatgtgggaaggcgttcagaagaaagttatccttaatttgtcatcaaagaagtcatactggagaagaaccttaagaatgtagtgcatgtggccaagcctttagttatcaccaatcccctactgttaatcagagatgtcccactggataaaaaacatataaatgtaagaaatgtagaaaaaccttcagccaggaggctggcaagatggccgaataggaacagctctgatctgcagttcccagtgagatcaacgcagaaggtgggtgctttctgtatttccagctgaggtacctggctcatctcattgggactggttagacagtgggtgcagcccacggagggtgagctgaagcagggtggggngtaacctcacctgggaagtgcaaggagtcggggatctccctcccctagccaagggaagccatgagggactgtgccatgaggaatggtgcactccggcacagatactacgcttttcccatggtcttcgcaacccacagaccaggagatccccttgggtgcctatgccaccaaggccctgggtttcaagcacaaaactgggcggccattcgggcagacaccgagctagctgtaggagtttttttgatagcccagtggcacctggaatgccagtgaaacagaaccgcttactcccttgttaagggggctgaagccggggagccaagtggttcccatgcccactgagcccagcaagctaagatccactggcttggaattctccctgccagcacagcagtctgaagtcaacctgggatgatcaagcttggtggggggaggggcgccaaccattaccaaagcttgaataggtggttttcccctcacagcgtaaacaaagccatggggaagttccagctgagcagagccctccacagctcagcaaagcctctgtagccagactgcctctctagattcctcctctctgggcagcgcatctttgaaaaaagtgcagataaaaccctcatctccctgggacaaagcacgtgggggaaaggggtgnctgtgggcacagcttcagcagacttaaacattcctgcctgccagctctgaagagagcagcagttcttccagcacagcgcttgagctctgctaagggacagactgcctcctcaagtgggtccctgacccccatgcctcctgacggggagacacctcccagcaggggtccacagacacctcatacaggagagctctggctggcatctggtgggtgcccctctgggacaaagcttccagaggaaggaacaggcagcaatctttgctgttctgcagcctccacnggtgatacccaggcagananggtctggagtggacctccagcaaactccagcagacctgcagccgaggggcctcactgttagaaggaaaactaacaggaatataatcaacatcaacaaaggacatccacacagaaaccccatctgaaggttaccagcatcaaagaccaaaggtagataaattcacgaagatgaggagaaaccagtgcaaaaagcctgaaaattccaaaaaccagaatgcctcttctcctccaaaggatcacaactccttgccggcaagggaacaaaactggatagagaatgagtttgacaaattgacagaagtaggcttcagaaggtgggaaataacaaactcctctgagctaaaggagcatgttctaacccaatgcaaggaagctaagaaccttgaaaaaaggttagaggaattgctaactagaataaccagtttagagaagaacataaatgacctgatggagctgaaaaacacagcatgagaacttcgtgaagcatacagaagaaaaaccttcagccagattgaatgctttacagggaagaattcatactgcagagcggtcttaacaatgtaaagaatgtgcaaatgtcctcagacaagatgcacaccttgctcattagtgagttcatttcaggcagccagctcttcctcacccactacatcaccaagtcctgtggatatatctgctaaatatttttggaatttatccacttcttttggttccccagtccaaaacacagtcatttcacctggactatttcaatcattacacaggtgtccaaccttttgtcttccctgggccacattggaagaagaaaaattgtcttgtgccacacatacaatacactaacattaacaatagctgatgagctaagaaaaaaaaaaagtctgtgcatagttttagtgatacaccacctccnataagcaaaaaagtcctcacattcaatgggttgcatacccatgaattctaaaacttcatcctcttttgtccctttcgagttaacattacagccacagtgacctttcaaaaatgcaaattaagttactcttaaaactctagttaaaatacttgatgtacataaagtgcttagcaaaatgaccaactcatactaagtgcttagtaaatgttagataagtattctccaganttgatgtaaattatttttaaacagtgcattcttgaaagcagtatggcagtcataaaaattttggaaccaaaacagtatctttttttaagctaaaaaaaagttttaaatggtgtctttctatgttgcccagggtggtctcaaactcctgtgctcaagtgaccctcccacctcattctcaagtggctgcaattacaggcaaccagcctgacttaaaacagtatcttaaggtagatggtgattagcacatgtagtatgcttaacatttaatattataataagacatcacagcggctgtctcatgattaaggctgtgttcccttgttggtgaggaaattaattatgacttgataaatagaacatgttttaagaagtggctatatagctctggataaaacgaacaaaagaattagaattcctgcggggaatatatacaagactttatttagtcaagtaaaaaaaaatcactaatgtttaactgaagaaagagaaattgaataatatagttctatttcaacatgtgggttcacagatttattctaaccttccaagtaaagttgttccactagtaaagttgttctggagtatatttttnnnaaaaaaaacacttaaaatgttccacttctttcatgaggctaagtcaactctgatatcaaaccaaggggaaagaaatgaaattataggtgagtttacttagttatatacaaaaggaaattattagcctctgctgatggagaacagaggctgtgaataaatggagatccataacatgatcctacatgaatgtttcaatattgtaatcctgtaagttacttttacattgacagttctgaaattcatgttgagtgttaattaggcaggaatcagaagggaggttttgtagaaggtcgtatccatgggttttttatatttgaaaagtgttttcgatgtatcattgggggagattaaatgtctttgacagttgtccaactagaaataaagtcagcatcccatttgactccttacacagaagttcattctatactcattacagatgtaagaggttaagatggtagaggagaatgtagagtatttctgtgcctttaggttcaggaggtctttgataagcaggacaaggtccagaagccatgaagagagaaatctagggagggagaagagagatagtgggtatgcttctctagctccccatcttccaggtccacctcttgacttcctgttcccctaaacctgagcacatcacgccaggcctctctgctgccaggacagcatcagctcactcctcagcaataatctagggtatgtgggaaggtcagggctgtggtaaggaatagaatcaaagaggggtgtgatacggggtgggggcacttggccgcctgctaaacttggacattaattttatatcatgacccccttttaagcccagtgagctgggcttcagtttttcccaggccatgcacatttaatttatttcagcgtaactctaatcgtcattttcactgcatatctttattttttatcttgtcgatttaagaaatgtgaagattgat

SEQ ID NO: 62076 - DNA, 3120 bp, Homo sapiens
gactaatggccctaactaagtattaacccctgccaagaaaagagctacttcctcttgaagtaaatgaagatagtgatgctttctcttaaactttacttataaaaagcatcaaaggggggaatgaagcaggaaatataaaaggaaaaacaagtaaagggaaaacaagtcctttcctgaccagtctgactcactccaaagtcctgctggagctatgataattatctgcaaggccaggcaggggctccgaaggagggctccaggagcagggatgagaaaaacaagttctccttatcagtttccctgtttgaaattctctccccataacattattctttgttctgctctcacaactatttttgtaactatttctgcaagtctgtaaagattttgtaagttcttgtttttctttctgtagcatggcaaggtcacaagacatgtttaagtaaggtaggctcatgttgcaaatcctgttgtaaaacctgtcaacggtatgattaactgcctttgttctgcttctgtaagactgctttctcacctcgcaggttttgcgccaaaaacccgacttgcccctgcctgatgcatgtataaaagtcaagccctgtctttgttccgggctcagcctttggatgttaatccgctgggccagtggccacctaaataaaaccttcctgttgcacccagtgatctctccggcctcctggttcccacaacatataagcattccttttctctgcaacctagcccgcatctgtcattgactttttgaacaataggcattctgactggatgagatggtatctcactgtggtttttctctgcatttttctaataattaacaacgtgaattttgttttcatgtgcttgtcagccacatgtatgtcttcttttgaaaagtatctgttcatgtttttgcttactttttaattaggtttttggttttctttttgttgttgttgttgttttctgagatggagtcttgctgtgtcaccaggatggagtgcagtggcatgatctcgactcactgcaacctccacctcccaggttcagatgattcttctgcttcagtctcctgagtagctgggatcacagggaccattgacatttatggatgtggccatagaattctctttggaggagtggcaatgcctggacactgcacagcagaatttatataggcatgtgatgtgagagaactacagaaacctggttttcttgggtgaaggtattgctgtctctaagccagacctgattacctgtctggagcaaggaaaagagccctggaatatgaagagacatgagatggtagctaaacatttagttatgttttattattttgcccaacacctttggccagagcagaacataagagattctttccagaaagtgaccctaagaagatatagaaaatgtggatatgagaatttacagttaagaaaaggctgtaaaagtgtggttgagtgtaaacagcacaaaggagattatagtggacttaaccaatgtttgaaaactaccttgagcaaaatatttcaatgtaataaatatgtagaagttttccataaaatttcaaattcaaatagacacaagatgagacatactgaaaataaacattttaaatgtaaagaatgtcgcaaaacattttgcatgctttcacacctaactcaacataaaagaatccaaactagagtgaatttctacaaatgtgaagcatatggaagagcctttaactggtcctcaacccttaataaacataagagaattcatactggagaaaaaccttacaaatgtaaagaatgtggcaaagcctttaaccagacctcacaccttattagacataagagaattcatactgaagagaaaccctacaaatgtgaagaatgtggcaaagcctttaaccagtcatcgacccttactacacataatataattcatactggggaaattccctacaaatgtgagaaatgtgttagagcttttaaccaagcctcaaagcttactgaacataagttaattcataccggagagaaacgttatgaatgtgaagaatgcggcaaagcttttaaccgatcctcaaaacttactgaacataagtacattcatactggagagaagctgtacaaatgtgaagaatgtggtaaagcctttaaccagtcctcaacccttactacacataagagaattcatagtggagagaagccctacaaatgtgaagaatgtggcaaagcttttaaacaattttcaaatcttactgaccataaaaaaattcatactggagagaaaccctacaaatgtgaggaatgtggcaaagcttttaaccaactctcaaaccttactagacataaggtaattcatactggagagaaaccctacaaatgtggagaatgtggcaaagcctttaaccagtcctcagcccttaatacacataagataatccatactggagagaatccccacaaatgtagagaatctggcaaagttttccacctatcctcaaaacttagtacatgtaagaaaattcatactggagagaaactctacaaatgtgaagaatgtggcaaagcctttaactgatcttcaacccttattggacataagagaattcatactggagagaaaccctacaaatgtgaagaatgtggcaaagcttttaaccaatcttcaacacttactacacataagataattcatactgaagagaaacagtacaaatgtgatgaatgtggcaaagcttctacctgatcctcaaaactcattgaacacaagaaaattcatactggagagaaaccttacaagtgtgaagaatgtggcaaaacttctaaccatttctcaacctttactaaacataagatgattcatactggagagaagttacacaaatgtgatgaatgtgacaaagcttttaaccaatcttcaaccctttctacacataaaagaattcatactggagagaaaccctacaaatgtgaagaatgtggcagagcttttaattgatcatcaaaccttattaaacataagaaaattcatattggagagaaaccctacaaatgtgaagaatgtggaaaagcttttaaccagttctcaactcttactacacataaaataattcatactggagagaaacca

SEQ ID NO: 62077 - DNA, 538 bp, Homo sapiens
ggtctctggcggcagccggagcttctggtgtagtcttcactgctctgtgtcttctgctcctagaggcccagcttctgtggcctcgttaccatgcaggtattgggagatccacagctaagacgccaggacccactggaagcctagacaatgggaccattgacatttatggatgtggccatagaattctctttggaggagtggcaatgcctggacactgcacagcagaatttatataggcatgtgatgtgagagaactacagaaacctggttttcttgggtgaaggtattgctgtctctaagccagacctgattacctgtctggagcaaggaaaagagccctggaatatgaagagacatgagatggtagctaaacatttaggctggagtacaatggcgtgatcttggctcaacgcaacctccacctcccggattcaagcaattctcctgcctcagcctccagagtagctgggattacaggcatgcgccaccatatctggctaattcttcattttcagtagacaaggtttctccatgttgg

SEQ ID NO: 62078 - DNA, 4168 bp, Homo sapiens
acgcgtccgcccacgcgtccggagaagttacacaaatgtgatgaatgtgacaaagcttttaaccaatcttcaaccctttctacacataaaagaattcatactggagagaaaccctacaaatgtgaagaatgtggcagagcttttaattgatcatcaaaccttattaaacataagaaaattcatattggagagaaaccctacaaatgtgaagaatgtggaaaagcttttaaccagttctcaactcttactacacataaaataattcatactggagagaaaccatataaatgtgaagaatgtggcaaagctttcaacctatacgtaaaccttactacacataagaaaattcatactggagagaaaccctacaagtgtgaagaatgtggcaaagcttttagccaagtgtcaactcttactatacataaaagaattcatacagcagaatttatataggcatgtgatgtgagagaactacagaaacctggttttcttgggtgaaggtattgctgtctctaagccagacctgattacctgtctggagcaaggaaaagagccctggaatatgaagagacatgagatggtagctaaacatttagttatgttttattattttgcccaacacctttggccagagcagaacataagagattctttccagaaagtgaccctaagaagatatagaaaatgtggatatgagaatttacagttaagaaaaggctgtaaaagtgtggttgagtgtaaacagcacaaaggagattatagtggacttaaccaatgtttgaaaactaccttgagcaaaatatttcaatgtaataaatatgtagaagttttccataaaatttcaaattcaaatagacacaagatgagacatactgaaaataaacattttaaatgtaaagaatgtcgcaaaacattttgcatgctttcacacctaactcaacataaaagaatccaaactagagtgaatttctacaaatgtgaagcatatggaagagcctttaactggtcctcaacccttaataaacataagagaattcatactggagaaaaaccttacaaatgtaaagaatgtggcaaagcctttaaccagacctcacaccttattagacataagagaattcatactgaagagaaaccctacaaatgtgaagaatgtggcaaagcctttaaccagtcatcgacccttactacacataatataattcatactggggaaattccctacaaatgtgagaaatgtgttagagcttttaaccaagcctcaaagcttactgaacataagttaattcataccggagagaaacgttatgaatgtgaagaatgcggcaaagcttttaaccgatcctcaaaacttactgaacataagtacattcatactggagagaagctgtacaaatgtgaagaatgtgacaaggcctttaacctgtcctcaacgcttactaaacataaggtaattcatactggagagaaactgtacaaatgtaaagaatgtggtaaagcttttaaacagttctcacaccttgctatacataatataattcatactggagagaaactctacaaatgtgaagaatgtggcaaagcttttaactcatcctcaaaccttactgcacataagaaaaatcgtactggagagaaaccctacaaatgtgaagaatgtggcaaagctaacctatcatcaacccttactccacataagacaattcatatttgagagaaaccctgcaaatgtgaagaatgtggcaatgcttgtaactaaatctcaaactttactaaacataagaaaattaatactggaaactttacaaacctgaaagatgtgacaatgattttgacaacaccttcaaacttttctaaacataaaataaatcatactggtgagaaatcttaaaaatatgaagaatggtacaaagcctttaaatggttgtcacacttgattgtaggtaagataatttatactggaggaaactcccagaagtgtgaagaatgtggcaaaacttttaatttttcacaccttagagcacaggaaagcacttcagaaaaattgtacaaatataaatgtggaaaagccattaatatctgcttacatcttactcaacattagagagttagtgcttaataaaagcattataaaagcaattagtgtaaaatcagaaaatgaaagttttttttttttttttagatggagtcttgctctgtcacccaggctggagtgcagtggtgtgatcttggctcactgcaacctctgcctcccaggttcaagcaattctcctgccttagcctccagagtagctgagaatacaggcacacaccaccacatttggctaatttttttatttttagtagagactggctatcaccatgttggccaggctgatcttgaactcctgacctcaagtgatccacatgcctctgcctcccaaagtgctgggattataggtgtgagtcactgtgcctgacaaatataagcctttaaagagaagaaggttttcattttgaagacaaacattaggtacataaagagggttgtagtgtctttacttgtatcacagattttattgtacacattatgtactaaaggaaaatcctgaagcagtgctcaaactttgatcaacatcagggagtttatattggagaaaaactgcaaatgtaatatatttggaaaaacatttttcaaaaactactgcttagaaaacaccaggggatttatactaaaatatatttttgcagatgcagtaagtataaaagaaatttaatccaaaattaagtgtgtgtaaatatcagagaattcacagtagaaatatctaaggcactgacattttagacattgaactaatcagtgtgctgagtacagaaaataatccaaaattaaagttggtagataaattatttgtatataactttaaaagaggtagaaatatttttagttataattacatttaaagtatacttttttctttgaaaaaattacaaaatttttaaaaagtgaatgatgtaattcaactcaaattacttcatgcttttcattctattcacatgtgaaagcatgtgatcaattgctgcttcatcaaagatatgagacattcttttttgttaggtgggcaatattttttaccttttctatggaagagtaaagacattacaatgtaggatgcatgataaaaatctaagtggagaggctctttgtgtttaatttataatattgaatgatgtatgagggaagtgttcagaggaatattctgcattctagtgaaaatatcttttattttagttaaaattaaattaaaattagtagtatatctttttactaactacttttatgtaataaaatgcagcacatttaaaaaattttagattattgtgaacttaattttttaattaaactttttttttaacatgttaagaccaattgtgcattcagtgaagtattatcatgccactaacttcaacctatcccaccttactcaagggtgttggtaaaagatagtaacaatgtactatttaataacagagtggactaacatctctaataatttctcttgccagtgactttaaactaaagaacttaattaaagaacattgttcccataggttaaatttttattctttttcttatttaaacatatttttcttaacttttgtgggtacatagtgtgtgtatatatttatgccatatatggcatattttgatacaggcatatgaataggtattaatcacatcagggcaaatgaaatatccatcaactccagcatttatcatttgtattacaaaccgattctacacttttagttactttaaaatgtacaagtaaattgctattgactatagggtcattttcatgggtataataaaaattatatacaagtataaataaaatcctgagtcttaaaattctgagtcctgcttaaacattttaaaaattttgttatgtatttttctttgaacatgtctctctgcctgcaaacataacagaattttagtattggtttacatagagttaactatacccatatattactctaaaaataaatgttaagtgcaagaaagttatggactgtttttgtgtgagtgtgagtttgtacctattttcaaaagaaaagagcaatattggaacaaaacaaatattttaataaattaatgtactagacaactgaaaacttcaaaaat

SEQ ID NO: 62079 - DNA, 4890 bp, Homo sapiens
gactaatggccctaactaagtattaacccctgccaagaaaagagctacttcctcttgaagtaaatgaagatagtgatgctttctcttaaactttacttataaaaagcatcaaaggggggaatgaagcaggaaatataaaaggaaaaacaagtaaagggaaaacaagtcctttcctgaccagtctgactcactccaaagtcctgctggagctatgataattatctgcaaggccaggcaggggctccgaaggagggctccaggagcagggatgagaaaaacaagttctccttatcagtttccctgtttgaaattctctccccataacattattctttgttctgctctcacaactatttttgtaactatttctgcaagtctgtaaagattttgtaagttcttgtttttctttctgtagcatggcaaggtcacaagacatgtttaagtaaggtaggctcatgttgcaaatcctgttgtaaaacctgtcaacggtatgattaactgcctttgttctgcttctgtaagactgctttctcacctcgcaggttttgcgccaaaaacccgacttgcccctgcctgatgcatgtataaaagtcaagccctgtctttgttccgggctcagcctttggatgttaatccgctgggccagtggccacctaaataaaaccttcctgttgcacccagtgatctctccggcctcctggttcccacaacatataagcattccttttctctgcaacctagcccgcatctgtcattgactttttgaacaataggcattctgactggatgagatggtatctcactgtggtttttctctgcatttttctaataattaacaacgtgaattttgttttcatgtgcttgtcagccacatgtatgtcttcttttgaaaagtatctgttcatgtttttgcttactttttaattaggtttttggttttctttttgttgttgttgttgttttctgagatggagtcttgctgtgtcaccaggatggagtgcagtggcatgatctcgactcactgcaacctccacctcccaggttcagatgattcttctgcttcagtctcctgagtagctgggatcacagggaccattgacatttatggatgtggccatagaattctctttggaggagtggcaatgcctggacactgcacagcagaatttatataggcatgtgatgtgagagaactacagaaacctggttttcttgggtgaaggtattgctgtctctaagccagacctgattacctgtctggagcaaggaaaagagccctggaatatgaagagacatgagatggtagctaaacatttagttatgttttattattttgcccaacacctttggccagagcagaacataagagattctttccagaaagtgaccctaagaagatatagaaaatgtggatatgagaatttacagttaagaaaaggctgtaaaagtgtggttgagtgtaaacagcacaaaggagattatagtggacttaaccaatgtttgaaaactaccttgagcaaaatatttcaatgtaataaatatgtagaagttttccataaaatttcaaattcaaatagacacaagatgagacatactgaaaataaacattttaaatgtaaagaatgtcgcaaaacattttgcatgctttcacacctaactcaacataaaagaatccaaactagagtgaatttctacaaatgtgaagcatatggaagagcctttaactggtcctcaacccttaataaacataagagaattcatactggagaaaaaccttacaaatgtaaagaatgtggcaaagcctttaaccagacctcacaccttattagacataagagaattcatactgaagagaaaccctacaaatgtgaagaatgtggcaaagcctttaaccagtcatcgacccttactacacataatataattcatactggggaaattccctacaaatgtgagaaatgtgttagagcttttaaccaagcctcaaagcttactgaacataagttaattcataccggagagaaacgttatgaatgtgaagaatgcggcaaagcttttaaccgatcctcaaaacttactgaacataagtacattcatactggagagaagctgtacaaatgtgaagaatgtgacaaggcctttaacctgtcctcaacgcttactaaacataaggtaattcatactggagagaaactgtacaaatgtaaagaatgtggtaaagcttttaaacagttctcacaccttgctatacataatataattcatactggagagaaactctacaaatgtgaagaatgtggcaaagcttttaactcatcctcaaaccttactgcacataagaaaaatcgtactggagagaaaccctacaaatgtgaagaatgtggcaaagctaacctatcatcaacccttactccacataagacaattcatatttgagagaaaccctgcaaatgtgaagaatgtggcaatgcttgtaactaaatctcaaactttactaaacataagaaaattaatactggaaactttacaaacctgaaagatgtgacaatgattttgacaacaccttcaaacttttctaaacataaaataaatcatactggtgagaaatcttaaaaatatgaagaatggtacaaagcctttaaatggttgtcacacttgattgtaggtaagataatttatactggaggaaactcccagaagtgtgaagaatgtggcaaaacttttaatttttcacaccttagagcacaggaaagcacttcagaaaaattgtacaaatataaatgtggaaaagccattaatatctgcttacatcttactcaacattagagagttagtgcttaataaaagcattataaaagcaattagtgtaaaatcagaaaatgaaagttttttttttttttttagatggagtcttgctctgtcacccaggctggagtgcagtggtgtgatcttggctcactgcaacctctgcctcccaggttcaagcaattctcctgccttagcctccagagtagctgagaatacaggcacacaccaccacatttggctaatttttttatttttagtagagactggctatcaccatgttggccaggctgatcttgaactcctgacctcaagtgatccacatgcctctgcctcccaaagtgctgggattataggtgtgagtcactgtgcctgacaaatataagcctttaaagagaagaaggttttcattttgaagacaaacattaggtacataaagagggttgtagtgtctttacttgtatcacagattttattgtacacattatgtactaaaggaaaatcctgaagcagtgctcaaactttgatcaacatcagggagtttatattggagaaaaactgcaaatgtaatatatttggaaaaacatttttcaaaaactactgcttagaaaacaccaggggatttatactaaaatatatttttgcagatgcagtaagtataaaagaaatttaatccaaaattaagtgtgtgtaaatatcagagaattcacagtagaaatatctaaggcactgacattttagacattgaactaatcagtgtgctgagtacagaaaataatccaaaattaaagttggtagataaattatttgtatataactttaaaagaggtagaaatatttttagttataattacatttaaagtatacttttttctttgaaaaaattacaaaatttttaaaaagtgaatgatgtaattcaactcaaattacttcatgcttttcattctattcacatgtgaaagcatgtgatcaattgctgcttcatcaaagatatgagacattcttttttgttaggtgggcaatattttttaccttttctatggaagagtaaagacattacaatgtaggatgcatgataaaaatctaagtggagaggctctttgtgtttaatttataatattgaatgatgtatgagggaagtgttcagaggaatattctgcattctagtgaaaatatcttttattttagttaaaattaaattaaaattagtagtatatctttttactaactacttttatgtaataaaatgcagcacatttaaaaaattttagattattgtgaacttaattttttaattaaactttttttttaacatgttaagaccaattgtgcattcagtgaagtattatcatgccactaacttcaacctatcccaccttactcaagggtgttggtaaaagatagtaacaatgtactatttaataacagagtggactaacatctctaataatttctcttgccagtgactttaaactaaagaacttaattaaagaacattgttcccataggttaaatttttattctttttcttatttaaacatatttttcttaacttttgtgggtacatagtgtgtgtatatatttatgccatatatggcatattttgatacaggcatatgaataggtattaatcacatcagggcaaatgaaatatccatcaactccagcatttatcatttgtattacaaaccgattctacacttttagttactttaaaatgtacaagtaaattgctattgactatagggtcattttcatgggtataataaaaattatatacaagtataaataaaatcctgagtcttaaaattctgagtcctgcttaaacattttaaaaattttgttatgtatttttctttgaacatgtctctctgcctgcaaacataacagaattttagtattggtttacatagagttaactatacccatatattactctaaaaataaatgttaagtgcaagaaagttatggactgtttttgtgtgagtgtgagtttgtacctattttcaaaagaaaagagcaatattggaacaaaacaaatattttaataaattaatgtactagacaactgaaaacttcaaaaat

SEQ ID NO: 62080 - DNA, 4055 bp, Homo sapiens
acgcgtccgcccacgcgtccggagaagttacacaaatgtgatgaatgtgacaaagcttttaaccaatcttcaaccctttctacacataaaagaattcatactggagagaaaccctacaaatgtgaagaatgtggcagagcttttaattgatcatcaaaccttattaaacataagaaaattcatattggagagaaaccctacaaatgtgaagaatgtggaaaagcttttaaccagttctcaactcttactacacataaaataattcatactggagagaaaccatataaatgtgaagaatgtggcaaagctttcaacctatacgtaaaccttactacacataagaaaattcatactggagagaaaccctacaagtgtgaagaatgtggcaaagcttttagccaagtgtcaactcttactatacataaaagaattcatacagcagaatttatataggcatgtgatgtgagagaactacagaaacctggttttcttgggtgaaggtattgctgtctctaagccagacctgattacctgtctggagcaaggaaaagagccctggaatatgaagagacatgagatggtagctaaacatttagttatgttttattattttgcccaacacctttggccagagcagaacataagagattctttccagaaagtgaccctaagaagatatagaaaatgtggatatgagaatttacagttaagaaaaggctgtaaaagtgtggttgagtgtaaacagcacaaaggagattatagtggacttaaccaatgtttgaaaactaccttgagcaaaatatttcaatgtaataaatatgtagaagttttccataaaatttcaaattcaaatagacacaagatgagacatactgaaaataaacattttaaatgtaaagaatgtcgcaaaacattttgcatgctttcacacctaactcaacataaaagaatccaaactagagtgaatttctacaaatgtgaagcatatggaagagcctttaactggtcctcaacccttaataaacataagagaattcatactggagaaaaaccttacaaatgtaaagaatgtggcaaagcctttaaccagacctcacaccttattagacataagagaattcatactgaagagaaaccctacaaatgtgaagaatgtggcaaagcctttaaccagtcatcgacccttactacacataatataattcatactggggaaattccctacaaatgtgagaaatgtgttagagcttttaaccaagcctcaaagcttactgaacataagttaattcataccggagagaaacgttatgaatgtgaagaatgcggcaaagcttttaaccgatcctcaaaacttactgaacataagtacattcatactggagagaagctgtacaaatgtgaagaatgtgacaaggcctttaacctgtcctcaacgcttactaaacataaggtaattcatactggagagaaactgtacaaatgtaaagaatgtggtaaagcttttaaacagttctcacaccttgctatacataatataattcatactggagagaaactctacaaatgtgaagaatgtggcaaagcttttaactcatcctcaaaccttactgcacataagaaaaatcgtactggagagaaaccctacaaatgtgaagaatgtggcaaagctaacctatcatcaacccttactccacataagacaattcatatttgagagaaaccctgcaaatgtgaagaatgtggcaatgcttgtaactaaatctcaaactttactaaacataagaaaattaatactggaaactttacaaacctgaaagatgtgacaatgattttgacaacaccttcaaacttttctaaacataaaataaatcatactggtgagaaatcttaaaaatatgaagaatggtacaaagcctttaaatggttgtcacacttgattgtaggtaagataatttatactggaggaaactcccagaagtgtgaagaatgtggcaaaacttttaatttttcacaccttagagcacaggaaagcacttcagaaaaattgtacaaatataaatgtggaaaagccattaatatctgcttacatcttactcaacattagagagttagtgcttaataaaagcattataaaagcaattagtgtaaaatcagaaaatgaaagttttttttttttttttagatggagtcttgctctgtcacccaggctggagtgcagtggtgtgatcttggctcactgcaacctctgcctcccaggttcaagcaattctcctgccttagcctccagagtagctgagaatacaggcacacaccaccacatttggctaatttttttatttttagtagagactggctatcaccatgttggccaggctgatcttgaactcctgacctcaagtgatccacatgcctctgcctcccaaagtgctgggattataggtgtgagtcactgtgcctgacaaatataagcctttaaagagaagaaggttttcattttgaagacaaacattaggtacataaagagggttgtagtgtctttacttgtatcacagattttattgtacacattatgtactaaaggaaaatcctgaagcagtgctcaaactttgatcaacatcagggagtttatattggagaaaaactgcaaatgtaatatatttggaaaaacatttttcaaaaactactgcttagaaaacaccaggggatttatactaaaatatatttttgcagatgcagtaagtataaaagaaatttaatccaaaattaagtgtgtgtaaatatcagagaattcacagtagaaatatctaaggcactgacattttagacattgaactaatcagtgtgctgagtacagaaaataatccaaaattaaagttggtagataaattatttgtatataactttaaaagaggtagaaatatttttagttataattacatttaaagtatacttttttctttgaaaaaattacaaaatttttaaaaagtgaatgatgtaattcaactcaaattacttcatgcttttcattctattcacatgtgaaagcatgtgatcaattgctgcttcatcaaagatatgagacattcttttttgttaggtgggcaatattttttaccttttctatggaagagtaaagacattacaatgtaggatgcatgataaaaatctaagtggagaggctctttgtgtttaatttataatattgaatgatgtatgagggaagtgttcagaggaatattctgcattctagtgaaaatatcttttattttagttaaaattaaattaaaattagtagtatatctttttactaactacttttatgtaataaaatgcagcacatttaaaaaattttagattattgtgaacttaattttttaattaaactttttttttaacatgttaagaccaattgtgcattcagtgaagtattatcatgccactaacttcaacctatcccaccttactcaagggtgttggtaaaagatagtaacaatgtactatttaataacagagtggactaacatctctaataatttctcttgccagtgactttaaactaaagaacttaattaaagaacattgttcccataggttaaatttttattctttttcttatttaaacatatttttcttaacttttgtgggtacatagtgtgtgtatatatttatgccatatatggcatattttgatacaggcatatgaataggtattaatcacatcagggcaaatgaaatatccatcaactccagcatttatcatttgtattacaaaccgattctacacttttagttactttaaaatgtacaagtaaattgctattgactatagggtcattttcatgggtataataaaaattatatacaagtataaataaaatcctgagtcttaaaattctgagtcctgcttaaacattttaaaaattttgttatgtatttttctttgaacatgtctctctgcctgcaaacataacagaattttagtattggtttacatagagttaactatacccatatattactctaaaaataaatgttaagtgcaagaaagttatgga

SEQ ID NO: 62081 - DNA, 2988 bp, Homo sapiens
aaacttactacacataagaaaattcatacaggagagaaaccttacaaatgtgaaaaatgtgctaaagcttttagccagtcttcaaccctttctacatataagataattcacactggagagaaatgctacaaatgtgaagaatgtggcaaagtttttaaccgatcttcaaaccttacagaccataaaaaaattcatacaggagagaaatcctacaaatgtgaagaatgtgacaaggcctttaacctgtcctcaacgcttactaaacataaggtaattcatactggagagaaactgtacaaatgtaaagaatgtggtaaagcttttaaacagttctcacaccttgctatacataatataattcatactggagagaaactctacaaatgtgaagaatgtggcaaagcttttaactcatcctcaaaccttactgcacataagaaaaatcgtactggagagaaaccctacaaatgtgaagaatgtggcaaagctaacctatcatcaacccttactccacataagacaattcatatttgagagaaaccctgcaaatgtgaagaatgtggcaatgcttgtaactaaatctcaaactttactaaacataagaaaattaatactggaaactttacaaacctgaaagatgtgacaatgattttgacaacaccttcaaacttttctaaacataaaataaatcatactggtgagaaatcttaaaaatatgaagaatggtacaaagcctttaaatggttgtcacacttgattgtaggtaagataatttatactggaggaaactcccagaagtgtgaagaatgtggcaaaacttttaatttttcacaccttagagcacaggaaagcacttcagaaaaattgtacaaatataaatgtggaaaagccattaatatctgcttacatcttactcaacattagagagttagtgcttaataaaagcattataaaagcaattagtgtaaaatcagaaaatgaaagttttttttttttttttagatggagtcttgctctgtcacccaggctggagtgcagtggtgtgatcttggctcactgcaacctctgcctcccaggttcaagcaattctcctgccttagcctccagagtagctgagaatacaggcacacaccaccacatttggctaatttttttatttttagtagagactggctatcaccatgttggccaggctgatcttgaactcctgacctcaagtgatccacatgcctctgcctcccaaagtgctgggattataggtgtgagtcactgtgcctgacaaatataagcctttaaagagaagaaggttttcattttgaagacaaacattaggtacataaagagggttgtagtgtctttacttgtatcacagattttattgtacacattatgtactaaaggaaaatcctgaagcagtgctcaaactttgatcaacatcagggagtttatattggagaaaaactgcaaatgtaatatatttggaaaaacatttttcaaaaactactgcttagaaaacaccaggggatttatactaaaatatatttttgcagatgcagtaagtataaaagaaatttaatccaaaattaagtgtgtgtaaatatcagagaattcacagtagaaatatctaaggcactgacattttagacattgaactaatcagtgtgctgagtacagaaaataatccaaaattaaagttggtagataaattatttgtatataactttaaaagaggtagaaatatttttagttataattacatttaaagtatacttttttctttgaaaaaattacaaaatttttaaaaagtgaatgatgtaattcaactcaaattacttcatgcttttcattctattcacatgtgaaagcatgtgatcaattgctgcttcatcaaagatatgagacattcttttttgttaggtgggcaatattttttaccttttctatggaagagtaaagacattacaatgtaggatgcatgataaaaatctaagtggagaggctctttgtgtttaatttataatattgaatgatgtatgagggaagtgttcagaggaatattctgcattctagtgaaaatatcttttattttagttaaaattaaattaaaattagtagtatatctttttactaactacttttatgtaataaaatgcagcacatttaaaaaattttagattattgtgaacttaattttttaattaaactttttttttaacatgttaagaccaattgtgcattcagtgaagtattatcatgccactaacttcaacctatcccaccttactcaagggtgttggtaaaagatagtaacaatgtactatttaataacagagtggactaacatctctaataatttctcttgccagtgactttaaactaaagaacttaattaaagaacattgttcccataggttaaatttttattctttttcttatttaaacatatttttcttaacttttgtgggtacatagtgtgtgtatatatttatgccatatatggcatattttgatacaggcatatgaataggtattaatcacatcagggcaaatgaaatatccatcaactccagcatttatcatttgtattacaaaccgattctacacttttagttactttaaaatgtacaagtaaattgctattgactatagggtcattttcatgggtataataaaaattatatacaagtataaataaaatcctgagtcttaaaattctgagtcctgcttaaacattttaaaaattttgttatgtatttttctttgaacatgtctctctgcctgcaaacataacagaattttagtattggtttacatagagttaactatacccatatattactctaaaaataaatgttaagtgcaagaaagttatggactgtttttgtgtgagtgtgagtttgtacctattttcaaaagaaaagagcaatattggaacaaaacaaatattttaataaattaatgtactagacaactgaaaacttcaaaaat

SEQ ID NO: 62082 - DNA, 337 bp, Homo sapiens
gtatatcaggacacaacagatccaaacgcatctctgcaaatatcgctcagctgaggagatgcagagattactgaaattttaatccattaattaaaagatattatcttcattcattcttcatgaattactacctcagttgctttgctatataaattttcccaactcaaatgctcttctccccactaccccccgacaccaatcccaaacaactcaagctcctatccttccatgaaacattttttccaaagacattccgggtcccactgattaatcttttctcagaacttctattagagagtctatcccacatagttgaatcttggagtctattctattt

SEQ ID NO: 62083 - DNA, 1016 bp, Homo sapiens
aattggcaacccggaagcggtcggtagtgcggcgctgtttaaagatggcggcggaggaacctcagcagcagaagcaggagccgctgggcagcgactccgaaggtgttaactgtctggcctatgatgaagccatcatggctcagcaggaccgaattcagcaagagattgctgtgcagaaccctctggtgtcagagcggctggagctctcggtcctatacaaggagtatgctgaagatgacaacatctatcaacagaagatcaaggacctccacaaaaagtactcgtacatccgcaagaccaggcctgacggcaactgtttctatcgggctttcggattctcccacttggaggcactgctggatgacagcaaggagttgcagcggttcaaggctgtgtctgccaagagcaaggaagacctggtgtcccagggcttcactgaattcacaattgaggatttccacaacacgttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtga

SEQ ID NO: 62084 - DNA, 1720 bp, Homo sapiens
atggtgctaaggaaaatacgtgcggcgctgtttaaagatggcggcggaggaacctcagcagcagaagcaggagccgctgggcagcgactccgaaggtgttaactgtctggcctatgatgaagccatcatggctcagcaggaccgaattcagcaagagattgctgtgcagaaccctctggtgtcagagcggctggagctctcggtcctatacaaggagtatgctgaagatgacaacatctatcaacagaagatcaaggacctccacaaaaagtactcgtacatccgcaagaccaggcctgacggcaactgtttctatcgggctttcggattctcccacttggaggcactgctggatgacagcaaggagttgcagcggttcaaggctgtgtctgccaagagcaaggaagacctggtgtcccagggcttcactgaattcacaattgaggatttccacaacacgttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgagccgtgtgtgcgtgtccctgctctgctgcccgcctggctgctctgtctgctgccccctccccccaggtgggtccccctgcttttcacctatctactcctgagcttccccaacaggagcaggtttgaggggccaggcctcttggaggcccctcctgcttcgttgggttctgcttccttcccttcttagctggctcaggggcttctatgggatcctggaagttccttagggacttgcccagggtcccagggccacccacacttcatctgctccctcataggccccacctccacgtcccggctgggccccagaccccagcttcctgccctccaccgggagtctgcatggttgggagtcctgggtggaggggcctttgtgaggctggacccggctcagggcaggtggaggagctgggcctcccacagggtgcccgggcagtgccatcctggtgggggagggcagccttcaaacgtgtggggtctacagtcctcaggtctaggcagggctgccggttctccacctccccatccgccccaggccccctgcctgtgcctgccttgcaccccctctgcttgggccacggtgtctctgcattgcctgcctttttgccttcacctcttttcttccccgccccctgcacattcggggtctcagcccccaggctgtgagctccttgggggcaggccctcaataaatgtgaactgctgctgccg

SEQ ID NO: 62085 - DNA, 1786 bp, Homo sapiens
aattggcaacccggaagcggtcggtagtgcggcgctgtttaaagatggcggcggaggaacctcagcagcagaagcaggagccgctgggcagcgactccgaaggtgttaactgtctggcctatgatgaagccatcatggctcagcaggaccgaattcagcaagagattgctgtgcagaaccctctggtgtcagagcggctggagctctcggtcctatacaaggagtatgctgaagatgacaacatctatcaacagaagatcaaggacctccacaaaaagtactcgtacatccgcaagaccaggcctgacggcaactgtttctatcgggctttcggattctcccacttggaggcactgctggatgacagcaaggagttgcagcggttcaaggctgtgtctgccaagagcaaggaagacctggtgtcccagggcttcactgaattcacaattgaggatttccacaacacgttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgagccgtgtgtgcgtgtccctgctctgctgcccgcctggctgctctgtctgctgccccctccccccaggtgggtccccctgcttttcacctatctactcctgagcttccccaacaggagcaggtttgaggggccaggcctcttggaggcccctcctgcttcgttgggttctgcttccttcccttcttagctggctcaggggcttctatgggatcctggaagttccttagggacttgcccagggtcccagggccacccacacttcatctgctccctcataggccccacctccacgtcccggctgggccccagaccccagcttcctgccctccaccgggagtctgcatggttgggagtcctgggtggaggggcctttgtgaggctggacccggctcagggcaggtggaggagctgggcctcccacagggtgcccgggcagtgccatcctggtgggggagggcagccttcaaacgtgtggggtctacagtcctcaggtctaggcagggctgccggttctccacctccccatccgccccaggccccctgcctgtgcctgccttgcaccccctctgcttgggccacggtgtctctgcattgcctgcctttttgccttcacctcttttcttccccgccccctgcacattcggggtctcagcccccaggctgtgagctccttgggggcaggccctcaataaatgtgaactgctgctgccgcctctgccgtccgcctgtgcctctgcccgcctggctcaccgagagctcttgccagcccc

SEQ ID NO: 62086 - DNA, 1152 bp, Homo sapiens
  misc_feature (1144)..(1144): n is a, c, g, or t
aattggcaacccggaagcggtcggtagtgcggcgctgtttaaagatggcggcggaggaacctcagcagcagaagcaggagccgctgggcagcgactccgaaggtgttaactgtctggcctatgatgaagccatcatggctcagcaggaccgaattcagcaagagattgctgtgcagaaccctctggtgtcagagcggctggagctctcggtcctatacaaggagtatgctgaagatgacaacatctatcaacagaagatcaaggacctccacaaaaagtactcgtacatccgcaagaccaggcctgacggcaactgtttctatcgggctttcggattctcccacttggaggcactgctggatgacagcaaggagttgcagcggttcaaggctgtgtctgccaagagcaaggaagacctggtgtcccagggcttcactgaattcacaattgaggatttccacaacacgttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgagccgtgtgtgcgtgtccctgctctgctgcccgcctggctgctctgtctgctgccctccccagtggtccctgctttactactatctgacttctacagacagttgaggcagctcttgagcctctctcgtngtttctct

SEQ ID NO: 62087 - DNA, 1711 bp, Homo sapiens
aattggcaacccggaagcggtcggtagtgcggcgctgtttaaagatggcggcggaggaacctcagcagcagaagcaggagccgctgggcagcgactccgaaggtgttaactgtctggcctatgatgaagccatcatggctcagcaggaccgaattcagcaagagattgctgtgcagaaccctctggtgtcagagcggctggagctctcggtcctatacaaggagtatgctgaagatgacaacatctatcaacagaagatcaaggacctccacaaaaagtactcgtacatccgcaagaccaggcctgacggcaactgtttctatcgggctttcggattctcccacttggaggcactgctggatgacagcaaggagttgcagcggttcaaggctgtgtctgccaagagcaaggaagacctggtgtcccagggcttcactgaattcacaattgaggatttccacaacacgttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgaaaaaaaaaaaaaaaaaaaaaaaaaaaaaaaaaaaaaaaaaaaaaaaaaaaaaaaagagagaggggcgcgcgcgcccccaaaaatatctcccccgcggggggcgcccaaccccacgcgcgcccccccgagtttctgtgggcacaagagaggggcgccccacaaagagaggagcgacggcgtatatatatataaacaccgcgagacggcgcgcgtggcgcgcgcgcgggattataaacacagcggggggcgagcggcgggggaacaacacgcggcggacaagcggggagaagaactctctatcggaggacaagagagacgcgcgcctctctatctctgtcgcggggggagggggtgcgacgagaaacatattgtgtgtggggggcgacacacatctctctccctacctagacgagagatatatatcaaacgcctctctctagagagggagcgatacattctctatcacacatcttctctacaagcgtgtcgtgtcatcaagggggggtgggtgagtacacacccgcgacgagggcgtgctgacaatgtagtgtgtggcgccaacgggtgcctgtagtgaaaaaagcctgtctctggcgcacctctcgcgtgtgcagctctctatttcattatatcagccgcaaaacaacctctttatttatatccacccggggggggcgctcctataacgaaacaca

SEQ ID NO: 62088 - DNA, 1831 bp, Homo sapiens
aattggcaacccggaagcggtcggtagtgcggcgctgtttaaagatggcggcggaggaacctcagcagcagaagcaggagccgctgggcagcgactccgaaggtgttaactgtctggcctatgatgaagccatcatggctcagcaggaccgaattcagcaagagattgctgtgcagaaccctctggtgtcagagcggctggagctctcggtcctatacaaggagtatgctgaagatgacaacatctatcaacagaagatcaaggacctccacaaaaagtactcgtacatccgcaagaccaggcctgacggcaactgtttctatcgggctttcggattctcccacttggaggcactgctggatgacagcaaggagttgcagcggttcaaggctgtgtctgccaagagcaaggaagacctggtgtcccagggcttcactgaattcacaattgaggatttccacaacacgttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggtgccgtccccctcccctttactctcggccgggggagtgcagtgggcccacagggcctggggcggggtgcggagaccagggcctgaccggcacctgtgccacaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgagccgtgtgtgcgtgtccctgctctgctgcccgcctggctgctctgtctgctgccccctccccccaggtgggtccccctgcttttcacctatctactcctgagcttccccaacaggagcaggtttgaggggccaggcctcttggaggcccctcctgcttcgttgggttctgcttccttcccttcttagctggctcaggggcttctatgggatcctggaagttccttagggacttgcccagggtcccagggccacccacacttcatctgctccctcataggccccacctccacgtcccggctgggccccagaccccagcttcctgccctccaccgggagtctgcatggttgggagtcctgggtggaggggcctttgtgaggctggacccggctcagggcaggtggaggagctgggcctcccacagggtgcccgggcagtgccatcctggtgggggagggcagccttcaaacgtgtggggtctacagtcctcaggtctaggcagggctgccggttctccacctccccatccgccccaggccccctgcctgtgcctgccttgcaccccctctgcttgggccacggtgtctctgcattgcctgcctttttgccttcacctcttttcttccccgccccctgcacattcggggtctcagcccccaggctgtgagctccttgggggcaggccctcaataaatgtgaactgctgctgccg

SEQ ID NO: 62089 - DNA, 1683 bp, Homo sapiens
cggccctgggatgtgaggggcctgcgggatctgtccctgaggcctgcgactttttctggtgttaactgtctggcctatgatgaagccatcatggctcagcaggaccgaattcagcaagagattgctgtgcagaaccctctggtgtcagagcggctggagctctcggtcctatacaaggagtatgctgaagatgacaacatctatcaacagaagatcaaggacctccacaaaaagtactcgtacatccgcaagaccaggcctgacggcaactgtttctatcgggctttcggattctcccacttggaggcactgctggatgacagcaaggagttgcagcggttcaaggctgtgtctgccaagagcaaggaagacctggtgtcccagggcttcactgaattcacaattgaggatttccacaacacgttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgagccgtgtgtgcgtgtccctgctctgctgcccgcctggctgctctgtctgctgccccctccccccaggtgggtccccctgcttttcacctatctactcctgagcttccccaacaggagcaggtttgaggggccaggcctcttggaggcccctcctgcttcgttgggttctgcttccttcccttcttagctggctcaggggcttctatgggatcctggaagttccttagggacttgcccagggtcccagggccacccacacttcatctgctccctcataggccccacctccacgtcccggctgggccccagaccccagcttcctgccctccaccgggagtctgcatggttgggagtcctgggtggaggggcctttgtgaggctggacccggctcagggcaggtggaggagctgggcctcccacagggtgcccgggcagtgccatcctggtgggggagggcagccttcaaacgtgtggggtctacagtcctcaggtctaggcagggctgccggttctccacctccccatccgccccaggccccctgcctgtgcctgccttgcaccccctctgcttgggccacggtgtctctgcattgcctgcctttttgccttcacctcttttcttccccgccccctgcacattcggggtctcagcccccaggctgtgagctccttgggggcaggccctcaataaatgtgaactgctgctgccg

SEQ ID NO: 62090 - DNA, 1791 bp, Homo sapiens
  misc_feature (42)..(42): n is a, c, g, or t
caacaacgtcacggccaacggatgcgcaggcccccggtgagngttgtaaaagatcggacgagggtgcggcgctgtttaaagatggcggcggaggaacctcagcagcagaagcaggagccgctgggcagcgactccgaaggtgttaactgtctggcctatgatgaagccatcatggctcagcaggaccgaattcagcaagaggacatgacagatccctgcctcctccagattgctgtgcagaaccctctggtgtcagagcggctggagctctcggtcctatacaaggagtatgctgaagatgacaacatctatcaacagaagatcaaggacctccacaaaaagtactcgtacatccgcaagaccaggcctgacggcaactgtttctatcgggctttcggattctcccacttggaggcactgctggatgacagcaaggagttgcagcggttcaaggctgtgtctgccaagagcaaggaagacctggtgtcccagggcttcactgaattcacaattgaggatttccacaacacgttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgagccgtgtgtgcgtgtccctgctctgctgcccgcctggctgctctgtctgctgccccctccccccaggtgggtccccctgcttttcacctatctactcctgagcttccccaacaggagcaggtttgaggggccaggcctcttggaggcccctcctgcttcgttgggttctgcttccttcccttcttagctggctcaggggcttctatgggatcctggaagttccttagggacttgcccagggtcccagggccacccacacttcatctgctccctcataggccccacctccacgtcccggctgggccccagaccccagcttcctgccctccaccgggagtctgcatggttgggagtcctgggtggaggggcctttgtgaggctggacccggctcagggcaggtggaggagctgggcctcccacagggtgcccgggcagtgccatcctggtgggggagggcagccttcaaacgtgtggggtctacagtcctcaggtctaggcagggctgccggttctccacctccccatccgccccaggccccctgcctgtgcctgccttgcaccccctctgcttgggccacggtgtctctgcattgcctgcctttttgccttcacctcttttcttccccgccccctgcacattcggggtctcagcccccaggctgtgagctccttgggggcaggccctcaataaatgtgaactgctgctgccg

SEQ ID NO: 62091 - DNA, 2080 bp, Homo sapiens
  misc_feature (42)..(42): n is a, c, g, or t
caacaacgtcacggccaacggatgcgcaggcccccggtgagngttgtaaaagatcggacgagggtgcggcgctgtttaaagatggcggcggaggaacctcagcagcagaagcaggagccgctgggcagcgactccgaaggtgttaactgtctggcctatgatgaagccatcatggctcagcaggaccgaattcagcaagagattgctgtgcagaaccctctggtgtcagagcggctggagctctcggtcctatacaaggagtatgctgaagatgacaacatctatcaacagaagatcaaggacctccacaaaaagtactcgtacatccgcaagaccaggcctgacggcaactgtttctatcgggctttcggattctcccacttggaggcactgctggatgacagcaaggagttgcagcggtgagaagggtgggcactgggcaccgaggcaggtgggtgtctacctcctccccgggcgagtaggatgtgtctcgagtagggtgtctccctccttcccgggcgatgggctggactctggccttgccaggcggggcagtgctgtctcggccctggcgtctgggctggtcgaggagcccatgctgggcccgcctttccatcccacccccaggttcaaggctgtgtctgccaagagcaaggaagacctggtgtcccagggcttcactgaattcacaattgaggatttccacaacacggtgagccctggtgcctgtcttgggctgggccatgggggaggggttcacctggtgaggaccacccatctcctccccgtcatcttgccctttctccctccgtggctgcagttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgagccgtgtgtgcgtgtccctgctctgctgcccgcctggctgctctgtctgctgccccctccccccaggtgggtccccctgcttttcacctatctactcctgagcttccccaacaggagcaggtttgaggggccaggcctcttggaggcccctcctgcttcgttgggttctgcttccttcccttcttagctggctcaggggcttctatgggatcctggaagttccttagggacttgcccagggtcccagggccacccacacttcatctgctccctcataggccccacctccacgtcccggctgggccccagaccccagcttcctgccctccaccgggagtctgcatggttgggagtcctgggtggaggggcctttgtgaggctggacccggctcagggcaggtggaggagctgggcctcccacagggtgcccgggcagtgccatcctggtgggggagggcagccttcaaacgtgtggggtctacagtcctcaggtctaggcagggctgccggttctccacctccccatccgccccaggccccctgcctgtgcctgccttgcaccccctctgcttgggccacggtgtctctgcattgcctgcctttttgccttcacctcttttcttccccgccccctgcacattcggggtctcagcccccaggctgtgagctccttgggggcaggccctcaataaatgtgaactgctgctgccg

SEQ ID NO: 62092 - DNA, 1921 bp, Homo sapiens
  misc_feature (42)..(42): n is a, c, g, or t
caacaacgtcacggccaacggatgcgcaggcccccggtgagngttgtaaaagatcggacgagggtgcggcgctgtttaaagatggcggcggaggaacctcagcagcagaagcaggagccgctgggcagcgactccgaaggtgttaactgtctggcctatgatgaagccatcatggctcagcaggaccgaattcagcaagagattgctgtgcagaaccctctggtgtcagagcggctggagctctcggtcctatacaaggagtatgctgaagatgacaacatctatcaacagaagatcaagtgtttctatcgggctttcggattctcccacttggaggcactgctggatgacagcaaggagttgcagcggtgagaagggtgggcactgggcaccgaggcaggtgggtgtctacctcctccccgggcgagtaggatgtgtctcgagtagggtgtctccctccttcccgggcgatgggctggactctggccttgccaggcggggcagtgctgtctcggccctggcgtctgggctggtcgaggagcccatgctgggcccgcctttccatcccacccccaggttcaaggctgtgtctgccaagagcaaggaagacctggtgtcccagggcttcactgaattcacaattgaggatttccacaacacgttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgagccgtgtgtgcgtgtccctgctctgctgcccgcctggctgctctgtctgctgccccctccccccaggtgggtccccctgcttttcacctatctactcctgagcttccccaacaggagcaggtttgaggggccaggcctcttggaggcccctcctgcttcgttgggttctgcttccttcccttcttagctggctcaggggcttctatgggatcctggaagttccttagggacttgcccagggtcccagggccacccacacttcatctgctccctcataggccccacctccacgtcccggctgggccccagaccccagcttcctgccctccaccgggagtctgcatggttgggagtcctgggtggaggggcctttgtgaggctggacccggctcagggcaggtggaggagctgggcctcccacagggtgcccgggcagtgccatcctggtgggggagggcagccttcaaacgtgtggggtctacagtcctcaggtctaggcagggctgccggttctccacctccccatccgccccaggccccctgcctgtgcctgccttgcaccccctctgcttgggccacggtgtctctgcattgcctgcctttttgccttcacctcttttcttccccgccccctgcacattcggggtctcagcccccaggctgtgagctccttgggggcaggccctcaataaatgtgaactgctgctgccg

SEQ ID NO: 62093 - DNA, 1815 bp, Homo sapiens
aattggcaacccggaagcggtcggtagtgcggcgctgtttaaagatggcggcggaggaacctcagcagcagaagcaggagccgctgggcagcgactccgaaggtgttaactgtctggcctatgatgaagccatcatggctcagcaggaccgaattcagcaagagattgctgtgcagaaccctctggtgtcagagcggctggagctctcggtcctatacaaggagtatgctgaagatgacaacatctatcaacagaagatcaaggacctccacaaaaagtactcgtacatccgcaagaccaggcctgacggcaactgtttctatcgggctttcggattctcccacttggaggcactgctggatgacagcaaggagttgcagcggttcaaggctgtgtctgccaagagcaaggaagacctggtgtcccagggcttcactgaattcacaattgaggatttccacaacacgttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggtgccgtccccctcccctttactctcggccgggggagtgcagtgggcccacagggcctggggcggggtgcggagaccagggcctgaccggcacctgtgccacaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgaaaaaaaaaaaaaaaaaaaaaaaaaaaaaaaaaaaaaaaaaaaaaaaaaaaaaaaagagagaggggcgcgcgcgcccccaaaaatatctcccccgcggggggcgcccaaccccacgcgcgcccccccgagtttctgtgggcacaagagaggggcgccccacaaagagaggagcgacggcgtatatatatataaacaccgcgagacggcgcgcgtggcgcgcgcgcgggattataaacacagcggggggcgagcggcgggggaacaacacgcggcggacaagcggggagaagaactctctatcggaggacaagagagacgcgcgcctctctatctctgtcgcggggggagggggtgcgacgagaaacatattgtgtgtggggggcgacacacatctctctccctacctagacgagagatatatatcaaacgcctctctctagagagggagcgatacattctctatcacacatcttctctacaagcgtgtcgtgtcatcaagggggggtgggtgagtacacacccgcgacgagggcgtgctgacaatgtagtgtgtggcgccaacgggtgcctgtagtgaaaaaagcctgtctctggcgcacctctcgcgtgtgcagctctctatttcattatatcagccgcaaaacaacctctttatttatatccacccggggggggcgctcctataacgaaacaca

SEQ ID NO: 62094 - DNA, 1207 bp, Homo sapiens
gaggttacccgggaggcggaggttatggtgagcctagatcataccattgcactccagcctgggcaagaagagcgaaactccatctcaacaaaaactaaaacaaaacaaaacaaaacaaaacaaaacaaaacaaaacaaaacaccactctggagaggccgaagcaggtggaggattacgaggtcaggagatcaagatcatcctggctaacatggtgaaaccccgtctctggtccgagcggaccggtccgctcggaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgagccgtgtgtgcgtgtccctgctctgctgcccgcctggctgctctgtctgctgccccctccccccaggtgggtccccctgcttttcacctatctactcctgagcttccccaacaggagcaggtttgaggggccaggcctcttggaggcccctcctgcttcgttgggttctgcttccttcccttcttagctggctcaggggcttctatgggatcctggaagttccttagggacttgcccagggtcccagggccacccacacttcatctgctccctcataggccccacctccacgtcccggctgggccccagaccccagcttcctgccctccaccgggagtctgcatggttgggagtcctgggtggaggggcctttgtgaggctggacccggctcagggcaggtggaggagctgggcctcccacagggtgcccgggcagtgccatcctggtgggggagggcagccttcaaacgtgtggggtctacagtcctcaggtctaggcagggctgccggttctccacctccccatccgccccaggccccctgcctgtgcctgccttgcaccccctctgcttgggccacggtgtctctgcattgcctgcctttttgccttcacctcttttcttccccgccccctgcacattcggggtctcagcccccaggctgtgagctccttgggggcaggccctcaataaatgtgaactgctgctgccg

SEQ ID NO: 62095 - DNA, 342 bp, Homo sapiens
gttaactgtctggcctatgatgaagccatcatggctcagcaggaccgaattcagcaagaggtgaggggctgcagtgggcgagggaggcagtggccagcagccccattgtggaaatgcataggctgggcatgaggcctattgtctgtctctactttggaagctccctcctccctaggctatgctaggtactggtgcttttctgggggtcgctgtgccaccgggtgaccagcccagctcttttgtagttattctgtctgttaggcatgggtcactccatctccctgctaggacatgacagatccctgcctcctccagattgctgtgcagaaccctctggtgtca

SEQ ID NO: 62096 - DNA, 1727 bp, Homo sapiens
aattggcaacccggaagcggtcggtagtgcggcgctgtttaaagatggcggcggaggaacctcagcagcagaagcaggagccgctgggcagcgactccgaaggtgttaactgtctggcctatgatgaagccatcatggctcagcaggaccgaattcagcaagagattgctgtgcagaaccctctggtgtcagagcggctggagctctcggtcctatacaaggagtatgctgaagatgacaacatctatcaacagaagatcaaggacctccacaaaaagtactcgtacatccgcaagaccaggcctgacggcaactgtttctatcgggctttcggattctcccacttggaggcactgctggatgacagcaaggagttgcagcggttcaaggctgtgtctgccaagagcaaggaagacctggtgtcccagggcttcactgaattcacaattgaggatttccacaacacgttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgagccgtgtgtgcgtgtccctgctctgctgcccgcctggctgctctgtctgctgccccctccccccaggtgggtccccctgcttttcacctatctactcctgagcttccccaacaggagcaggtttgaggggccaggcctcttggaggcccctcctgcttcgttgggttctgcttccttcccttcttagctggctcaggggcttctatgggatcctggaagttccttagggacttgcccagggtcccagggccacccacacttcatctgctccctcataggccccacctccacgtcccggctgggccccagaccccagcttcctgccctccaccgggagtctgcatggttgggagtcctgggtggaggggcctttgtgaggctggacccggctcagggcaggtggaggagctgggcctcccacagggtgcccgggcagtgccatcctggtgggggagggcagccttcaaacgtgtggggtctacagtcctcaggtctaggcagggctgccggttctccacctccccatccgccccaggccccctgcctgtgcctgccttgcaccccctctgcttgggccacggtgtctctgcattgcctgcctttttgccttcacctcttttcttccccgccccctgcacattcggggtctcagcccccaggctgtgagctccttgggggcaggccctcaataaatgtgaactgctgctgccg

SEQ ID NO: 62097 - DNA, 1764 bp, Homo sapiens
  misc_feature (42)..(42): n is a, c, g, or t
caacaacgtcacggccaacggatgcgcaggcccccggtgagngttgtaaaagatcggacgagggtgcggcgctgtttaaagatggcggcggaggaacctcagcagcagaagcaggagccgctgggcagcgactccgaaggtgttaactgtctggcctatgatgaagccatcatggctcagcaggaccgaattcagcaagagattgctgtgcagaaccctctggtgtcagagcggctggagctctcggtcctatacaaggagtatgctgaagatgacaacatctatcaacagaagatcaaggacctccacaaaaagtactcgtacatccgcaagaccaggcctgacggcaactgtttctatcgggctttcggattctcccacttggaggcactgctggatgacagcaaggagttgcagcggttcaaggctgtgtctgccaagagcaaggaagacctggtgtcccagggcttcactgaattcacaattgaggatttccacaacacgttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgagccgtgtgtgcgtgtccctgctctgctgcccgcctggctgctctgtctgctgccccctccccccaggtgggtccccctgcttttcacctatctactcctgagcttccccaacaggagcaggtttgaggggccaggcctcttggaggcccctcctgcttcgttgggttctgcttccttcccttcttagctggctcaggggcttctatgggatcctggaagttccttagggacttgcccagggtcccagggccacccacacttcatctgctccctcataggccccacctccacgtcccggctgggccccagaccccagcttcctgccctccaccgggagtctgcatggttgggagtcctgggtggaggggcctttgtgaggctggacccggctcagggcaggtggaggagctgggcctcccacagggtgcccgggcagtgccatcctggtgggggagggcagccttcaaacgtgtggggtctacagtcctcaggtctaggcagggctgccggttctccacctccccatccgccccaggccccctgcctgtgcctgccttgcaccccctctgcttgggccacggtgtctctgcattgcctgcctttttgccttcacctcttttcttccccgccccctgcacattcggggtctcagcccccaggctgtgagctccttgggggcaggccctcaataaatgtgaactgctgctgccg

SEQ ID NO: 62098 - DNA, 1775 bp, Homo sapiens
aattggcaacccggaagcggtcggtagtgcggcgctgtttaaagatggcggcggaggaacctcagcagcagaagcaggagccgctgggcagcgactccgaaggtgttaactgtctggcctatgatgaagccatcatggctcagcaggaccgaattcagcaagagattgctgtgcagaaccctctggtgtcagagcggctggagctctcggtcctatacaaggagtatgctgaagatgacaacatctatcaacagaagatcaaggacctccacaaaaagtactcgtacatccgcaagaccaggcctgacggcaactgtttctatcgggctttcggattctcccacttggaggcactgctggatgacagcaaggagttgcagcggttcaaggctgtgtctgccaagagcaaggaagacctggtgtcccagggcttcactgaattcacaattgaggatttccacaacacgttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgagccgtgtgtgcgtgtccctgctctgctgcccgcctggctgctctgtctgctgccccctccccccaggtgggtccccctgcttttcacctatctactcctgagcttccccaacaggagcaggtttgaggggccaggcctcttggaggcccctcctgcttcgttgggttctgcttccttcccttcttagctggctcaggggcttctatgggatcctggaagttccttagggacttgcccagggtcccagggccacccacacttcatctgctccctcataggccccacctccacgtcccggctgggccccagaccccagcttcctgccctccaccgggagtctgcatggttgggagtcctgggtggaggggcctttgtgaggctggacccggctcagggcaggtggaggagctgggcctcccacagggtgcccgggcagtgccatcctggtgggggagggcagccttcaaacgtgtggggtctacagtcctcaggtctaggcagggctgccggttctccacctccccatccgccccaggccccctgcctgtgcctgccttgcaccccctctgcttgggccacggtgtctctgcattgcctgcctttttgccttcacctcttttcttccccgccccctgcacattcggggtctcagcccccaggctgtgagctccttgggggcaggccctcaataaatgtgaactgctgctgccgaaaaaaaaaaaaaaaaaagacatagagctcaatgactgtgggaaaaaa

SEQ ID NO: 62099 - DNA, 1707 bp, Homo sapiens
agccgtggtaccggtccgagtggtagggatgcggaggaacctcagcagcagaagcaggagccgctgggcagcgactccgaaggtgttaactgtctggcctatgatgaagccatcatggctcagcaggaccgaattcagcaagagattgctgtgcagaaccctctggtgtcagagcggctggagctctcggtcctatacaaggagtatgctgaagatgacaacatctatcaacagaagatcaaggacctccacaaaaagtactcgtacatccgcaagaccaggcctgacggcaactgtttctatcgggctttcggattctcccacttggaggcactgctggatgacagcaaggagttgcagcggttcaaggctgtgtctgccaagagcaaggaagacctggtgtcccagggcttcactgaattcacaattgaggatttccacaacacgttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgagccgtgtgtgcgtgtccctgctctgctgcccgcctggctgctctgtctgctgccccctccccccaggtgggtccccctgcttttcacctatctactcctgagcttccccaacaggagcaggtttgaggggccaggcctcttggaggcccctcctgcttcgttgggttctgcttccttcccttcttagctggctcaggggcttctatgggatcctggaagttccttagggacttgcccagggtcccagggccacccacacttcatctgctccctcataggccccacctccacgtcccggctgggccccagaccccagcttcctgccctccaccgggagtctgcatggttgggagtcctgggtggaggggcctttgtgaggctggacccggctcagggcaggtggaggagctgggcctcccacagggtgcccgggcagtgccatcctggtgggggagggcagccttcaaacgtgtggggtctacagtcctcaggtctaggcagggctgccggttctccacctccccatccgccccaggccccctgcctgtgcctgccttgcaccccctctgcttgggccacggtgtctctgcattgcctgcctttttgccttcacctcttttcttccccgccccctgcacattcggggtctcagcccccaggctgtgagctccttgggggcaggccctcaataaatgtgaactgctgctgccg

SEQ ID NO: 62100 - DNA, 1709 bp, Homo sapiens
gcaggctgtacagccccggaagtaatgggatcgcggaggaacctcagcagcagaagcaggagccgctgggcagcgactccgaaggtgttaactgtctggcctatgatgaagccatcatggctcagcaggaccgaattcagcaagagattgctgtgcagaaccctctggtgtcagagcggctggagctctcggtcctatacaaggagtatgctgaagatgacaacatctatcaacagaagatcaaggacctccacaaaaagtactcgtacatccgcaagaccaggcctgacggcaactgtttctatcgggctttcggattctcccacttggaggcactgctggatgacagcaaggagttgcagcggttcaaggctgtgtctgccaagagcaaggaagacctggtgtcccagggcttcactgaattcacaattgaggatttccacaacacgttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgagccgtgtgtgcgtgtccctgctctgctgcccgcctggctgctctgtctgctgccccctccccccaggtgggtccccctgcttttcacctatctactcctgagcttccccaacaggagcaggtttgaggggccaggcctcttggaggcccctcctgcttcgttgggttctgcttccttcccttcttagctggctcaggggcttctatgggatcctggaagttccttagggacttgcccagggtcccagggccacccacacttcatctgctccctcataggccccacctccacgtcccggctgggccccagaccccagcttcctgccctccaccgggagtctgcatggttgggagtcctgggtggaggggcctttgtgaggctggacccggctcagggcaggtggaggagctgggcctcccacagggtgcccgggcagtgccatcctggtgggggagggcagccttcaaacgtgtggggtctacagtcctcaggtctaggcagggctgccggttctccacctccccatccgccccaggccccctgcctgtgcctgccttgcaccccctctgcttgggccacggtgtctctgcattgcctgcctttttgccttcacctcttttcttccccgccccctgcacattcggggtctcagcccccaggctgtgagctccttgggggcaggccctcaataaatgtgaactgctgctgccg

SEQ ID NO: 62101 - DNA, 1972 bp, Homo sapiens
  misc_feature (42)..(42): n is a, c, g, or t
caacaacgtcacggccaacggatgcgcaggcccccggtgagngttgtaaaagatcggacgagggtgcggcgctgtttaaagatggcggcggaggaacctcagcagcagaagcaggagccgctgggcagcgactccgaaggtgttaactgtctggcctatgatgaagccatcatggctcagcaggaccgaattcagcaagagattgctgtgcagaaccctctggtgtcagagcggctggagctctcggtcctatacaaggagtatgctgaagatgacaacatctatcaacagaagatcaaggacctccacaaaaagtactcgtacatccgcaagaccaggcctgacggcaactgtttctatcgggctttcggattctcccacttggaggcactgctggatgacagcaaggagttgcagcggtgagaagggtgggcactgggcaccgaggcaggtgggtgtctacctcctccccgggcgagtaggatgtgtctcgagtagggtgtctccctccttcccgggcgatgggctggactctggccttgccaggcggggcagtgctgtctcggccctggcgtctgggctggtcgaggagcccatgctgggcccgcctttccatcccacccccaggttcaaggctgtgtctgccaagagcaaggaagacctggtgtcccagggcttcactgaattcacaattgaggatttccacaacacgttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgagccgtgtgtgcgtgtccctgctctgctgcccgcctggctgctctgtctgctgccccctccccccaggtgggtccccctgcttttcacctatctactcctgagcttccccaacaggagcaggtttgaggggccaggcctcttggaggcccctcctgcttcgttgggttctgcttccttcccttcttagctggctcaggggcttctatgggatcctggaagttccttagggacttgcccagggtcccagggccacccacacttcatctgctccctcataggccccacctccacgtcccggctgggccccagaccccagcttcctgccctccaccgggagtctgcatggttgggagtcctgggtggaggggcctttgtgaggctggacccggctcagggcaggtggaggagctgggcctcccacagggtgcccgggcagtgccatcctggtgggggagggcagccttcaaacgtgtggggtctacagtcctcaggtctaggcagggctgccggttctccacctccccatccgccccaggccccctgcctgtgcctgccttgcaccccctctgcttgggccacggtgtctctgcattgcctgcctttttgccttcacctcttttcttccccgccccctgcacattcggggtctcagcccccaggctgtgagctccttgggggcaggccctcaataaatgtgaactgctgctgccg

SEQ ID NO: 62102 - DNA, 1835 bp, Homo sapiens
aattggcaacccggaagcggtcggtagtgcggcgctgtttaaagatggcggcggaggaacctcagcagcagaagcaggagccgctgggcagcgactccgaaggtgttaactgtctggcctatgatgaagccatcatggctcagcaggaccgaattcagcaagagattgctgtgcagaaccctctggtgtcagagcggctggagctctcggtcctatacaaggagtatgctgaagatgacaacatctatcaacagaagatcaaggacctccacaaaaagtactcgtacatccgcaagaccaggcctgacggcaactgtttctatcgggctttcggattctcccacttggaggcactgctggatgacagcaaggagttgcagcggttcaaggctgtgtctgccaagagcaaggaagacctggtgtcccagggcttcactgaattcacaattgaggatttccacaacacggtgagccctggtgcctgtcttgggctgggccatgggggaggggttcacctggtgaggaccacccatctcctccccgtcatcttgccctttctccctccgtggctgcagttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgagccgtgtgtgcgtgtccctgctctgctgcccgcctggctgctctgtctgctgccccctccccccaggtgggtccccctgcttttcacctatctactcctgagcttccccaacaggagcaggtttgaggggccaggcctcttggaggcccctcctgcttcgttgggttctgcttccttcccttcttagctggctcaggggcttctatgggatcctggaagttccttagggacttgcccagggtcccagggccacccacacttcatctgctccctcataggccccacctccacgtcccggctgggccccagaccccagcttcctgccctccaccgggagtctgcatggttgggagtcctgggtggaggggcctttgtgaggctggacccggctcagggcaggtggaggagctgggcctcccacagggtgcccgggcagtgccatcctggtgggggagggcagccttcaaacgtgtggggtctacagtcctcaggtctaggcagggctgccggttctccacctccccatccgccccaggccccctgcctgtgcctgccttgcaccccctctgcttgggccacggtgtctctgcattgcctgcctttttgccttcacctcttttcttccccgccccctgcacattcggggtctcagcccccaggctgtgagctccttgggggcaggccctcaataaatgtgaactgctgctgccg

SEQ ID NO: 62103 - DNA, 1713 bp, Homo sapiens
  misc_feature (42)..(42): n is a, c, g, or t
caacaacgtcacggccaacggatgcgcaggcccccggtgagngttgtaaaagatcggacgagggtgcggcgctgtttaaagatggcggcggaggaacctcagcagcagaagcaggagccgctgggcagcgactccgaaggtgttaactgtctggcctatgatgaagccatcatggctcagcaggaccgaattcagcaagagattgctgtgcagaaccctctggtgtcagagcggctggagctctcggtcctatacaaggagtatgctgaagatgacaacatctatcaacagaagatcaagtgtttctatcgggctttcggattctcccacttggaggcactgctggatgacagcaaggagttgcagcggttcaaggctgtgtctgccaagagcaaggaagacctggtgtcccagggcttcactgaattcacaattgaggatttccacaacacgttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgagccgtgtgtgcgtgtccctgctctgctgcccgcctggctgctctgtctgctgccccctccccccaggtgggtccccctgcttttcacctatctactcctgagcttccccaacaggagcaggtttgaggggccaggcctcttggaggcccctcctgcttcgttgggttctgcttccttcccttcttagctggctcaggggcttctatgggatcctggaagttccttagggacttgcccagggtcccagggccacccacacttcatctgctccctcataggccccacctccacgtcccggctgggccccagaccccagcttcctgccctccaccgggagtctgcatggttgggagtcctgggtggaggggcctttgtgaggctggacccggctcagggcaggtggaggagctgggcctcccacagggtgcccgggcagtgccatcctggtgggggagggcagccttcaaacgtgtggggtctacagtcctcaggtctaggcagggctgccggttctccacctccccatccgccccaggccccctgcctgtgcctgccttgcaccccctctgcttgggccacggtgtctctgcattgcctgcctttttgccttcacctcttttcttccccgccccctgcacattcggggtctcagcccccaggctgtgagctccttgggggcaggccctcaataaatgtgaactgctgctgccg

SEQ ID NO: 62104 - DNA, 1626 bp, Homo sapiens
ttgcagtcaggcagagaggcctacgccagggccgagccccccggcctgctccagcggcggcccgcgccgtgagggcctcgagtttcgctgggctacggagcacaaaggtgttaactgtctggcctatgatgaagccatcatggctcagcaggaccgaattcagcaagagattgctgtgcagaaccctctggtgtcagagcggctggagctctcggtcctatacaaggagtatgctgaagatgacaacatctatcaacagaagatcaaggacctccacaaaaagtactcgtacatccgcaagaccaggcctgacggcaactgtttctatcgggctttcggattctcccacttggaggcactgctggatgacagcaaggagttgcagcggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgagccgtgtgtgcgtgtccctgctctgctgcccgcctggctgctctgtctgctgccccctccccccaggtgggtccccctgcttttcacctatctactcctgagcttccccaacaggagcaggtttgaggggccaggcctcttggaggcccctcctgcttcgttgggttctgcttccttcccttcttagctggctcaggggcttctatgggatcctggaagttccttagggacttgcccagggtcccagggccacccacacttcatctgctccctcataggccccacctccacgtcccggctgggccccagaccccagcttcctgccctccaccgggagtctgcatggttgggagtcctgggtggaggggcctttgtgaggctggacccggctcagggcaggtggaggagctgggcctcccacagggtgcccgggcagtgccatcctggtgggggagggcagccttcaaacgtgtggggtctacagtcctcaggtctaggcagggctgccggttctccacctccccatccgccccaggccccctgcctgtgcctgccttgcaccccctctgcttgggccacggtgtctctgcattgcctgcctttttgccttcacctcttttcttccccgccccctgcacattcggggtctcagcccccaggctgtgagctccttgggggcaggccctcaataaatgtgaactgctgctgccg

SEQ ID NO: 62105 - DNA, 553 bp, Homo sapiens
  misc_feature (42)..(42): n is a, c, g, or t
caacaacgtcacggccaacggatgcgcaggcccccggtgagngttgtaaaagatcggacgagggtgcggcgctgtttaaagatggcggcggaggaacctcagcagcagaagcaggagccgctgggcagcgactccgaaggtgttaactgtctggcctatgatgaagccatcatggctcagcaggaccgaattcagcaagagattgctgtgcagaaccctctggtgtcagagcggctggagctctcggtcctatacaaggagtatgctgaagatgacaacatctatcaacagaagatcaaggacctccacaaaaagtactcgtacatccgcaagaccaggcctgacggcaactgtttctatcgggctttcggattctcccacttggaggcactgctggatgacagcaaggagttgcagcggtgagaagggtgggcactgggcaccgaggcaggtgtgggactaggtgcaggtgtccggtgcaggtgtgggactaccggtgcaggtgtgggactaccggtgcaggtgtgggactaccggtgcaggtgtgggacta

SEQ ID NO: 62106 - DNA, 666 bp, Homo sapiens
tttttacatttgtcaaagatgtatattctgaggtctagtgagttcagacacctcggggaagcctctagcacatacatttatacgatttctttccaatataaactctcaagtagtgactgaactctggtgaagcttctgccaccctcatttcatttgtaaagcatatctgcactttgggaggctgaggtgggcggatcacttgaggtcaggagttcaagagcagcctggccaacatggtgaaaccctgtttctgccaaaaatacaaaaattagctgggcttcgtggcgggtactggtagtaccagctactcgagaggctgagtcaggagaattgcttgaaccctggaggcggaggttgcagtgagccgagatcgcgccactgcactctagcctgggtgacagagtgagactccatcacgcacacgcacgcacgaaagtgaatggcacctccctcttgtttgttcttctggccatgtgacatgcccttcacctcccaccatcattttaaccttcctcaggtttcccgagagggtgaacagacgtcagcgccatgtttcctataaagcctgcaaaattgtgagtcaattaaacctctttatacattacctagcctcaggtatttctgtctagccatgcaattatggcctaatatatttacacatggagt

SEQ ID NO: 62107 - DNA, 242 bp, Homo sapiens
tagatgttgtcctaacctctgggatccccaaataatttatacttactcatatagcttgtatatttgtcctttccctttgaagtctcatgtggaattgtagtaatctccagtattggaggtggagcctagtgggaggtgattggatgatgggggtggctttctcaagaaagttttagtaccatccccttgttgctgtccttgtgatagttctcatgaggtctggctcatgcctgtaatcccag

SEQ ID NO: 62108 - DNA, 630 bp, Homo sapiens
tctcaagcattttcattgtagaaagagatctttgtttttattttttaataactaaaatttacattgactttttaaactaagaatctttgcctccaagataaattttttctctatcttgagaacaacagtaaacaacatcaggaagttttaaaactgctttcagattatcacggttccagaaataatgtattttgtatttcagtcttaaaggagcatattccctttgcaagccctggagttcagtaagctggattcttagctagtgtctccataaagtggacacggaaaggaagagaatgtagacacatcaaaaggacgcctcgtcagttgagaaacaaggcattttcaagaagcagtaacagaagatcatgaggatgaaccaatccagtaaagacccttgtatgtagttcttagtggttcattagcgacctttaaggaagcagtatcaatgggataatgaataaagggtaaataggggttgcactatgagttacataatttgtttttcaaaaattgttaatataataagtgtgtcagttattaagttctcttctatctccaaatccaagcttctaaactttgctttgggttgctaaagcagtcactagacaagccatttctgcattgctg

SEQ ID NO: 62109 - DNA, 677 bp, Homo sapiens
tctcaagcattttcattgtagaaagagatctttgtttttattttttaataactaaaatttacattgactttttaaactaagaatctttgcctccaagataaattttttctctatcttgagaacaacagtaaacaacatcaggaagttttaaaactgctttcagattatcacggttccagaaataatgtattttgtatttcagtcttaaaggagcatattccctttgcaagccctggagttcagtaagctggattcttagctagtgtctccataaagtggacacggaaaggaagagaatgtagacacatcaaaaggacgcctcgtcagttgagaaacaaggcattttcaagaagcagtaacagaagatcatgaggatgaaccaatccagtaaagacccttaaaaatatttctgtggccttctctgcttcacctcctccatttaacttctcagtaggagttcttcagaaaagttgatgagactgaatgagtgaatggaaaagaacccattggctgagagtcaaagaaggatggtttgccattccagctgctccaactaagacttccgaggttcagtctagagagaaatcaagtcctgtgtttcccgggttcaccttgaacaagtcaccactttatccctccacatcactctcgttttagcaataaaatatcaagtaaaa

SEQ ID NO: 62110 - DNA, 380 bp, Homo sapiens
tttcaactgtgacaatttttactaagaagcctacagtgctataatggtatattatggtgattgtgccccaatatgcaggggcttgtcctgagaaaaggatgtttcaactcagagatgaaaaatgaatcaggaactaatcaggtggaatgggcacagatgtccaggctttggaaatacacgtgtaaaggccttgtatccacacctaaatctcatcttgaattgtaactcccacaattcccacgtgtcatgggaggaacccagtgggaggtgatggaattatgggggtgggtaatatttctcgtaatagtgaatgagtcccatgacatctgatggtttaaaaaatgggagtttccctacacaagctctctctttgccggcca

SEQ ID NO: 62111 - DNA, 238 bp, Homo sapiens
tgaggtgtgttcagattacacctgctgctggggcaatgcttggagacagtggtgggctgagaagaggagatgcagcagaacaaatgtttgatacaggccaggcgtggtggctcatacctgtaatcccagcactttggaaagccaaggtgggcagatcatctgaggtcaggagttcaaaaccagcctgcccaacatggtaaaaccccatctctactaaagtacaaaaattagctgggca

SEQ ID NO: 62112 - DNA, 382 bp, Homo sapiens
atatttcctcccgcagccccctctatgtgatcccagagccctctgtgcataatcttaccagtgcatttacctcagtgcttttagaattctgtttagagtgtcagtatttttcctcctgggctgtgtatatctttatgtccttggtggcttctcagagactggcatgtctatctgcttaattgatgtctgctgaatgaatcgaatgagtgagttctaataataaactgtaaaaccacctcttcgagaatgggcaggagcctctgcagctaagcagagctggggattccaaatgcagatctgaaagctgcaagaccatttctggcctcacagtcccagagctgaggatccttgctttgaaattctctgtataaactttacacaa

SEQ ID NO: 62113 - DNA, 307 bp, Homo sapiens
agccatgatagaaatttgaaggacattctcagtaactttatgtcctgttagaggaaagatttgaaagcatactggctggagaggcagaagatctgggttctggtttctacttagtttgaactttcttggacttagtctctgtatctgtaaaatgaaggactgaattaagttatccttacagccttttctaactcttaaattttaggattgattcttaatggtttaagatgtgttaacaatggaattaccctaaatgtcaaatcccattgttttttaggtaataaaaattatactgaaatcatttgaa

SEQ ID NO: 62114 - DNA, 313 bp, Homo sapiens
ttagatttaaataaaaaatgggaagtgatcttagaaacgaaacaatatatattaaagtttaaaaatgtttgacacaatagctttattctttgaaatgtatgctaaagaagtcagaggtatacttaaatgtattactatgaggatatgcattacaatattatacatgctaaaagattagaaagaaaaataaaaaactaggtaaaataagagattggctaaataaatcatgatattgctgtattaaaaattaagacccaacatcatgttttctgaggctgtttaacatacagagaaaagctcacaaaatatcaaa

SEQ ID NO: 62115 - DNA, 728 bp, Homo sapiens
aattctctattcttcctgaacaagatggataaattatattaatgtgctgtatatatatatttttaacctgagctattggagaaataagagaacctgttagatttgaaatagatttgtaacatttacaggaaatttgcttgtttataacacagtactctggccaggacgtatgcttcatcaggaaaatgtcataactgaattggaaataggaatttgaagccatttacttctctgtaaatgaaaacacattcagtcttactcttttggtgataccagataataccattttaaggccataggttcttgctttaattatatttgtcatcatgttaattaatttctgcttctgtgtatagttgcccaggtaacacatgtatgtgtctgtgtatgtatgtgaactaacaccttaattagtggagaacactggccatatggatcaccagagtttttccatattaattacctttacaagtcaatgaaggaacaaaggtaaaggcaaaagaattggaaccaggccatttttttttctagcataacacagttttcccttacttggttaacaaggaaagttgaaaaactcttaaagaaactctagcctaaagcattgagtctttcagaagggatttccaaactaaactatgaagacaaatttggacaagaagtaaatttttttcttggttatattcctctgaaaagcatattatttaataaaccgttggtcaattact

SEQ ID NO: 62116 - DNA, 461 bp, Homo sapiens
ccagaggtagatttttcttccagctctgtgcttgggcatttcccaaagcgaaacttccaaaggcacatcctgtcttcctgagtggtattctttgaggcagctgagtagcaaaactgaggctattaatgttcgcttagcaactgagcagctactgtgtatcaggggctctgcctgtgaccagggagtacacggtcttgtagaagagaaaaccgggtactcagctaactgtggtaccatgtgctaggtgccaaaggaggaacagagggccctgcgtgatctgctcaggaccgtgagggagaggtaagaagagttcaaaggagaggtcatatttcaaacagaccttgaagctgttcaaggcagagaagaaaaggatggtgttccacgaatggcctgagctaaggcaagtggaaacacgaggtttgttggaagaatcgcaaggacagcctgatgtttatagaaag

SEQ ID NO: 62117 - DNA, 371 bp, Homo sapiens
attgaatcaatacagcctgtgtttctcatgatcgcctggtccttgagactgttgataaggcattagagagcttcatggttgttgataatctgaggaacgccctctctagtgacagactgtcacggacatggaggattttttgaagtgccttttcaattttatgagttgaggatcctgcagccctggagatttataattgtccctgccactgctgctttgtgccttcttctagtttctgccttgtttatctggttttcttcccccatagtattttggcaattgtgaaaagtggttctggagaagtaccaacaaatgctcttactgcccgagaactgacacttttggaggctactgatgtttacggcaaaata

SEQ ID NO: 62118 - DNA, 421 bp, Homo sapiens
atattgagagagggggactgaggaaggactgaaccatcttcccaggggtcattggcggggtgttcagcatgagcatggagagcatagccctcctgatttgggagggaaacctcaaataactctcccaaccaaaacatgaaacatctactgttggatgcactttgtgtctagaacatcatcttcaacaagcttctgatttccaagaggggatcactgatagagctcctatgaggtgctgggcactgttctgggtgctaggaatacagtgtgaaacaaaacagataatatcctgggcttcatgagactgatattctagtagcactgcacattaaacccatgtttttgtctttgtttttgtctttgtttttgttttgtttcatttgagacagggtctcaatctgtcccccaagctggagggcag

SEQ ID NO: 62119 - DNA, 2075 bp, Homo sapiens
  misc_feature (860)..(860): n is a, c, g, or t
  misc_feature (1668)..(1668): n is a, c, g, or t
  misc_feature (1764)..(1764): n is a, c, g, or t
  misc_feature (1958)..(1958): n is a, c, g, or t
gaaacagaaacagaatgcatggctgctcaaaaagagtatctttttgtgctttcttgagggagagggttgtggaggggaaaccctccaactcgggctggctaacagggatgcttccttatgaaacgtgctcacctaagaataccagtgagaccatcggcactttctgtaattggcagcaatagagctattagaagaaacatgaaagagatagatggatctgaaatcaacatttgtaacaaaaggcctcaccatgttccccagcacaaatgtgctactgattagcagctaaaatgtgagcatccctactcaaattcaccctgttctccccatcctgaaggttctgatattaatgcataacattgtagcttataatgcttttacttaacattatcttattcatgcatcatcagagaatgatctaccaaaatgtatggagagaaagctaaaaatgtaaagtggctgttctcaatcttagctacatattagaacaacttggggagtttttaaattctgtgataaccacactgccctcagaccaatccgaattctggggcttaaatccaggtggagtgctagccacatgtagagcagctttctgctttcatatatatctgggcttaggcctcggtgagggttgggaagggcctatgacctctgaagagccttcacattacagcccaggaacagctggcccacagcaggagagatgcagagcctgaggtggagggccaagcctggggaatagggggtgctttgaagagcgtggtggtgaatggaggcttaatgaagcagaaactctactgctgtccagctgccccaaattacctgaatttagaaaggaacacaaagttacagtgagngcattttattttagctcagacaaatccaacaccatggatagaaggagggaaagtaaagatcccattcagagccttcctcctccaagaattgaggggctttctcatttttctctctgtaaaggatcatttcataattcagctctcttacttttataagccacttttaaaacccacattcctgtgtgtatttatatctatttctgtgctttctattctgttctattagtaatcagtccattcaagtgtcagtaccatgctgttttaattatggaggctttatactgtgttttaataactggtcaagctatgtcccttactgtgctgcttttttcagagttgaaaaagatttaataaaatcacaaatttaattggatttaatccttcatgtaaacaatatacaaattattttcctccttgcctctggttcttattcttttttaatcatctttggtgaatttttttctttcatataagatcttaggagtagatggagaggagtgactaaatctcacaagaacagactcaatattaccacacagtaccgaggggaaaatccacccccatgattaaatcacctcccaccagaccccacccctaacaccgagggttacaattagacatgagatttcagtggagacacagatccaaatcatatcagctactttggaagacagtatagaagtttctcttaaaactgaacgtactcttaccatatgatccagtaatgatactccttggtatttacccaaatgagttgaaaacttaacacacacacaaaaaaaacgaacccacacatggatatttttangagtttcagtcataattgccaaaatttgaaagcaaccaagatgtctttcagtaggtgaatggaaaaataaactgtggtatatccagagagtggaanatttttcattgttaaaaagaaatgagcaggccaggcacagtggctcatgcctgtaatcccagcactttgggagttcgaggtgggtggattgcctaaggtcaggagttcgagaccagcctgaccaacatggtgaaatcccgtctctactaaaaataaaaaaactagccgggcgtggtggtgggtgcctctaatcncagctactcaggaggctgaggcaggagaatcacttgaacccgggaggcggaggctgcagtgagcagagatcacgccattgcactccagcctgggcaataagagtgaaactccagctc

SEQ ID NO: 62120 - DNA, 488 bp, Homo sapiens
acctcagccaccatcgccaagcgggtacagtcagaagccccatttacaggtgaagaaacgaggctcagagagagaaggtgacgtgacatggaaaggggattcagaacgttagaaccagattcggaatcctaaaagctgagggccagacagcggctgcttctgtatgtggtgatgtggacccgaggctcgggccttcgtgacctcatgggaacacttaggatcagagcgcctgagtcttggaaacaaaatgttgaagttggagtctttgataaaatcttgaactggaagggctgggaatacctttggacacttctagacttctctgggtgggttttgtgtgtgtgtgtgtgtgagacacagccttaggaggtcctgagaacatgtgtcccctgggtggggtctattgaagtggtctctggggacctgcatgttcctccaataagctctgcaggagattctgatgcttacctgggtctgagagcctgcag

SEQ ID NO: 62121 - DNA, 1815 bp, Homo sapiens
cgcgaggagggttgctagtggagaagcaaccttggccatggaccagccggctggcctgcaggtggactacgtcttccggggtgtggagcatgccgtgcgggtgatggtttctgggcaggtgctggagctggaggtggaggaccggatgacggctgaccagtggcggggcgagttcgatgctggcttcattgaagatttgactcacaagacagggaacttcaaacagttcaacatcttctgtcatatgctggagtcagccctcactcagagtagtgagtcagtcaccctggacctgctgacctacacagacctggagtccctgcggaaccgcaagatggggggccgcccaggctccttggcccccaggtcggcccagctcaactccaagcgctacctgatcctcatctactccgtggagtttgacaggattcactacccgctgcccctcccgtaccagggcaagccagaccccgtggttctgcagggcatcatccggtcactgaaggaggaactgggccgcctgcaagggctggatggccagaacactcgggacacccgggagaatgagatctggcacctgcgggagcaggtgtcgcgcctggcgtccgagaagcgggagctggaggcgcagctgggccgatcgcgcgaggaggcgctggccgggcgcgcggcacgccaggaggccgaggcgctgcgcgggctggtgcgcgggctggagctggagctgcggcaggagcgcggcctcgggcacagggtggccggccgtcgcggccaggactgccgccgtctggccaaggagctcgaggaggcgaaggcatcggagcggagcctgcgcgcccggctgaagacgctgaccagcgagctggcattgtacaagagggggaggcggactccgccggtgcagccgcccccgacgcgggaggaccgggcctcatcgtcccgggagcgctccgcgtcgcgaggccgcggcgccgcgcgctcctcatcccgggagagcggccgcgggagccggggtcggggccgccctgcgcgcccctcgccctcgcccacaggtggtcgcgcgctccgcttcgaccccacggcctttgtgaaagccaaggaaaggaagcagagagagatccagatgaagcagcagcagcggaaccgcttaggcagtgggggaagcggggacggtccgtccgtctcctggtctcgccagacccggccccctgctgccttgactggccgaggggacgcccctaaccgctcccgaaaccgcagctcctcagtggacagtttccgcagccgctgctcgtctgccagctcctgcagcgatttggaggatttctctgagtcgctctccagagggggtcaccgccgccgtgggaagcctcccagcccaacgccctggagtgggtccaatatgaagtctccccccgtggaacgcagccaccatcagaaatctctggccaactccgggggctgggtccccatcaaagagtacagctcggagcaccaggcggctgacatggccgaaatagacgcacgcctgaaggccttgcaggagtacatgaaccgactggacatgcggtcataacgtggagaaggggtactacccctccatcccccacccacttgctgggtatggtgtggggggtggggccagggtggcctccagccctgcccagtccctgccctggccccgtccctcctgctgcccctggggtctcaggtgtgtgaggccctgaccctgccctctccccaggcagtgcatgctgggagggaggatgtgtgcattttgtaaataaacatatttgccctggggaaaaaaaaact

SEQ ID NO: 62122 - DNA, 1732 bp, Homo sapiens
cgcgaggagggttgctagtggagaagcaaccttggccatggaccagccggctggcctgcaggtggactacgtcttccggggtgtggagcatgccgtgcgggtgatggtttctgggcaggtgctggagctggaggtggaggaccggatgacggctgaccagtggcggggcgagttcgatgctggctagtagtgagtcagtcaccctggacctgctgacctacacagacctggagtccctgcggaaccgcaagatggggggccgcccaggctccttggcccccaggtcggcccagctcaactccaagcgctacctgatcctcatctactccgtggagtttgacaggattcactacccgctgcccctcccgtaccagggcaagccagaccccgtggttctgcagggcatcatccggtcactgaaggaggaactgggccgcctgcaagggctggatggccagaacactcgggacacccgggagaatgagatctggcacctgcgggagcaggtgtcgcgcctggcgtccgagaagcgggagctggaggcgcagctgggccgatcgcgcgaggaggcgctggccgggcgcgcggcacgccaggaggccgaggcgctgcgcgggctggtgcgcgggctggagctggagctgcggcaggagcgcggcctcgggcacagggtggccggccgtcgcggccaggactgccgccgtctggccaaggagctcgaggaggcgaaggcatcggagcggagcctgcgcgcccggctgaagacgctgaccagcgagctggcattgtacaagagggggaggcggactccgccggtgcagccgcccccgacgcgggaggaccgggcctcatcgtcccgggagcgctccgcgtcgcgaggccgcggcgccgcgcgctcctcatcccgggagagcggccgcgggagccggggtcggggccgccctgcgcgcccctcgccctcgcccacaggtggtcgcgcgctccgcttcgaccccacggcctttgtgaaagccaaggaaaggaagcagagagagatccagatgaagcagcagcagcggaaccgcttaggcagtgggggaagcggggacggtccgtccgtctcctggtctcgccagacccggccccctgctgccttgactggccgaggggacgcccctaaccgctcccgaaaccgcagctcctcagtggacagtttccgcagccgctgctcgtctgccagctcctgcagcgatttggaggatttctctgagtcgctctccagagggggtcaccgccgccgtgggaagcctcccagcccaacgccctggagtgggtccaatatgaagtctccccccgtggaacgcagccaccatcagaaatctctggccaactccgggggctgggtccccatcaaagagtacagctcggagcaccaggcggctgacatggccgaaatagacgcacgcctgaaggccttgcaggagtacatgaaccgactggacatgcggtcataacgtggagaaggggtactacccctccatcccccacccacttgctgggtatggtgtggggggtggggccagggtggcctccagccctgcccagtccctgccctggccccgtccctcctgctgcccctggggtctcaggtgtgtgaggccctgaccctgccctctccccaggcagtgcatgctgggagggaggatgtgtgcattttgtaaataaacatatttgccctggggaaaaaaaaact

SEQ ID NO: 62123 - DNA, 2060 bp, Homo sapiens
cgcgaggagggttgctagtggagaagcaaccttggccatggaccagccggctggcctgcaggtggactacgtcttccggggtgtggagcatgccgtgcgggtgatggtttctgggcaggtgctggagctggaggtggaggaccggatgacggctgaccagtggcggggcgagttcgatgctggcttcattgaagatttgactcacaagacagggaacttcaaacagttcaacatcttctgtcatatgctggagtcagccctcactcagagtagtgagtcagtcaccctggacctgctgacctacacagacctggagtccctgcggaaccgcaagatggggggccgcccaggctccttggcccccaggtcggcccagctcaactccaagcgctacctgatcctcatctactccgtggagtttgacaggattcactacccgctgcccctcccgtaccagggcaagccagaccccgtggttctgcagggcatcatccggtcactgaaggaggaactgggccgcctgcaagggctggatggccagaacactcgggacacccgggagaatgagatctggcacctgcgggagcaggtgtcgcgcctggcgtccgagaagcgggagctggaggcgcagctgggccgatcgcgcgaggaggcgctggccgggcgcgcggcacgccaggaggccgaggcgctgcgcgggctggtgcgcgggctggagctggagctgcggcaggagcgcggcctcgggcacagggtggccggccgtcgcggccaggactgccgccgtctggccaaggagctcgaggaggcgaaggcatcggagcggagcctgcgcgcccggctgaagacgctgaccagcgagctggcattgtacaagagggggaggcggactccgccggtgcagccgcccccgacgcgggaggaccgggcctcatcgtcccgggagcgctccgcgtcgcgaggccgcggcgccgcgcgctcctcatcccgggagagcggccgcgggagccggggtcggggccgccctgcgcgcccctcgccctcgcccacaggtggtcgcgcgctccgcttcgaccccacggcctttgtgaaagccaaggaaaggaagcagagagagatccagatgaagcagcagcagcggaaccgcttaggcagtgggggaagcggggacggtccgtccgtctcctggtctcgccagacccggccccctgctgccttgactggccgaggggacgcccctaaccgctcccgaaaccgcagctcctcagtggacagtttccgcagccgctgctcgtctgccagctcctgcagcgatttggaggatttctctgagtcgctctccagagggggtcaccgccgccgtgggaagcctcccagcccaacgccctggagtgggtccaatatgaagtctccccccgtggaacgcagccaccatcagaaatctctggccaactccgggggctgggtccccatcaaagagtacagctcggagcaccaggcggctgacatggccgaaatagacgcacgcctgaaggccttgcaggagtacatgaaccgactggacatgcggtcataacgtggagaaggggtactacccctccatcccccacccacttgctgggtgaagaaacgaggctcagagagagaaggtgacgtgacatggaaaggggattcagaacgttagaaccagattcggaatcctaaaagctgagggccagacagcggctgcttctgtatgtggtgatgtggacccgaggctcgggccttcgtgacctcatgggaacacttaggatcagagcgcctgagtcttggaaacaaaatgttgaagttggagtctttgataaaatcttgaactggaagggctgggaatacctttggacacttctagacttctctgggtgggttttgtgtgtgtgtgtgtgtgagacacagccttaggaggtcctgagaacatgtgtcccctgggtggggtctattgaagtggtctctggggacctgcatgttcctccaataagctctgcaggagattctgatgcttacctgggtctgagagcctgcag

SEQ ID NO: 62124 - DNA, 1622 bp, Homo sapiens
cgcgaggagggttgctagtggagaagcaaccttggccatggaccagccggctggcctgcaggtggactacgtcttccggggtgtggagcatgccgtgcgggtgatggtttctgggcaggtgctggagctggaggtggaggaccggatgacggctgaccagtggcggggcgagttcgatgctggcttcattgaagatttgactcacaagacagggaacttcaaacagttcaacatcttctgtcatatgctggagtcagccctcactcagagtagtgagtcagtcaccctggacctgctgacctacacagacctggagtccctgcggaaccgcaagatggggggccgcccaggctccttggcccccaggtcggcccagctcaactccaagcgctacctgatcctcatctactccgtggagtttgacaggattcactacccgctgcccctcccgtaccagggcaagccagaccccgtggttctgcagggcatcatccggtcactgaaggaggaactgggccgcctgcaagggctggatggccagaacactcgggacacccgggagaatgagatctggcacctgcgggagcaggtgtcgcgcctggcgtccgagaagcgggagctggaggcgcagctgggccgatcgcccggctgaagacgctgaccagcgagctggcattgtacaagagggggaggcggactccgccggtgcagccgcccccgacgcgggaggaccgggcctcatcgtcccgggagcgctccgcgtcgcgaggccgcggcgccgcgcgctcctcatcccgggagagcggccgcgggagccggggtcggggccgccctgcgcgcccctcgccctcgcccacaggtggtcgcgcgctccgcttcgaccccacggcctttgtgaaagccaaggaaaggaagcagagagagatccagatgaagcagcagcagcggaaccgcttaggcagtgggggaagcggggacggtccgtccgtctcctggtctcgccagacccggccccctgctgccttgactggccgaggggacgcccctaaccgctcccgaaaccgcagctcctcagtggacagtttccgcagccgctgctcgtctgccagctcctgcagcgatttggaggatttctctgagtcgctctccagagggggtcaccgccgccgtgggaagcctcccagcccaacgccctggagtgggtccaatatgaagtctccccccgtggaacgcagccaccatcagaaatctctggccaactccgggggctgggtccccatcaaagagtacagctcggagcaccaggcggctgacatggccgaaatagacgcacgcctgaaggccttgcaggagtacatgaaccgactggacatgcggtcataacgtggagaaggggtactacccctccatcccccacccacttgctgggtatggtgtggggggtggggccagggtggcctccagccctgcccagtccctgccctggccccgtccctcctgctgcccctggggtctcaggtgtgtgaggccctgaccctgccctctccccaggcagtgcatgctgggagggaggatgtgtgcattttgtaaataaacatatttgccctggggaaaaaaaaact

SEQ ID NO: 62125 - DNA, 1018 bp, Homo sapiens
cgcgaggagggttgctagtggagaagcaaccttggccatggaccagccggctggcctgcaggtggactacgtcttccggggtgtggagcatgccgtgcgggtgatggtttctgggcaggtgctggagctggaggtggaggaccggatgacggctgaccagtggcggggcgagttcgatgctggcttcattgaagatttgactcacaagacagggaacttcaaacagttcaacatcttctgtcatatgctggagtcagccctcactcagagtagtgagtcagtcaccctggacctgctgacctacacagacctggagtccctgcggaaccgcaagatggggggccgcccaggctccttggcccccaggtcggcccagctcaactccaagcgctacctgatcctcatctactccgtggagtttgacaggattcactacccgctgcccctcccgcgccctccgtctccctctagtggacagtttccgcagccgctgctcgtctgccagctcctgcagcgatttggaggatttctctgagtcgctctccagagggggtcaccgccgccgtgggaagcctcccagcccaacgccctggagtgggtccaatatgaagtctccccccgtggaacgcagccaccatcagaaatctctggccaactccgggggctgggtccccatcaaagagtacagctcggagcaccaggcggctgacatggccgaaatagacgcacgcctgaaggccttgcaggagtacatgaaccgactggacatgcggtcataacgtggagaaggggtactacccctccatcccccacccacttgctgggtatggtgtggggggtggggccagggtggcctccagccctgcccagtccctgccctggccccgtccctcctgctgcccctggggtctcaggtgtgtgaggccctgaccctgccctctccccaggcagtgcatgctgggagggaggatgtgtgcattttgtaaataaacatatttgccctggggaaaaaaaaact

SEQ ID NO: 62126 - DNA, 677 bp, Homo sapiens
cgcgaggagggttgctagtggagaagcaaccttggccatggaccagccggctggcctgcaggtggactacgtcttccggggtgtggagcatgccgtgcgggtgatggtttctgggcaggtgctggagctggaggtggaggaccggatgacggctgaccagtggcggggcgagttcgatgctggcttcattgaagatttgactcacaagacagggaacttcaaacagttcaacatcttctgtcatatgctggagtcagccctcactcagagtagtgagtcagtcaccctggacctgctgacctacacagacctggagtccctgcggaaccgcaagatggggggccgcccaggctccttggcccccaggtcggcccagctcaactccaagcgctacctgatcctcatctactccgtggagtttgacaggattcactacccgctgcccctcccgtaccagggcaagccagaccccgtggttctgcagggcatcatccggtcactgaaggaggaactgggccgccctgcccagtccctgccctggccccgtccctcctgctgcccctggggtctcaggtgtgtgaggccctgaccctgccctctccccaggcagtgcatgctgggagggaggatgtgtgcattttgtaaataaacatatttgccctggggaaaaaaaaact

SEQ ID NO: 62127 - DNA, 379 bp, Homo sapiens
aaagccctttctatgaaggttacaggctctatatctgctttcatgatgacatttgtctatgtttttgtaggattctattctgacaagcacaaaaccctgcaccaagttgaacctgtcctttgtgatgaggctgttgaacagaagagcagcgtagcagtctgtctattcttgctccacattcagctaaatgccaactccgatccctttgagatggtgaacaggctgaacccagggatcgtgtcatccctcagtatccagacttcttcagagaaccatgtggtgaaacttcttgattaaggtcgcaaaagaagagacaactatacattttgtgatgctgaagggaaatgtacaagagcactactgaagaagtccagccaaa

SEQ ID NO: 62128 - DNA, 291 bp, Homo sapiens
ggcaaaaacatcaacacatggaaggtatacactggttcggttcaaaaagggggattatcttcaggagaggtcttataggttgtaggtggacttggggattctctggtttgtgattggttaaaggagtaaggccctgtctacagcttagagttgacagaaaggaaggtaagaatgctctgtcagagtcagccacaataaaatgccctggttagcaagcctgatggcctgcaggcctgacttacacctgccttgcatggccttagggcttgttcataatttgttatcttatgg

SEQ ID NO: 62129 - DNA, 1741 bp, Homo sapiens
taaatctcataatgcatgcagttgaagtattggagagaaaacgaaagaattcctacaagacatgaaataaaacacagctacttcactgttgtcagggaaaaaaaccaactgctccaaaagaatgtgtttttctcccattctggaaatcaacatgcagtctgaatctaacattacagtgcgagatgacattgatgacatcaacaccaatatgtaccaaccactatcatatccgttaagctttcaagtgtctctcaccggatttcttatgttagaaattgtgttgggacttggcagcaacctcactgtattggtactttactgcatgaaatccaacttaatcaactctgtcagtaacattattacaatgaatcttcatgtacttgatgtaataatttgtgtgggatgtattcctctaactatagttatccttctgctttcactggagagtaacactgctctcatttgctgtttccatgaggcttgtgtatcttttgcaagtgtctcaacagcaatcaacgtttttgctatcactttggacagatatgacatctctgtaaaacctgcaaaccgaattctgacaatgggcagagctgtaatgttaatgatatccatttggattttttcttttttctctttcctgattccttttattgaggtaaattttttcagtcttcaaagtggaaatacctgggaaaacaagacacttttatgtgtcagtacaaatgaatactacactgaactgggaatgtattatcacctgttagtacagatcccaatattctttttcactgttgtagtaatgttaatcacatacaccaaaatacttcaggctcttaatattcgaataggcacaagattttcaacagggcagaagaagaaagcaagaaagaaaaagacaatttctctaaccacacaacatgaggctacagacatgtcacaaagcagtggtgggagaaatgtagtctttggtgtaagaacttcagtttctgtaataattgccctccggcgagctgtgaaacgacaccgtgaacgacgagaaagacaaaagagagtcttcaggatgtctttattgattatttctacatttcttctctgctggacaccaatttctgttttaaataccaccattttatgtttaggcccaagtgaccttttagtaaaattaagattgtgttttttagtcatggcttatggaacaactatatttcaccctctattatatgcattcactagacaaaaatttcaaaaggtcttgaaaagtaaaatgaaaaagcgagttgtttctatagtagaagctgatcccctgcctaataatgctgtaatacacaactcttggatagatcctaaaagaaacaaaaaaattacctttgaagatagtgaaataagagaaaaatgtttagtgcctcaggttgtcacagactagagaaaagtctcagtttcaccaaatccacattcaaatgagttttaaatttaaattgtaaaaactgatattactgccaaatataagaaaaatattttaagtattggttatgttgtaaattttcaatgtgaatgtcaattagataggtcatatatattcaatttcttcattacttaatgtatttgttgcatggcagtttgttaaagtactatcatgtgtatattttgtcaatattatgtccaacagaaaatattcatgtaagtcatattttttaaggaataaatacatagccttaaaacagtgtataactttaaaatgtaa

SEQ ID NO: 62130 - DNA, 1528 bp, Homo sapiens
  misc_feature (6)..(6): n is a, c, g, or t
  misc_feature (1100)..(1100): n is a, c, g, or t
attagnctagtacgaggcgggtggctctcggccttgggaaggaaggcagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatccaaaaaaaaaaaaaaaaaaaaaaaaacaaaaaaagaaggggggggcgcgcgcctacaaaaataatcccccgcgggggggccccacgttttggcgcgcgctccccgcgcttttttgtgtaaacacagggggcgcgccccatatgtaggggggcgcgatataataaaggcgcgggcgcgcgcggcggcgcgcggcggtttataacaacaggagcgctgcccggaggtggagggaacacagtcggtcgcccgcgtggggaactcctctgcgtgcgaaaaagcggacacccccctatcctctgctgggggggcggcgcccgctatgttcgcgggcacaccacctctccaccgcagcaagagatatatgtaagagcgccgctcgagaggcgggaacaatctacaaacacttacgagggcgttctatcatgtggtgtgctaccaccagcagcgcgcatataattgccgcgcgcggtatgaaaaaaatttaggcacccccgcgggaagtatgtatgtacttttcgggagcaacaattcttatttacccgccggggagtctngttgttgttaagaataaaaacaggcgcgcacactccacgacctaacgacagtgacccctggtacagccaacgagcagcaagctgaaccaaccgactgctatgcacacaactagagagtcgggacgaccaggcaacgaggagaatcgtccgcggcaggcgagcgagacagtcgcgacgacgcagcagggcaggggctacagcagcaccaagcgaccgcaccgcggcagacggaggcacggagcgacagaaggaaagcgggcgagctagccaacgcacccgcaggagcagtacgcccaggcagccagcagccagacagcgaacagtcaagcccgcgagaggacacaagcggcgaatcagacagcaggaccagcgcgagccagccacccagacgagacaggagagcacaaaacacgcgcccgcacggccgc

SEQ ID NO: 62131 - DNA, 487 bp, Homo sapiens
agacggatccccgatatttgtggttctggcctattcattagtgctgtaaactatgttgacatgggattggccgacactgtgatgcacacgtagctcacagactacagtactaaatgctacccttggttgtccatcaccaggatacattgcgcttgcatgactcccaaaaagacttctcgagatacctgcgctcgaatgcatggtcttcatcatgatcgtatgcagaagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagccagagccagaaccataaatatcgcggtaccga

SEQ ID NO: 62132 - DNA, 252 bp, Homo sapiens
ccgcccagcagcagcccccgccatatatatgtgtatgtgtgtgtatatatagacatatgtatatatatgtgtgtatgtatatatataatgtatatatgtgtgggggcggccgctggccccccgagccagcgcccccccccggagctgcgccctggatcctcacactacagatcaggccttctttggttcttgggtggttttgggttttttctgttttttttttttttttattttttggagggggggggcccg

SEQ ID NO: 62133 - DNA, 251 bp, Homo sapiens
agacggatccccgatatttgtggttctggctcactgggggttcccactctccgtccatctcttcatcccagtccaggggcttcgtagcagcaagggccaggagacaggcgtgttctgtgtggtttctgtgtttcatttgtggtggtgtttttggccggggttgggaggttttttgtttgttctgtttgatgacaccatatgtgtgtaacatctccacacagagccacacagtatgtacgtgaagccagctc

SEQ ID NO: 62134 - DNA, 214 bp, Homo sapiens
acgctctctctgtggggtgtacaggctgtgctgagttcttccttccccactgcatagcctgtacaccatcactcagagcgtttcccagggctgcagaggctgtggcctgcctgtttccctgtgcctcttgtttggcctgcacatttaaatttttaaaaatatttgccaacatttgaaaagtgagagcttgactatttaaaaactcaaaaaaaaa

SEQ ID NO: 62135 - DNA, 4388 bp, Homo sapiens
  misc_feature (131)..(131): n is a, c, g, or t
  misc_feature (3960)..(3960): n is a, c, g, or t
catggccgggctagcgcttagccagctgcgtggctggacccccgggactcttgcgggccaagacgcgggaagaggcggggcagggggcggggtctgcgcggggacccggatgcggcccgaccgcgacctcnggaaccggaagtagagcctggtgcctgggagcggctggcgcggcggaatccagggccgacccgggccggaccgaccccaggcggcgacggaatcagtccccaatgcctggaaattcctcattggattactgtgttttaaacagaatttcgtgaacagccttttatctccaagcggaaagaaagatgtggaaagcttcagcaggccacgctgtgtccatcgcccaggatgacgcgggggccgatgactgggagaccgaccctgattttgtgaatgatgtgagtgagaaggagcaaagatggggtgccaagacggtgcagggctccgggcaccaggagcatatcaacatacacaagctgagggagaatgtctttcaagagcatcagacccttaaggagaaggaacttgaaacaggaccaaaagcttcccatggctatggagggaaatttggtgtggaacaagaccgaatggataagtcagctgtcggccacgaatatcagtcgaaactttccaagcactgctcgcaggtggactcggtccgtggcttcggaggcaagtttggtgtccagatggacagagttgatcagtctgctgtaggctttgaataccaggggaagactgagaagcatgcctcccagaaagactactccagtggttttggcggcaagtatggcgtgcaggccgaccgagtagacaagagcgcggtgggcttcgactaccagggcaagacggagaagcacgagtcacagagagattactccaaaggtttcggcggcaaatacggtatcgacaaggacaaagtggataagagcgccgttggctttgagtatcaaggcaaaacggagaagcacgagtcccagaaagactatgtgaaagggtttggaggaaaatttggtgtgcagacagacagacaagacaaatgtgcccttggctgggatcaccaggagaaattgcagctgcatgaatcccaaaaagattataagactggttttggaggcaaattcggtgttcagtcggagaggcaggactccgctgctgtggggtttgattacaaggagaagctggccaagcacgagtcccagcaagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagccagagccaaaacgcaaacgccccctgtgtcgcccgcacctcagccaaccgaggagaggctgccctcgagccccgtctatgaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcagaggacagcacctacgatgagtacgagaacgatctggggatcacagccgtcgccctgtacgactaccaggctgcgggcgatgatgagatctcatttgaccctgatgacatcatcaccaacatcgagatgattgacgacggctggtggcgcggggtgtgcaagggccggtacgggctcttcccagccaactatgtggagctgcggcagtagggcccccagcccccccccggagctgcgccctggatcctcacactacagatcaggccttctttggttcttgggtggttttgggttttttctgttttttttttttttttttttttttttttttgaaggtggggaggggaatatacacattgcttttatatttaatacttttgctgatgcttttgaaaatgtttatgccacagaatttgctaatatattgtaatcacattccttaggaggactttggtaattggttttatgcattgatggttttttttttcttttttgccaaattgactgtcacgcggcagcttcagggagctcgcattctcttgtgttcgtgttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtcttaactgtcacccatatggtccctgggccaccgggcagcctggggcggtgtgtgtgccatgtcacagcatggcctctcggccttgggaaggaaggcagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatccaaaaaaaaaaaaaaaaaacaaacaaaaaaaaaaaaaaaaaaaaaaaaacaaaaaaagaaggggggggcgcgcgcctacaaaaataatcccccgcgggggggccccacgttttggcgcgcgctccccgcgcttttttgtgtaaacacagggggcgcgccccatatgtaggggggcgcgatataataaaggcgcgggcgcgcgcggcggcgcgcggcggtttataacaacaggagcgctgcccggaggtggagggaacacagtcggtcgcccgcgtggggaactcctctgcgtgcgaaaaagcggacacccccctatcctctgctgggggggcggcgcccgctatgttcgcgggcacaccacctctccaccgcagcaagagatatatgtaagagcgccgctcgagaggcgggaacaatctacaaacacttacgagggcgttctatcatgtggtgtgctaccaccagcagcgcgcatataattgccgcgcgcggtatgaaaaaaatttaggcacccccgcgggaagtatgtatgtacttttcgggagcaacaattcttatttacccgccggggagtctngttgttgttaagaataaaaacaggcgcgcacactccacgacctaacgacagtgacccctggtacagccaacgagcagcaagctgaaccaaccgactgctatgcacacaactagagagtcgggacgaccaggcaacgaggagaatcgtccgcggcaggcgagcgagacagtcgcgacgacgcagcagggcaggggctacagcagcaccaagcgaccgcaccgcggcagacggaggcacggagcgacagaaggaaagcgggcgagctagccaacgcacccgcaggagcagtacgcccaggcagccagcagccagacagcgaacagtcaagcccgcgagaggacacaagcggcgaatcagacagcaggaccagcgcgagccagccacccagacgagacaggagagcacaaaacacgcgcccgcacggccgc

SEQ ID NO: 62136 - DNA, 3274 bp, Homo sapiens
  misc_feature (131)..(131): n is a, c, g, or t
catggccgggctagcgcttagccagctgcgtggctggacccccgggactcttgcgggccaagacgcgggaagaggcggggcagggggcggggtctgcgcggggacccggatgcggcccgaccgcgacctcnggaaccggaagtagagcctggtgcctgggagcggctggcgcggcggaatccagggccgacccgggccggaccgaccccaggcggcgacggaatcagtccccaatgcctggaaattcctcattggattactgtgttttaaacagaatttcgtgaacagccttttatctccaagcggaaagaaagatgtggaaagcttcagcaggccacgctgtgtccatcgcccaggatgacgcgggggccgatgactgggagaccgaccctgattttgtgaatgatgtgagtgagaaggagcaaagatggggtgccaagacggtgcagggctccgggcaccaggagcatatcaacatacacaagctgagggagaatgtctttcaagagcatcagacccttaaggagaaggaacttgaaacaggaccaaaagcttcccatggctatggagggaaatttggtgtggaacaagaccgaatggataagtcagctgtcggccacgaatatcagtcgaaactttccaagcactgctcgcaggtggactcggtccgtggcttcggaggcaagtttggtgtccagatggacagagttgatcagtctgctgtaggctttgaataccaggggaagactgagaagcatgcctcccagaaagactactccagtggttttggcggcaagtatggcgtgcaggccgaccgagtagacaagagcgcggtgggcttcgactaccagggcaagacggagaagcacgagtcacagagagattactccaaaggtttcggcggcaaatacggtatcgacaaggacaaagtggataagagcgccgttggctttgagtatcaaggcaaaacggagaagcacgagtcccagaaagactatgtgaaagggtttggaggaaaatttggtgtgcagacagacagacaagacaaatgtgcccttggctgggatcaccaggagaaattgcagctgcatgaatcccaaaaagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagccagagccaaaacgcaaacgccccctgtgtcgcccgcacctcagccaaccgaggagaggctgccctcgagccccgtctatgaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcagaggacagcacctacgatgagtacgagaacgatctggggatcacagccgtcgccctgtacgactaccaggctgcgggcgatgatgagatctcatttgaccctgatgacatcatcaccaacatcgagatgattgacgacggctggtggcgcggggtgtgcaagggccggtacgggctcttcccagccaactatgtggagctgcggcagtagggcccccagcccccccccggagctgcgccctggatcctcacactacagatcaggccttctttggttcttgggtggttttgggttttttctgttttttttttttttttttttttttttttttgaaggtggggaggggaatatacacattgcttttatatttaatacttttgctgatgcttttgaaaatgtttatgccacagaatttgctaatatattgtaatcacattccttaggaggactttggtaattggttttatgcattgatggttttttttttcttttttgccaaattgactgtcacgcggcagcttcagggagctcgcattctcttgtgttcgtgttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtcttaactgtcacccatatggtccctgggccaccgggcagcctggggcggtgtgtgtgccatgtcacagcatggcctctcggccttgggaaggaaggcagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatcca

SEQ ID NO: 62137 - DNA, 3927 bp, Homo sapiens
  misc_feature (131)..(131): n is a, c, g, or t
catggccgggctagcgcttagccagctgcgtggctggacccccgggactcttgcgggccaagacgcgggaagaggcggggcagggggcggggtctgcgcggggacccggatgcggcccgaccgcgacctcnggaaccggaagtagagcctggtgcctgggagcggctggcgcggcggaatccagggccgacccgggccggaccgaccccaggcggcgacggaatcagtccccaatgcctggaaattcctcattggattactgtgttttaaacagaatttcgtgaacagccttttatctccaagcggaaagaaagatgtggaaagcttcagcaggccacgctgtgtccatcgcccaggatgacgcgggggccgatgactgggagaccgaccctgattttgtgaatgatgtgagtgagaaggagcaaagatggggtgccaagacggtgcagggctccgggcaccaggagcatatcaacatacacaagctgagggagaatgtctttcaagagcatcagacccttaaggagaaggaacttgaaacaggaccaaaagcttcccatggctatggagggaaatttggtgtggaacaagaccgaatggataagtcagctgtcggccacgaatatcagtcgaaactttccaagcactgctcgcaggtggactcggtccgtggcttcggaggcaagtttggtgtccagatggacagagttgatcagtctgctgtaggctttgaataccaggggaagactgagaagcatgcctcccagaaagactactccagtggttttggcggcaagtatggcgtgcaggccgaccgagtagacaagagcgcggtgggcttcgactaccagggcaagacggagaagcacgagtcacagagagattactccaaaggtttcggcggcaaatacggtatcgacaaggacaaagtggataagagcgccgttggctttgagtatcaaggcaaaacggagaagcacgagtcccagaaaggtgtcttccgttttatcttaccctccagccagcagctagtaatgtgacaggtggtagccacaccggaaaaggaaaaacaaagcgttattgatagcccttaacgtagatgtctctttttcatgaaatgcccaacttgaaaacggcacatccagaaacacagctgctaaataggaactcgcagcttgagtgttatggcgctccagccccagcggcgttgcttatcgtggtggccacaccccgcacgtctgtgttgcccgtgtgagcctgtgctgtctcatggtgcgggtggaagccgcatgcgtgggagcttccatggggtcctgtctggcttagtcacgatgctgaggtcatagactaggttatttcctgccactctccaaggagggcctcttcatggatgttatctaaagtattaccaaagatccggaagggaagagtagattgagtgaatcatatgcgtttaactgtattgaaaacatactttccacctgtgacctgcactacccgatatatgtggttctggcctttcattgtgcatgtagactatgtgaaagggtttggaggaaaatttggtgtgcagacagacagacaagacaaatgtgcccttggctgggatcaccaggagaaattgcagctgcatgaatcccaaaaagattataagactggttttggaggcaaattcggtgttcagtcggagaggcaggactccgctgctgtggggtttgattacaaggagaagctggccaagcacgagtcccagcaagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagccagagccaaaacgcaaacgccccctgtgtcgcccgcacctcagccaaccgaggagaggctgccctcgagccccgtctatgaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcagaggacagcacctacgatgagtacgagaacgatctggggatcacagccgtcgccctgtacgactaccaggctgcgggcgatgatgagatctcatttgaccctgatgacatcatcaccaacatcgagatgattgacgacggctggtggcgcggggtgtgcaagggccggtacgggctcttcccagccaactatgtggagctgcggcagtagggcccccagcccccccccggagctgcgccctggatcctcacactacagatcaggccttctttggttcttgggtggttttgggttttttctgttttttttttttttttttttttttttttttgaaggtggggaggggaatatacacattgcttttatatttaatacttttgctgatgcttttgaaaatgtttatgccacagaatttgctaatatattgtaatcacattccttaggaggactttggtaattggttttatgcattgatggttttttttttcttttttgccaaattgactgtcacgcggcagcttcagggagctcgcattctcttgtgttcgtgttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtcttaactgtcacccatatggtccctgggccaccgggcagcctggggcggtgtgtgtgccatgtcacagcatggcctctcggccttgggaaggaaggcagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatcca

SEQ ID NO: 62138 - DNA, 3816 bp, Homo sapiens
  misc_feature (131)..(131): n is a, c, g, or t
catggccgggctagcgcttagccagctgcgtggctggacccccgggactcttgcgggccaagacgcgggaagaggcggggcagggggcggggtctgcgcggggacccggatgcggcccgaccgcgacctcnggaaccggaagtagagcctggtgcctgggagcggctggcgcggcggaatccagggccgacccgggccggaccgaccccaggcggcgacggaatcagtccccaatgcctggaaattcctcattggattactgtgttttaaacagaatttcgtgaacagccttttatctccaagcggaaagaaagatgtggaaagcttcagcaggccacgctgtgtccatcgcccaggatgacgcgggggccgatgactgggagaccgaccctgattttgtgaatgatgtgagtgagaaggagcaaagatggggtgccaagacggtgcagggctccgggcaccaggagcatatcaacatacacaagctgagggagaatgtctttcaagagcatcagacccttaaggagaaggaacttgaaacaggaccaaaagcttcccatggctatggagggaaatttggtgtggaacaagaccgaatggataagtcagctgtcggccacgaatatcagtcgaaactttccaagcactgctcgcaggtggactcggtccgtggcttcggaggcaagtttggtgtccagatggacagagttgatcagtctgctgtaggctttgaataccaggggaagactgagaagcatgcctcccagaaagactactccagtggttttggcggcaagtatggcgtgcaggccgaccgagtagacaagagcgcggtgggcttcgactaccagggcaagacggagaagcacgagtcacagagagattactccaaaggtttcggcggcaaatacggtatcgacaaggacaaagtggataagagcgccgttggctttgagtatcaaggcaaaacggagaagcacgagtcccagaaaggtgtcttccgttttatcttaccctccagccagcagctagtaatgtgacaggtggtagccacaccggaaaaggaaaaacaaagcgttattgatagcccttaacgtagatgtctctttttcatgaaatgcccaacttgaaaacggcacatccagaaacacagctgctaaataggaactcgcagcttgagtgttatggcgctccagccccagcggcgttgcttatcgtggtggccacaccccgcacgtctgtgttgcccgtgtgagcctgtgctgtctcatggtgcgggtggaagccgcatgcgtgggagcttccatggggtcctgtctggcttagtcacgatgctgaggtcatagactaggttatttcctgccactctccaaggagggcctcttcatggatgttatctaaagtattaccaaagatccggaagggaagagtagattgagtgaatcatatgcgtttaactgtattgaaaacatactttccacctgtgacctgcactacccgatatatgtggttctggcctttcattgtgcatgtagactatgtgaaagggtttggaggaaaatttggtgtgcagacagacagacaagacaaatgtgcccttggctgggatcaccaggagaaattgcagctgcatgaatcccaaaaagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagccagagccaaaacgcaaacgccccctgtgtcgcccgcacctcagccaaccgaggagaggctgccctcgagccccgtctatgaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcagaggacagcacctacgatgagtacgagaacgatctggggatcacagccgtcgccctgtacgactaccaggctgcgggcgatgatgagatctcatttgaccctgatgacatcatcaccaacatcgagatgattgacgacggctggtggcgcggggtgtgcaagggccggtacgggctcttcccagccaactatgtggagctgcggcagtagggcccccagcccccccccggagctgcgccctggatcctcacactacagatcaggccttctttggttcttgggtggttttgggttttttctgttttttttttttttttttttttttttttttgaaggtggggaggggaatatacacattgcttttatatttaatacttttgctgatgcttttgaaaatgtttatgccacagaatttgctaatatattgtaatcacattccttaggaggactttggtaattggttttatgcattgatggttttttttttcttttttgccaaattgactgtcacgcggcagcttcagggagctcgcattctcttgtgttcgtgttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtcttaactgtcacccatatggtccctgggccaccgggcagcctggggcggtgtgtgtgccatgtcacagcatggcctctcggccttgggaaggaaggcagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatcca

SEQ ID NO: 62139 - DNA, 4680 bp, Homo sapiens
  misc_feature (131)..(131): n is a, c, g, or t
catggccgggctagcgcttagccagctgcgtggctggacccccgggactcttgcgggccaagacgcgggaagaggcggggcagggggcggggtctgcgcggggacccggatgcggcccgaccgcgacctcnggaaccggaagtagagcctggtgcctgggagcggctggcgcggcggaatccagggccgacccgggccggaccgaccccaggcggcgacggaatcagtccccaatgcctggaaattcctcattggattactgtgttttaaacagaatttcgtgaacagccttttatctccaagcggaaagaaagatgtggaaagcttcagcaggccacgctgtgtccatcgcccaggatgacgcgggggccgatgactgggagaccgaccctgattttgtgaatgatgtgagtgagaaggagcaaagatggggtgccaagacggtgcagggctccgggcaccaggagcatatcaacatacacaagctgagggagaatgtctttcaagagcatcagacccttaaggagaaggaacttgaaacaggaccaaaagcttcccatggctatggagggaaatttggtgtggaacaagaccgaatggataagtcagctgtcggccacgaatatcagtcgaaactttccaagcactgctcgcaggtggactcggtccgtggcttcggaggcaagtttggtgtccagatggacagagttgatcagtctgctgtaggctttgaataccaggggaagactgagaagcatgcctcccagaaaggtaagacgcgaaaggtgcagaaagagcccgctccgggggccccgatggggagagtcacagccacctgaagccgtttccccgcgctccgggggccctgatggggagagtcacagccacctgaagccgtttcctgagcggtggctgttgccacaaggaggactctgccctcctcttcatgtttctggatcatctggataccacatgatggatgtattccccgttacacatccccctcggagccctggcatctgctgtcattgtggggcttctcccccttgtagcggaagccgccttcccttcatctgggcagcgctcctcctggaaaagagagctcacagattgatcggcagaaagctaacttccccccaaggctagaaaccagagttgttaaattcttgttttccttatacacatacggtcttaactgctggtgattaatcttgattacatcatgcagtctcttttttgaaagaccaaagcatatcgccaccttaaagttctcagtttattttttgcaagcttatttagttcttcctcctttgtgtcattgcatcatccgcggaacaagctctcagtccttacgcagtctcggtgcagtctaggtggaggtagctgtggtgtgggcaggcggaggatcagggtcttgtctcccatgttcagctgcatggctttcttcatatgaggctttctctttccatttttttcattttgttttgtttgtttgtttgttttgagacagagtctcgctctgttgcccaggctggagtgcagtggcacgatctcggctcactgcaacctgcgcctcctgggttcaaacgattctcctgcctcagcctcccaagtagctgggattacaggtgtgtgccactacccctggctagtttttctattttttagtaaagatggggttttgccacgttggccaggctggtctcaaactcctggcctcaagtgatccgcccacctcagcctccaaagtgctggttctttgtatgaagctttccagcttttacctgagcagttgattttcaaagtgggcatgcagcgtcatttctgactacacaaaggaactgccctgtaacagctgacagggcccagaacccccccatgcacctgttgtgaaacagggtccagcgtcacctgtatggagcagtgggtggcttgttgtacattttaaaatgtgcgcttgatgtgtttgtgagttgtaacccctacacacttttgcttagtttaacaaaaggaacagtgtagttcgtcctcaggcccccgtgctaattgctgccctgtctctccagactactccagtggttttggcggcaagtatggcgtgcaggccgaccgagtagacaagagcgcggtgggcttcgactaccagggcaagacggagaagcacgagtcacagagagattactccaaaggtttcggcggcaaatacggtatcgacaaggacaaagtggataagagcgccgttggctttgagtatcaaggcaaaacggagaagcacgagtcccagaaagactatgtgaaagggtttggaggaaaatttggtgtgcagacagacagacaagacaaatgtgcccttggctgggatcaccaggagaaattgcagctgcatgaatcccaaaaagattataagactggttttggaggcaaattcggtgttcagtcggagaggcaggactccgctgctgtggggtttgattacaaggagaagctggccaagcacgagtcccagcaagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagccagagccaaaacgcaaacgccccctgtgtcgcccgcacctcagccaaccgaggagaggctgccctcgagccccgtctatgaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcagaggacagcacctacgatgagtacgagaacgatctggggatcacagccgtcgccctgtacgactaccaggctgcgggcgatgatgagatctcatttgaccctgatgacatcatcaccaacatcgagatgattgacgacggctggtggcgcggggtgtgcaagggccggtacgggctcttcccagccaactatgtggagctgcggcagtagggcccccagcccccccccggagctgcgccctggatcctcacactacagatcaggccttctttggttcttgggtggttttgggttttttctgttttttttttttttttttttttttttttttgaaggtggggaggggaatatacacattgcttttatatttaatacttttgctgatgcttttgaaaatgtttatgccacagaatttgctaatatattgtaatcacattccttaggaggactttggtaattggttttatgcattgatggttttttttttcttttttgccaaattgactgtcacgcggcagcttcagggagctcgcattctcttgtgttcgtgttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtcttaactgtcacccatatggtccctgggccaccgggcagcctggggcggtgtgtgtgccatgtcacagcatggcctctcggccttgggaaggaaggcagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatcca

SEQ ID NO: 62140 - DNA, 2671 bp, Homo sapiens
gaggatcccccgcgttctcctaccaggggaagactgagaagcatgcctcccagaaagactactccagtggttttggcggcaagtatggcgtgcaggccgaccgagtagacaagagcgcggtgggcttcgactaccagggcaagacggagaagcacgagtcacagagagattactccaaaggtttcggcggcaaatacggtatcgacaaggacaaagtggataagagcgccgttggctttgagtatcaaggcaaaacggagaagcacgagtcccagaaagactatgtgaaagggtttggaggaaaatttggtgtgcagacagacagacaagacaaatgtgcccttggctgggatcaccaggagaaattgcagctgcatgaatcccaaaaagattataagactggttttggaggcaaattcggtgttcagtcggagaggcaggactccgctgctgtggggtttgattacaaggagaagctggccaagcacgagtcccagcaagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagccagagccaaaacgcaaacgccccctgtgtcgcccgcacctcagccaaccgaggagaggctgccctcgagccccgtctatgaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcagaggacagcacctacgatgagtacgagaacgatctggggatcacagccgtcgccctgtacgactaccaggctgcgggcgatgatgagatctcatttgaccctgatgacatcatcaccaacatcgagatgattgacgacggctggtggcgcggggtgtgcaagggccggtacgggctcttcccagccaactatgtggagctgcggcagtagggcccccagcccccccccggagctgcgccctggatcctcacactacagatcaggccttctttggttcttgggtggttttgggttttttctgttttttttttttttttttttttttttttttgaaggtggggaggggaatatacacattgcttttatatttaatacttttgctgatgcttttgaaaatgtttatgccacagaatttgctaatatattgtaatcacattccttaggaggactttggtaattggttttatgcattgatggttttttttttcttttttgccaaattgactgtcacgcggcagcttcagggagctcgcattctcttgtgttcgtgttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtcttaactgtcacccatatggtccctgggccaccgggcagcctggggcggtgtgtgtgccatgtcacagcatggcctctcggccttgggaaggaaggcagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatcca

SEQ ID NO: 62141 - DNA, 3094 bp, Homo sapiens
actgatttcgttgctccttttaaagtagtccttttttgtttgtttttagattactccaaaggtttcggcggcaaatacggtatcgacaaggacaaagtggataagagcgccgttggctttgagtatcaaggcaaaacggagaagcacgagtcccagaaaggtgtcttccgttttatcttaccctccagccagcagctagtaatgtgacaggtggtagccacaccggaaaaggaaaaacaaagcgttattgatagcccttaacgtagatgtctctttttcatgaaatgcccaacttgaaaacggcacatccagaaacacagctgctaaataggaactcgcagcttgagtgttatggcgctccagccccagcggcgttgcttatcgtggtggccacaccccgcacgtctgtgttgcccgtgtgagcctgtgctgtctcatggtgcgggtggaagccgcatgcgtgggagcttccatggggtcctgtctggcttagtcacgatgctgaggtcatagactaggttatttcctgccactctccaaggagggcctcttcatggatgttatctaaagtattaccaaagatccggaagggaagagtagattgagtgaatcatatgcgtttaactgtattgaaaacatactttccacctgtgacctgcactacccgatatatgtggttctggcctttcattgtgcatgtagactatgtgaaagggtttggaggaaaatttggtgtgcagacagacagacaagacaaatgtgcccttggctgggatcaccaggagaaattgcagctgcatgaatcccaaaaagattataagactggttttggaggcaaattcggtgttcagtcggagaggcaggactccgctgctgtggggtttgattacaaggagaagctggccaagcacgagtcccagcaagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagccagagccaaaacgcaaacgccccctgtgtcgcccgcacctcagccaaccgaggagaggctgccctcgagccccgtctatgaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcagaggacagcacctacgatgagtacgagaacgatctggggatcacagccgtcgccctgtacgactaccaggctgcgggcgatgatgagatctcatttgaccctgatgacatcatcaccaacatcgagatgattgacgacggctggtggcgcggggtgtgcaagggccggtacgggctcttcccagccaactatgtggagctgcggcagtagggcccccagcccccccccggagctgcgccctggatcctcacactacagatcaggccttctttggttcttgggtggttttgggttttttctgttttttttttttttttttttttttttttttgaaggtggggaggggaatatacacattgcttttatatttaatacttttgctgatgcttttgaaaatgtttatgccacagaatttgctaatatattgtaatcacattccttaggaggactttggtaattggttttatgcattgatggttttttttttcttttttgccaaattgactgtcacgcggcagcttcagggagctcgcattctcttgtgttcgtgttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtcttaactgtcacccatatggtccctgggccaccgggcagcctggggcggtgtgtgtgccatgtcacagcatggcctctcggccttgggaaggaaggcagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatcca

SEQ ID NO: 62142 - DNA, 3045 bp, Homo sapiens
gcgcatcccgctactcattcggtttacaacgtctcgacttggacaaagtggataagagcgccgttggctttgagtatcaaggcaaaacggagaagcacgagtcccagaaaggtgtcttccgttttatcttaccctccagccagcagctagtaatgtgacaggtggtagccacaccggaaaaggaaaaacaaagcgttattgatagcccttaacgtagatgtctctttttcatgaaatgcccaacttgaaaacggcacatccagaaacacagctgctaaataggaactcgcagcttgagtgttatggcgctccagccccagcggcgttgcttatcgtggtggccacaccccgcacgtctgtgttgcccgtgtgagcctgtgctgtctcatggtgcgggtggaagccgcatgcgtgggagcttccatggggtcctgtctggcttagtcacgatgctgaggtcatagactaggttatttcctgccactctccaaggagggcctcttcatggatgttatctaaagtattaccaaagatccggaagggaagagtagattgagtgaatcatatgcgtttaactgtattgaaaacatactttccacctgtgacctgcactacccgatatatgtggttctggcctttcattgtgcatgtagactatgtgaaagggtttggaggaaaatttggtgtgcagacagacagacaagacaaatgtgcccttggctgggatcaccaggagaaattgcagctgcatgaatcccaaaaagattataagactggttttggaggcaaattcggtgttcagtcggagaggcaggactccgctgctgtggggtttgattacaaggagaagctggccaagcacgagtcccagcaagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagccagagccaaaacgcaaacgccccctgtgtcgcccgcacctcagccaaccgaggagaggctgccctcgagccccgtctatgaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcagaggacagcacctacgatgagtacgagaacgatctggggatcacagccgtcgccctgtacgactaccaggctgcgggcgatgatgagatctcatttgaccctgatgacatcatcaccaacatcgagatgattgacgacggctggtggcgcggggtgtgcaagggccggtacgggctcttcccagccaactatgtggagctgcggcagtagggcccccagcccccccccggagctgcgccctggatcctcacactacagatcaggccttctttggttcttgggtggttttgggttttttctgttttttttttttttttttttttttttttttgaaggtggggaggggaatatacacattgcttttatatttaatacttttgctgatgcttttgaaaatgtttatgccacagaatttgctaatatattgtaatcacattccttaggaggactttggtaattggttttatgcattgatggttttttttttcttttttgccaaattgactgtcacgcggcagcttcagggagctcgcattctcttgtgttcgtgttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtcttaactgtcacccatatggtccctgggccaccgggcagcctggggcggtgtgtgtgccatgtcacagcatggcctctcggccttgggaaggaaggcagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatcca

SEQ ID NO: 62143 - DNA, 2200 bp, Homo sapiens
  misc_feature (9)..(9): n is a, c, g, or t
gcgtggtcnggcccggagtgttatggatagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagccagagccaaaacgcaaacgccccctgtgtcgcccgcacctcagccaaccgaggagaggctgccctcgagccccgtctatgaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcagaggacagcacctacgatgagtacgagaacgatctggggatcacagccgtcgccctgtacgactaccaggctgcgggcgatgatgagatctcatttgaccctgatgacatcatcaccaacatcgagatgattgacgacggctggtggcgcggggtgtgcaagggccggtacgggctcttcccagccaactatgtggagctgcggcagtagggcccccagcccccccccggagctgcgccctggatcctcacactacagatcaggccttctttggttcttgggtggttttgggttttttctgttttttttttttttttttttttttttttttgaaggtggggaggggaatatacacattgcttttatatttaatacttttgctgatgcttttgaaaatgtttatgccacagaatttgctaatatattgtaatcacattccttaggaggactttggtaattggttttatgcattgatggttttttttttcttttttgccaaattgactgtcacgcggcagcttcagggagctcgcattctcttgtgttcgtgttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtcttaactgtcacccatatggtccctgggccaccgggcagcctggggcggtgtgtgtgccatgtcacagcatggcctctcggccttgggaaggaaggcagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatcca

SEQ ID NO: 62144 - DNA, 2314 bp, Homo sapiens
gaagctatgactacaggtcacgagactcggtgctgttaaagttgcgtgcacagagggcgtgagtagcgcacggagtacacgctagactgatgcgggctttgatacacaaggtagaagctggccaagcacgagtcccagcaagagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagccagagccaaaacgcaaacgccccctgtgtcgcccgcacctcagccaaccgaggagaggctgccctcgagccccgtctatgaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcagaggacagcacctacgatgagtacgagaacgatctggggatcacagccgtcgccctgtacgactaccaggctgcgggcgatgatgagatctcatttgaccctgatgacatcatcaccaacatcgagatgattgacgacggctggtggcgcggggtgtgcaagggccggtacgggctcttcccagccaactatgtggagctgcggcagtagggcccccagcccccccccggagctgcgccctggatcctcacactacagatcaggccttctttggttcttgggtggttttgggttttttctgttttttttttttttttttttttttttttttgaaggtggggaggggaatatacacattgcttttatatttaatacttttgctgatgcttttgaaaatgtttatgccacagaatttgctaatatattgtaatcacattccttaggaggactttggtaattggttttatgcattgatggttttttttttcttttttgccaaattgactgtcacgcggcagcttcagggagctcgcattctcttgtgttcgtgttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtcttaactgtcacccatatggtccctgggccaccgggcagcctggggcggtgtgtgtgccatgtcacagcatggcctctcggccttgggaaggaaggcagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatcca

SEQ ID NO: 62145 - DNA, 2499 bp, Homo sapiens
ctgcagcgttagaaacacacagcagtgttcaggtgtgggcaggtagacacacctggggtggtcccgcagactgcatggagatggcagtggctctccgtggcatcactgctgcatgacagtgtgactttcatgtggatctgtgttgctgcaacggaagtctttggctggtagaatttccacatggattttttttttctcttaaaaagcaagagaacaaactgcgattgagcctctttttagcgctcagtagagcaggcgcacaggaagcagatgagaataagcccgtgctggtgcggaagactgtgctattgaagtggcgcgttgcaaagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagccagagccaaaacgcaaacgccccctgtgtcgcccgcacctcagccaaccgaggagaggctgccctcgagccccgtctatgaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcagaggacagcacctacgatgagtacgagaacgatctggggatcacagccgtcgccctgtacgactaccaggctgcgggcgatgatgagatctcatttgaccctgatgacatcatcaccaacatcgagatgattgacgacggctggtggcgcggggtgtgcaagggccggtacgggctcttcccagccaactatgtggagctgcggcagtagggcccccagcccccccccggagctgcgccctggatcctcacactacagatcaggccttctttggttcttgggtggttttgggttttttctgttttttttttttttttttttttttttttttgaaggtggggaggggaatatacacattgcttttatatttaatacttttgctgatgcttttgaaaatgtttatgccacagaatttgctaatatattgtaatcacattccttaggaggactttggtaattggttttatgcattgatggttttttttttcttttttgccaaattgactgtcacgcggcagcttcagggagctcgcattctcttgtgttcgtgttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtcttaactgtcacccatatggtccctgggccaccgggcagcctggggcggtgtgtgtgccatgtcacagcatggcctctcggccttgggaaggaaggcagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatcca

SEQ ID NO: 62146 - DNA, 2520 bp, Homo sapiens
  misc_feature (131)..(131): n is a, c, g, or t
catggccgggctagcgcttagccagctgcgtggctggacccccgggactcttgcgggccaagacgcgggaagaggcggggcagggggcggggtctgcgcggggacccggatgcggcccgaccgcgacctcnggaaccggaagtagagcctggtgcctgggagcggctggcgcggcggaatccagggccgacccgggccggaccgaccccaggcggcgacggaatcagtccccaatgcctggaaattcctcattggattactgtgttttaaacagaatttcgtgaacagccttttatctccaagcggaaagaaagatgtggaaagcttcagcaggccacgctgtgtccatcgcccaggatgacgcgggggccgatgactgggagaccgaccctgattttgtgaatgatgtgagtgagaaggagcaaagatggggtgccaagacggtgcagggctccgggcaccaggagcatatcaacatacacaagctgagggagaatgtctttcaagagcatcagacccttaaggagaaggaacttgaaacaggaccaaaagcttcccatggctatggagggaaatttggtgtggaacaagaccgaatggataagtcagctgtcggccacgaatatcagtcgaaactttccaagcactgctcgcaggtggactcggtccgtggcttcggaggcaagtttggtgtccagatggacagagttgatcagtctgctgtaggctttgaataccaggggaagactgagaagcatgcctcccagaaagactactccagtggttttggcggcaagtatggcgtgcaggccgaccgagtagacaagagcgcggtgggcttcgactaccagggcaagacggagaagcacgagtcacagagagattactccaaaggtttcggcggcaaatacggtatcgacaaggacaaagtggataagagcgccgttggctttgagtatcaaggcaaaacggagaagcacgagtcccagaaagactatgtgaaagggtttggaggaaaatttggtgtgcagacagacagacaagacaaatgtgcccttggctgggatcaccaggagaaattgcagctgcatgaatcccaaaaagattataagactggttttggaggcaaattcggtgttcagtcggagaggcaggactccgctgctgtggggtttgattacaaggagaagctggccaagcacgagtcccagcaagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtcttaactgtcacccatatggtccctgggccaccgggcagcctggggcggtgtgtgtgccatgtcacagcatggcctctcggccttgggaaggaaggcagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatcca

SEQ ID NO: 62147 - DNA, 1101 bp, Homo sapiens
aaaacgctccaggcacgatgtagaggatccccccatgacaaagctcattcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtcttaactgtcacccatatggtccctgggccaccgggcagcctggggcggtgtgtgtgccatgtcacagcatggcctctcggccttgggaaggaaggcagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatcca

SEQ ID NO: 62148 - DNA, 1044 bp, Homo sapiens
tagacggtccggaatttttgtcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtcttaactgtcacccatatggtccctgggccaccgggcagcctggggcggtgtgtgtgccatgtcacagcatggcctctcggccttgggaaggaaggcagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatcca

SEQ ID NO: 62149 - DNA, 2826 bp, Homo sapiens
  misc_feature (131)..(131): n is a, c, g, or t
catggccgggctagcgcttagccagctgcgtggctggacccccgggactcttgcgggccaagacgcgggaagaggcggggcagggggcggggtctgcgcggggacccggatgcggcccgaccgcgacctcnggaaccggaagtagagcctggtgcctgggagcggctggcgcggcggaatccagggccgacccgggccggaccgaccccaggcggcgacggaatcagtccccaatgcctggaaattcctcattggattactgtgttttaaacagaatttcgtgaacagccttttatctccaagcggaaagaaagatgtggaaagcttcagcaggccacgctgtgtccatcgcccaggatgacgcgggggccgatgactgggagaccgaccctgattttgtgaatgatgtgagtgagaaggagcaaagatggggtgccaagacggtgcagggctccgggcaccaggagcatatcaacatacacaagctgagggagaatgtctttcaagagcatcagacccttaaggagaaggaacttgaaacaggaccaaaagcttcccatggctatggagggaaatttggtgtggaacaagaccgaatggataagtcagctgtcggccacgaatatcagtcgaaactttccaagcactgctcgcaggtggactcggtccgtggcttcggaggcaagtttggtgtccagatggacagagttgatcagtctgctgtaggctttgaataccaggggaagactgagaagcatgcctcccagaaagactactccagtggttttggcggcaagtatggcgtgcaggccgaccgagtagacaagagcgcggtgggcttcgactaccagggcaagacggagaagcacgagtcacagagagattactccaaaggtttcggcggcaaatacggtatcgacaaggacaaagtggataagagcgccgttggctttgagtatcaaggcaaaacggagaagcacgagtcccagaaagactatgtgaaagggtttggaggaaaatttggtgtgcagacagacagacaagacaaatgtgcccttggctgggatcaccaggagaaattgcagctgcatgaatcccaaaaagattataagactggttttggaggcaaattcggtgttcagtcggagaggcaggactccgctgctgtggggtttgattacaaggagaagctggccaagcacgagtcccagcaagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagccagagccaaaacgcaaacgccccctgtgtcgcccgcacctcagccaaccgaggagaggctgccctcgagccccgtctatgaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcagaggacagcacctacgatgagtacgagaacgatctggggatcacagccgtcgccctgtacgactaccaggctgcgggcgatgatgagatctcatttgaccctgatgacatcatcaccaacatcgagatgattgacgacggctggtggcgcggggtgtgcaagggccggtacgggctcttcccagccaactatgtggagctgcggcagtagggcccccagcccccccccggagctgcgccctggatcctcacactacagatcaggccttctttggttcttgggtggttttgggttttttctgttttttttttttttttttttttttttttttgaaggtggggaggggaatatacacattgcttttatatttaatacttttgctgatgcttttgaaaatgtttatgccacagaatttgctaatatattgtaatcacattccttaggaggactttggtaattggttttatgcattgatggttttttttttcttttttgccaaattgactgtcacgcggcagcttcagggagctcgcattctcttgtgttcgtgttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacaccgccccaggctgcccgtggcccagggaccatatgggtgacagttaagacatcgcctttgtgaaaagccaagcccgacgcagcctcg

SEQ ID NO: 62150 - DNA, 914 bp, Homo sapiens
aagtcagacaggctggtggtaatcggacgaggtgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtcttaactgtcacccatatggtccctgggccaccgggcagcctggggcggtgtgtgtgccatgtcacagcatggcctctcggccttgggaaggaaggcagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatcca

SEQ ID NO: 62151 - DNA, 928 bp, Homo sapiens
aaaattactataccgaccaggttaagcctgtcgattaaggtgaatctgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtcttaactgtcacccatatggtccctgggccaccgggcagcctggggcggtgtgtgtgccatgtcacagcatggcctctcggccttgggaaggaaggcagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatcca

SEQ ID NO: 62152 - DNA, 2304 bp, Homo sapiens
  misc_feature (131)..(131): n is a, c, g, or t
catggccgggctagcgcttagccagctgcgtggctggacccccgggactcttgcgggccaagacgcgggaagaggcggggcagggggcggggtctgcgcggggacccggatgcggcccgaccgcgacctcnggaaccggaagtagagcctggtgcctgggagcggctggcgcggcggaatccagggccgacccgggccggaccgaccccaggcggcgacggaatcagtccccaatgcctggaaattcctcattggattactgtgttttaaacagaatttcgtgaacagccttttatctccaagcggaaagaaagatgtggaaagcttcagcaggccacgctgtgtccatcgcccaggatgacgcgggggccgatgactgggagaccgaccctgattttgtgaatgatgtgagtgagaaggagcaaagatggggtgccaagacggtgcagggctccgggcaccaggagcatatcaacatacacaagctgagggagaatgtctttcaagagcatcagacccttaaggagaaggaacttgaaacaggaccaaaagcttcccatggctatggagggaaatttggtgtggaacaagaccgaatggataagtcagctgtcggccacgaatatcagtcgaaactttccaagcactgctcgcaggtggactcggtccgtggcttcggaggcaagtttggtgtccagatggacagagttgatcagtctgctgtaggctttgaataccaggggaagactgagaagcatgcctcccagaaagactactccagtggttttggcggcaagtatggcgtgcaggccgaccgagtagacaagagcgcggtgggcttcgactaccagggcaagacggagaagcacgagtcacagagagattactccaaaggtttcggcggcaaatacggtatcgacaaggacaaagtggataagagcgccgttggctttgagtatcaaggcaaaacggagaagcacgagtcccagaaagactatgtgaaagggtttggaggaaaatttggtgtgcagacagacagacaagacaaatgtgcccttggctgggatcaccaggagaaattgcagctgcatgaatcccaaaaagattataagactggttttggaggcaaattcggtgttcagtcggagaggcaggactccgctgctgtggggtttgattacaaggagaagctggccaagcacgagtcccagcaagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagccagagccaaaacgcaaacgccccctgtgtcgcccgcacctcagccaaccgaggagaggctgccctcgagccccgtctatgaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcagaggacagcacctacgatgagtacgagaacgatctggggatcacagccgtcgccctgtacgactaccaggctgcgggcgatgatgagatctcatttgaccctgatgacatcatcaccaacatcgagatgattgacgacggctggtggcgcggggtgtgcaagggccgcttcagggagctcgcattctcttgtgttcgtgttgccctcgtgcccatcaagtgcagtcgggacctcccaggacaagcacgaggccgaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatcca

SEQ ID NO: 62153 - DNA, 1933 bp, Homo sapiens
  misc_feature (131)..(131): n is a, c, g, or t
catggccgggctagcgcttagccagctgcgtggctggacccccgggactcttgcgggccaagacgcgggaagaggcggggcagggggcggggtctgcgcggggacccggatgcggcccgaccgcgacctcnggaaccggaagtagagcctggtgcctgggagcggctggcgcggcggaatccagggccgacccgggccggaccgaccccaggcggcgacggaatcagtccccaatgcctggaaattcctcattggattactgtgttttaaacagaatttcgtgaacagccttttatctccaagcggaaagaaagatgtggaaagcttcagcaggccacgctgtgtccatcgcccaggatgacgcgggggccgatgactgggagaccgaccctgattttgtgaatgatgtgagtgagaaggagcaaagatggggtgccaagacggtgcagggctccgggcaccaggagcatatcaacatacacaagctgagggagaatgtctttcaagagcatcagacccttaaggagaaggaacttgaaacaggaccaaaagcttcccatggctatggagggaaatttggtgtggaacaagaccgaatggataagtcagctgtcggccacgaatatcagtcgaaactttccaagcactgctcgcaggtggactcggtccgtggcttcggaggcaagtttggtgtccagatggacagagttgatcagtctgctgtaggctttgaataccaggggaagactgagaagcatgcctcccagaaagactactccagtggttttggcggcaagtatggcgtgcaggccgaccgagtagacaagagcgcggtgggcttcgactaccagggcaagacggagaagcacgagtcacagagagattactccaaaggtttcggcggcaaatacggtatcgacaaggacaaagtggataagagcgccgttggctttgagtatcaaggcaaaacggagaagcacgagtcccagaaagactatgtgaaagggtttggaggaaaatttggtgtgcagacagacagacaagacaaatgtgcccttggctgggatcaccaggagaaattgcagctgcatgaatcccaaaaagattataagactggttttggaggcaaattcggtgttcagtcggagaggcaggactccgctgctgtggggtttgattacaaggagaagctggccaagcacgagtcccagcaagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagccagagccaaaacgcaaacgccccctgtgtcgcccgcacctcagccaaccgaggagaggctgccctcgagccccgtctatgaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcagaggacagcacctacgatgagtacgagaacgatctggggatcacagccgtcgccctgtacgactaccaggctgcgggcgatgatgagatctcatttgaccctgatgacatcatcaccaacatcgagatgatacacgagctggtagcatgaaattggaacctctaggtagctcacat

SEQ ID NO: 62154 - DNA, 1812 bp, Homo sapiens
  misc_feature (131)..(131): n is a, c, g, or t
catggccgggctagcgcttagccagctgcgtggctggacccccgggactcttgcgggccaagacgcgggaagaggcggggcagggggcggggtctgcgcggggacccggatgcggcccgaccgcgacctcnggaaccggaagtagagcctggtgcctgggagcggctggcgcggcggaatccagggccgacccgggccggaccgaccccaggcggcgacggaatcagtccccaatgcctggaaattcctcattggattactgtgttttaaacagaatttcgtgaacagccttttatctccaagcggaaagaaagatgtggaaagcttcagcaggccacgctgtgtccatcgcccaggatgacgcgggggccgatgactgggagaccgaccctgattttgtgaatgatgtgagtgagaaggagcaaagatggggtgccaagacggtgcagggctccgggcaccaggagcatatcaacatacacaagctgagggagaatgtctttcaagagcatcagacccttaaggagaaggaacttgaaacaggaccaaaagcttcccatggctatggagggaaatttggtgtggaacaagaccgaatggataagtcagctgtcggccacgaatatcagtcgaaactttccaagcactgctcgcaggtggactcggtccgtggcttcggaggcaagtttggtgtccagatggacagagttgatcagtctgctgtaggctttgaataccaggggaagactgagaagcatgcctcccagaaagactactccagtggttttggcggcaagtatggcgtgcaggccgaccgagtagacaagagcgcggtgggcttcgactaccagggcaagacggagaagcacgagtcacagagagattactccaaaggtttcggcggcaaatacggtatcgacaaggacaaagtggataagagcgccgttggctttgagtatcaaggcaaaacggagaagcacgagtcccagaaagactatgtgaaagggtttggaggaaaatttggtgtgcagacagacagacaagacaaatgtgcccttggctgggatcaccaggagaaattgcagctgcatgaatcccaaaaagattataagactggttttggaggcaaattcggtgttcagtcggagaggcaggactccgctgctgtggggtttgattacaaggagaagctggccaagcacgagtcccagcaaggcacagttgccaccagcctcctaccctccccccgaccctcctgtgcggccacttctagcacagacttcagggctcaccgtcagcacctgcaacacagtcctcctgtgtcaccacttgtcagctgtcaggctgttcggcactttaaacccatttctagtagagcgacactgattttgagtggttcactttcttccctgtgaacttgtgatctgtgtatggcaggatgcgccagttagtgtgtgggtgccatctttctaacccggtgacccatccagtctctggactggggcatctccggtctccagcagcattctgcccgaggctgttctgctgttattggtgactgccgtgagccactgagtcaggccttccagatgaggagagaggtgttggttcaaccaaaccactggccatttgaccaggggcttcgtagcagcaagggccaggagacaggcgtgttctgtgtggtttctgtgtttcatttgtggtggtgtttttggccggggttgggaggttttttgtttgttctgtttgatgacaccatatgtgtgtaacatctccacacagagccacacagtatgtacgtgaagccagctc

SEQ ID NO: 62155 - DNA, 1354 bp, Homo sapiens
  misc_feature (131)..(131): n is a, c, g, or t
catggccgggctagcgcttagccagctgcgtggctggacccccgggactcttgcgggccaagacgcgggaagaggcggggcagggggcggggtctgcgcggggacccggatgcggcccgaccgcgacctcnggaaccggaagtagagcctggtgcctgggagcggctggcgcggcggaatccagggccgacccgggccggaccgaccccaggcggcgacggaatcagtccccaatgcctggaaattcctcattggattactgtgttttaaacagaatttcgtgaacagccttttatctccaagcggaaagaaagatgtggaaagcttcagcaggccacgctgtgtccatcgcccaggatgacgcgggggccgatgactgggagaccgaccctgattttgtgaatgatgtgagtgagaaggagcaaagatggggtgccaagacggtgcagggctccgggcaccaggagcatatcaacatacacaagctgagggagaatgtctttcaagagcatcagacccttaaggagaaggaacttgaaacaggaccaaaagcttcccatggctatggagggaaatttggtgtggaacaagaccgaatggataagtcagctgtcggccacgaatatcagtcgaaactttccaagcactgctcgcaggtggactcggtccgtggcttcggaggcaagtttggtgtccagatggacagagttgatcagtctgctgtaggctttgaataccaggggaagactgagaagcatgcctcccagaaagactactccagtggttttggcggcaagtatggcgtgcaggccgaccgagtagacaagagcgcggtgggcttcgactaccagggcaagacggagaagcacgagtcacagagagattactccaaaggtttcggcggcaaatacggtatcgacaaggacaaagtggataagagcgccgttggctttgagtatcaaggcaaaacggagaagcacgagtcccagaaagactatgtgaaagggtttggaggaaaatttggtgtgcagacagacagacaagacaaatgtgcccttggctgggatcaccaggagaaattgcagctgcatgaatcccaaaaaggtacattcactctgcctgtatgcgagatggttttagaagtttgtttttgttccttgcggggtcagttggtatgtgttgtgtctgcgtgtgcctgctgcacattgttttgtcttcactgtttgaagttgtcctgtgtgcccccccaatcccccagttccctccagctagtgtagtcacaaaccctcctgctgacacggggtggtaccccagagagctgggtttacctggaagtgggttgcacggccaagcc

SEQ ID NO: 62156 - DNA, 3185 bp, Homo sapiens
  misc_feature (131)..(131): n is a, c, g, or t
  misc_feature (2504)..(2504): n is a, c, g, or t
catggccgggctagcgcttagccagctgcgtggctggacccccgggactcttgcgggccaagacgcgggaagaggcggggcagggggcggggtctgcgcggggacccggatgcggcccgaccgcgacctcnggaaccggaagtagagcctggtgcctgggagcggctggcgcggcggaatccagggccgacccgggccggaccgaccccaggcggcgacggaatcagtccccaatgcctggaaattcctcattggattactgtgttttaaacagaatttcgtgaacagccttttatctccaagcggaaagaaagatgtggaaagcttcagcaggccacgctgtgtccatcgcccaggatgacgcgggggccgatgactgggagaccgaccctgattttgtgaatgatgtgagtgagaaggagcaaagatggggtgccaagacggtgcagggctccgggcaccaggagcatatcaacatacacaagctgagggagaatgtctttcaagagcatcagacccttaaggagaaggaacttgaaacaggaccaaaagcttcccatggctatggagggaaatttggtgtggaacaagaccgaatggataagtcagctgtcggccacgaatatcagtcgaaactttccaagcactgctcgcaggtggactcggtccgtggcttcggaggcaagtttggtgtccagatggacagagttgatcagtctgctgtaggctttgaataccaggggaagactgagaagcatgcctcccagaaaggtaagacgcgaaaggtgcagaaagagcccgctccgggggccccgatggggagagtcacagccacctgaagccgtttccccgcgctccgggggccctgatggggagagtcacagccacctgaagccgtttcctgagcggtggctgttgccacaaggaggactctgccctcctcttcatgtttctggatcatctggataccacatgatggatgtattccccgttacacatccccctcggagccctggcatctgctgtcattgtggggcttctcccccttgtagcggaagccgccttcccttcatctgggcagcgctcctcctggaaaagagagctcacagattgatcggcagaaagctaacttccccccaaggctagaaaccagagttgttaaattcttgttttccttatacacatacggtcttaactgctggtgattaatcttgattacatcatgcagtctcttttttgaaagaccaaagcatatcgccaccttaaagttctcagtttattttttgcaagcttatttagttcttcctcctttgtgtcattgcatcatccgcggaacaagctctcagtccttacgcagtctcggtgcagtctaggtggaggtagctgtggtgtgggcaggcggaggatcagggtcttgtctcccatgttcagctgcatggctttcttcatatgaggctttctctttccatttttttcattttgttttgtttgtttgtttgttttgagacagagtctcgctctgttgcccaggctggagtgcagtggcacgatctcggctcactgcaacctgcgcctcctgggttcaaacgattctcctgcctcagcctcccaagtagctgggattacaggtgtgtgccactacccctggctagtttttctattttttagtaaagatggggttttgccacgttggccaggctggtctcaaactcctggcctcaagtgatccgcccacctcagcctccaaagtgctggttctttgtatgaagctttccagcttttacctgagcagttgattttcaaagtgggcatgcagcgtcatttctgactacacaaaggaactgccctgtaacagctgacagggcccagaacccccccatgcacctgttgtgaaacagggtccagcgtcacctgtatggagcagtgggtggcttgttgtacattttaaaatgtgcgcttgatgtgtttgtgagttgtaacccctacacacttttgcttagtttaacaaaaggaacagtgtagttcgtcctcaggcccccgtgctaattgctgccctgtctctccagactactccagtggttttggcggcaagtatggcgtgcaggccgaccgagtagacaagagcgcggtgggcttcgactaccagggcaagacggagaagcacgagtcacagagaggtggggcggaccccacggtctgtaatcacgcgtttgctccagaaacacccacgagggcattttctctctgcacacgtgattgttgtagattttttaactgaaaatgtttggtgttcttttcgtaccagtgtatgtgggcttttcctaattcgaatggctgcacagttccccatcgtatgaggattccatagtccatgtaaccattccttttttgaatgtggaatttaggttatttatttatttatttatttatttttggtagagatgaggtcttgccgtgttgcccggactggtcttgatctccgtggtctcaagcaatcctccccnaccttggtttccttaagtgctgggattacaggtgtgacctgtaaatttttttttttttttcttttagacggagtctcgctccgttgcccaggctggagtgtagtggcgtgatctctgctcactgcaacctccacctccctggttcaagcaattctcgtgcttcagcctcccggctagccgggattacaagcacacgccaccacgcccagctaatttttgtatttttagtagagacggagttctgccatgttgcccaggctggtcttgaattcctgacctcaggtgatcgccctgccttggcctcccaaagtgctgggattacaggtgtgagccactgcgcccagctgaaacttgactgcagggaacattcttgtacctgtgttttgttcacaagtgattattcaaaagaatcaactcctagacatggaattgctgggtcgaaggctattgaatgtaaaatttccatagatactgccaagttgtccttggaggctgtgctgagttcttccttccccactgcatagcctgtacaccatcactcagagcgtttcccagggctgcagaggctgtggcctgcctgtttccctgtgcctcttgtttggcctgcacatttaaatttttaaaaatatttgccaacatttgaaaagtgagagcttgactatttaaaaactcaaaaaaaaa

SEQ ID NO: 62157 - DNA, 1955 bp, Homo sapiens
  misc_feature (131)..(131): n is a, c, g, or t
catggccgggctagcgcttagccagctgcgtggctggacccccgggactcttgcgggccaagacgcgggaagaggcggggcagggggcggggtctgcgcggggacccggatgcggcccgaccgcgacctcnggaaccggaagtagagcctggtgcctgggagcggctggcgcggcggaatccagggccgacccgggccggaccgaccccaggcggcgacggaatcagtccccaatgcctggaaattcctcattggattactgtgttttaaacagaatttcgtgaacagccttttatctccaagcggaaagaaagatgtggaaagcttcagcaggccacgctgtgtccatcgcccaggatgacgcgggggccgatgactgggagaccgaccctgattttgtgaatgatgtgagtgagaaggagcaaagatggggtgccaagacggtgcagggctccgggcaccaggagcatatcaacatacacaagctgagggagaatgtctttcaagagcatcagacccttaaggagaaggaacttgaaacaggaccaaaagcttcccatggctatggagggaaatttggtgtggaacaagaccgaatggataagtcagctgtcggccacgaatatcagtcgaaactttccaagcactgctcgcaggtggactcggtccgtggcttcggaggcaagtttggtgtccagatggacagagttgatcagtctgctgtaggctttgaataccaggggaagactgagaagcatgcctcccagaaagactactccagtggttttggcggcaagtatggcgtgcaggccgaccgagtagacaagagcgcggtgggcttcgactaccagggcaagacggagaagcacgagtcacagagagattactccaaaggtttcggcggcaaatacggtatcgacaaggacaaagtggataagagcgccgttggctttgagtatcaaggcaaaacggagaagcacgagtcccagaaaggtgtcttccgttttatcttaccctccagccagcagctagtaatgtgacaggtggtagccacaccggaaaaggaaaaacaaagcgttattgatagcccttaacgtagatgtctctttttcatgaaatgcccaacttgaaaacggcacatccagaaacacagctgctaaataggaactcgcagcttgagtgttatggcgctccagccccagcggcgttgcttatcgtggtggccacaccccgcacgtctgtgttgcccgtgtgagcctgtgctgtctcatggtgcgggtggaagccgcatgcgtgggagcttccatggggtcctgtctggcttagtcacgatgctgaggtcatagactaggttatttcctgccactctccaaggagggcctcttcatggatgttatctaaagtattaccaaagatccggaagggaagagtagattgagtgaatcatatgcgtttaactgtattgaaaacatactttccacctgtgacctgcactacccgatatatgtggttctggcctttcattgtgcatgtagactatgtgaaagggtttggaggaaaatttggtgtgcagacagacagacaagacaaatgtgcccttggctgggatcaccaggagaaattgcagctgcatgaatcccaaaaagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcagccagaccacaatatcggggatcctctga

SEQ ID NO: 62158 - DNA, 737 bp, Homo sapiens
  misc_feature (38)..(38): n is a, c, g, or t
aaatgatgtcatgagctgcgccctcgggtttgatttcnggaaccggaagtagagcctggtgcctgggagcggctggcgcggcggaatccagggccgacccgggccggaccgaccccaggcggcgacggaatcagtccccaatgcctggaaattcctcattggattactgtgttttaaacagaatttcgtgaacagccttttatctccaagcggaaagaaagatgtggaaagcttcagcaggccacgctgtgtccatcgcccaggatgacgcgggggccgatgactgggagaccgaccctgattttgtgaatgatgtgagtgagaaggagcaaagatggggtgccaagacggtgcagggctccgggcaccaggagcatatcaagtaagaggcgtcgccaccaccctcccgagggcccctctgcggatggagccccaggtgcaacagggcccatggtcatctgtggagggacagcccgtgtggaaactgcatttatcttcttgacctgatacccatgcagtaaatgaatataagacacacacatatatgtgtatttgtgtaatgtgtgtgtttatatgtgtatatttagatacttctgtgctcagtaatttttaaattcccattgcaaacaatttccgtatttataattttagagtgtccgcttctcagtattgtggcttttatcagggaacatttgtccctaagctctaccttacaagcgagaggtttctaaagtatg

SEQ ID NO: 62159 - DNA, 316 bp, Homo sapiens
gtgttttgccacgtttcagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggtgagtggcaaggagtgggccg

SEQ ID NO: 62160 - DNA, 4295 bp, Homo sapiens
  misc_feature (38)..(38): n is a, c, g, or t
  misc_feature (3867)..(3867): n is a, c, g, or t
aaatgatgtcatgagctgcgccctcgggtttgatttcnggaaccggaagtagagcctggtgcctgggagcggctggcgcggcggaatccagggccgacccgggccggaccgaccccaggcggcgacggaatcagtccccaatgcctggaaattcctcattggattactgtgttttaaacagaatttcgtgaacagccttttatctccaagcggaaagaaagatgtggaaagcttcagcaggccacgctgtgtccatcgcccaggatgacgcgggggccgatgactgggagaccgaccctgattttgtgaatgatgtgagtgagaaggagcaaagatggggtgccaagacggtgcagggctccgggcaccaggagcatatcaacatacacaagctgagggagaatgtctttcaagagcatcagacccttaaggagaaggaacttgaaacaggaccaaaagcttcccatggctatggagggaaatttggtgtggaacaagaccgaatggataagtcagctgtcggccacgaatatcagtcgaaactttccaagcactgctcgcaggtggactcggtccgtggcttcggaggcaagtttggtgtccagatggacagagttgatcagtctgctgtaggctttgaataccaggggaagactgagaagcatgcctcccagaaagactactccagtggttttggcggcaagtatggcgtgcaggccgaccgagtagacaagagcgcggtgggcttcgactaccagggcaagacggagaagcacgagtcacagagagattactccaaaggtttcggcggcaaatacggtatcgacaaggacaaagtggataagagcgccgttggctttgagtatcaaggcaaaacggagaagcacgagtcccagaaagactatgtgaaagggtttggaggaaaatttggtgtgcagacagacagacaagacaaatgtgcccttggctgggatcaccaggagaaattgcagctgcatgaatcccaaaaagattataagactggttttggaggcaaattcggtgttcagtcggagaggcaggactccgctgctgtggggtttgattacaaggagaagctggccaagcacgagtcccagcaagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagccagagccaaaacgcaaacgccccctgtgtcgcccgcacctcagccaaccgaggagaggctgccctcgagccccgtctatgaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcagaggacagcacctacgatgagtacgagaacgatctggggatcacagccgtcgccctgtacgactaccaggctgcgggcgatgatgagatctcatttgaccctgatgacatcatcaccaacatcgagatgattgacgacggctggtggcgcggggtgtgcaagggccggtacgggctcttcccagccaactatgtggagctgcggcagtagggcccccagcccccccccggagctgcgccctggatcctcacactacagatcaggccttctttggttcttgggtggttttgggttttttctgttttttttttttttttttttttttttttttgaaggtggggaggggaatatacacattgcttttatatttaatacttttgctgatgcttttgaaaatgtttatgccacagaatttgctaatatattgtaatcacattccttaggaggactttggtaattggttttatgcattgatggttttttttttcttttttgccaaattgactgtcacgcggcagcttcagggagctcgcattctcttgtgttcgtgttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtcttaactgtcacccatatggtccctgggccaccgggcagcctggggcggtgtgtgtgccatgtcacagcatggcctctcggccttgggaaggaaggcagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatccaaaaaaaaaaaaaaaaaacaaacaaaaaaaaaaaaaaaaaaaaaaaaacaaaaaaagaaggggggggcgcgcgcctacaaaaataatcccccgcgggggggccccacgttttggcgcgcgctccccgcgcttttttgtgtaaacacagggggcgcgccccatatgtaggggggcgcgatataataaaggcgcgggcgcgcgcggcggcgcgcggcggtttataacaacaggagcgctgcccggaggtggagggaacacagtcggtcgcccgcgtggggaactcctctgcgtgcgaaaaagcggacacccccctatcctctgctgggggggcggcgcccgctatgttcgcgggcacaccacctctccaccgcagcaagagatatatgtaagagcgccgctcgagaggcgggaacaatctacaaacacttacgagggcgttctatcatgtggtgtgctaccaccagcagcgcgcatataattgccgcgcgcggtatgaaaaaaatttaggcacccccgcgggaagtatgtatgtacttttcgggagcaacaattcttatttacccgccggggagtctngttgttgttaagaataaaaacaggcgcgcacactccacgacctaacgacagtgacccctggtacagccaacgagcagcaagctgaaccaaccgactgctatgcacacaactagagagtcgggacgaccaggcaacgaggagaatcgtccgcggcaggcgagcgagacagtcgcgacgacgcagcagggcaggggctacagcagcaccaagcgaccgcaccgcggcagacggaggcacggagcgacagaaggaaagcgggcgagctagccaacgcacccgcaggagcagtacgcccaggcagccagcagccagacagcgaacagtcaagcccgcgagaggacacaagcggcgaatcagacagcaggaccagcgcgagccagccacccagacgagacaggagagcacaaaacacgcgcccgcacggccgc

SEQ ID NO: 62161 - DNA, 3397 bp, Homo sapiens
  misc_feature (131)..(131): n is a, c, g, or t
catggccgggctagcgcttagccagctgcgtggctggacccccgggactcttgcgggccaagacgcgggaagaggcggggcagggggcggggtctgcgcggggacccggatgcggcccgaccgcgacctcnggaaccggaagtagagcctggtgcctgggagcggctggcgcggcggaatccagggccgacccgggccggaccgaccccaggcggcgacggaatcagtccccaatgcctggaaattcctcattggattactgtgttttaaacagaatttcgtgaacagccttttatctccaagcggaaagaaagatgtggaaagcttcagcaggccacgctgtgtccatcgcccaggatgacgcgggggccgatgactgggagaccgaccctgattttgtgaatgatgtgagtgagaaggagcaaagatggggtgccaagacggtgcagggctccgggcaccaggagcatatcaacatacacaagctgagggagaatgtctttcaagagcatcagacccttaaggagaaggaacttgaaacaggaccaaaagcttcccatggctatggagggaaatttggtgtggaacaagaccgaatggataagtcagctgtcggccacgaatatcagtcgaaactttccaagcactgctcgcaggtggactcggtccgtggcttcggaggcaagtttggtgtccagatggacagagttgatcagtctgctgtaggctttgaataccaggggaagactgagaagcatgcctcccagaaagactactccagtggttttggcggcaagtatggcgtgcaggccgaccgagtagacaagagcgcggtgggcttcgactaccagggcaagacggagaagcacgagtcacagagagattactccaaaggtttcggcggcaaatacggtatcgacaaggacaaagtggataagagcgccgttggctttgagtatcaaggcaaaacggagaagcacgagtcccagaaagactatgtgaaagggtttggaggaaaatttggtgtgcagacagacagacaagacaaatgtgcccttggctgggatcaccaggagaaattgcagctgcatgaatcccaaaaagcaagagaacaaactgcgattgagcctctttttagcgctcagtagagcaggcgcacaggaagcagatgagaataagcccgtgctggtgcggaagactgtgctattgaagtggcgcgttgcaaagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagccagagccaaaacgcaaacgccccctgtgtcgcccgcacctcagccaaccgaggagaggctgccctcgagccccgtctatgaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcagaggacagcacctacgatgagtacgagaacgatctggggatcacagccgtcgccctgtacgactaccaggctgcgggcgatgatgagatctcatttgaccctgatgacatcatcaccaacatcgagatgattgacgacggctggtggcgcggggtgtgcaagggccggtacgggctcttcccagccaactatgtggagctgcggcagtagggcccccagcccccccccggagctgcgccctggatcctcacactacagatcaggccttctttggttcttgggtggttttgggttttttctgttttttttttttttttttttttttttttttgaaggtggggaggggaatatacacattgcttttatatttaatacttttgctgatgcttttgaaaatgtttatgccacagaatttgctaatatattgtaatcacattccttaggaggactttggtaattggttttatgcattgatggttttttttttcttttttgccaaattgactgtcacgcggcagcttcagggagctcgcattctcttgtgttcgtgttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtcttaactgtcacccatatggtccctgggccaccgggcagcctggggcggtgtgtgtgccatgtcacagcatggcctctcggccttgggaaggaaggcagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatcca

SEQ ID NO: 62162 - DNA, 2969 bp, Homo sapiens
  misc_feature (201)..(201): n is a, c, g, or t
  misc_feature (230)..(230): n is a, c, g, or t
cagtggaaaataacttttattgagaccccaccaactgcaaaatctgttcctggcattaagctccttcttcctttgcaattcggtctttcttcagtggtcccatggaggagaagaaagcattcatgggaccactgaagaaagaccgaattcaaaggaagaaggagcttaatgctttcgttctcctcgcatggtctggaagcnggcccctgcgtgctcgaattcggaaggcngtgctcgcaggtggactcggtccgtggcttcggaggcaagtttggtgtccagatggacagagttgatcagtctgctgtaggctttgaataccaggggaagactgagaagcatgcctcccagaaagactactccagtggttttggcggcaagtatggcgtgcaggccgaccgagtagacaagagcgcggtgggcttcgactaccagggcaagacggagaagcacgagtcacagagagattactccaaaggtttcggcggcaaatacggtatcgacaaggacaaagtggataagagcgccgttggctttgagtatcaaggcaaaacggagaagcacgagtcccagaaagactatgtgaaagggtttggaggaaaatttggtgtgcagacagacagacaagacaaatgtgcccttggctgggatcaccaggagaaattgcagctgcatgaatcccaaaaagattataagactggttttggaggcaaattcggtgttcagtcggagaggcaggactccgctgctgtggggtttgattacaaggagaagctggccaagcacgagtcccagcaagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagccagagccaaaacgcaaacgccccctgtgtcgcccgcacctcagccaaccgaggagaggctgccctcgagccccgtctatgaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcagaggacagcacctacgatgagtacgagaacgatctggggatcacagccgtcgccctgtacgactaccaggctgcgggcgatgatgagatctcatttgaccctgatgacatcatcaccaacatcgagatgattgacgacggctggtggcgcggggtgtgcaagggccggtacgggctcttcccagccaactatgtggagctgcggcagtagggcccccagcccccccccggagctgcgccctggatcctcacactacagatcaggccttctttggttcttgggtggttttgggttttttctgttttttttttttttttttttttttttttttgaaggtggggaggggaatatacacattgcttttatatttaatacttttgctgatgcttttgaaaatgtttatgccacagaatttgctaatatattgtaatcacattccttaggaggactttggtaattggttttatgcattgatggttttttttttcttttttgccaaattgactgtcacgcggcagcttcagggagctcgcattctcttgtgttcgtgttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtcttaactgtcacccatatggtccctgggccaccgggcagcctggggcggtgtgtgtgccatgtcacagcatggcctctcggccttgggaaggaaggcagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatcca

SEQ ID NO: 62163 - DNA, 3034 bp, Homo sapiens
  misc_feature (131)..(131): n is a, c, g, or t
catggccgggctagcgcttagccagctgcgtggctggacccccgggactcttgcgggccaagacgcgggaagaggcggggcagggggcggggtctgcgcggggacccggatgcggcccgaccgcgacctcnggaaccggaagtagagcctggtgcctgggagcggctggcgcggcggaatccagggccgacccgggccggaccgaccccaggcggcgacggaatcagtccccaatgcctggaaattcctcattggattactgtgttttaaacagaatttcgtgaacagccttttatctccaagcggaaagaaagatgtggaaagcttcagcaggccacgctgtgtccatcgcccaggatgacgcgggggccgatgactgggagaccgaccctgattttgtgaatgatgtgagtgagaaggagcaaagatggggtgccaagacggtgcagggctccgggcaccaggagcatatcaacatacacaagctgagggagaatgtctttcaagagcatcagacccttaaggagaaggaacttgaaacaggaccaaaagcttcccatggctatggagggaaatttggtgtggaacaagaccgaatggataagtcagctgtcggccacgaatatcagtcgaaactttccaagcactgctcgcaggtggactcggtccgtggcttcggaggcaagtttggtgtccagatggacagagttgatcagtctgctgtaggctttgaataccaggggaagactgagaagcatgcctcccagaaagactactccagtggttttggcggcaagtatggcgtgcaggccgaccgagtagacaagagcgcggtgggcttcgactaccagggcaagacggagaagcacgagtcacagagagattactccaaaggtttcggcggcaaatacggtatcgacaaggacaaagtggataagagcgccgttggctttgagtatcaaggcaaaacggagaagcacgagtcccagaaagactatgtgaaagggtttggaggaaaatttggtgtgcagacagacagacaagacaaatgtgcccttggctgggatcaccaggagaaattgcagctgcatgaatcccaaaaagattataagactggttttggaggcaaattcggtgttcagtcggagaggcaggactccgctgctgtggggtttgattacaaggagaagctggccaagcacgagtcccagcaagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagccagagccaaaacgcaaacgccccctgtgtcgcccgcacctcagccaaccgaggagaggctgccctcgagccccgtctatgaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcagaggacagcacctacgatgagtacgagaacgatctggggatcacagccgtcgccctgtacgactaccaggctgcgggcgatgatgagatctcatttgaccctgatgacatcatcaccaacatcgagatgattgacgacggctggtggcgcggggtgtgcaagggccgcttcagggagctcgcattctcttgtgttcgtgttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtcttaactgtcacccatatggtccctgggccaccgggcagcctggggcggtgtgtgtgccatgtcacagcatggcctctcggccttgggaaggaaggcagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatcca

SEQ ID NO: 62164 - DNA, 2549 bp, Homo sapiens
ttggggctccattcagtgacagcggagaagcacgagtcacagagagattactccaaaggtttcggcggcaaatacggtatcgacaaggacaaagtggataagagcgccgttggctttgagtatcaaggcaaaacggagaagcacgagtcccagaaagactatgtgaaagggtttggaggaaaatttggtgtgcagacagacagacaagacaaatgtgcccttggctgggatcaccaggagaaattgcagctgcatgaatcccaaaaagattataagactggttttggaggcaaattcggtgttcagtcggagaggcaggactccgctgctgtggggtttgattacaaggagaagctggccaagcacgagtcccagcaagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagccagagccaaaacgcaaacgccccctgtgtcgcccgcacctcagccaaccgaggagaggctgccctcgagccccgtctatgaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcagaggacagcacctacgatgagtacgagaacgatctggggatcacagccgtcgccctgtacgactaccaggctgcgggcgatgatgagatctcatttgaccctgatgacatcatcaccaacatcgagatgattgacgacggctggtggcgcggggtgtgcaagggccggtacgggctcttcccagccaactatgtggagctgcggcagtagggcccccagcccccccccggagctgcgccctggatcctcacactacagatcaggccttctttggttcttgggtggttttgggttttttctgttttttttttttttttttttttttttttttgaaggtggggaggggaatatacacattgcttttatatttaatacttttgctgatgcttttgaaaatgtttatgccacagaatttgctaatatattgtaatcacattccttaggaggactttggtaattggttttatgcattgatggttttttttttcttttttgccaaattgactgtcacgcggcagcttcagggagctcgcattctcttgtgttcgtgttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtcttaactgtcacccatatggtccctgggccaccgggcagcctggggcggtgtgtgtgccatgtcacagcatggcctctcggccttgggaaggaaggcagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatcca

SEQ ID NO: 62165 - DNA, 2893 bp, Homo sapiens
tattaagagccaccgcggggaacataaacaaacttctaaaaccatctcgcatacaggcagagtgaatgtctctttttcatgaaatgcccaacttgaaaacggcacatccagaaacacagctgctaaataggaactcgcagcttgagtgttatggcgctccagccccagcggcgttgcttatcgtggtggccacaccccgcacgtctgtgttgcccgtgtgagcctgtgctgtctcatggtgcgggtggaagccgcatgcgtgggagcttccatggggtcctgtctggcttagtcacgatgctgaggtcatagactaggttatttcctgccactctccaaggagggcctcttcatggatgttatctaaagtattaccaaagatccggaagggaagagtagattgagtgaatcatatgcgtttaactgtattgaaaacatactttccacctgtgacctgcactacccgatatatgtggttctggcctttcattgtgcatgtagactatgtgaaagggtttggaggaaaatttggtgtgcagacagacagacaagacaaatgtgcccttggctgggatcaccaggagaaattgcagctgcatgaatcccaaaaagattataagactggttttggaggcaaattcggtgttcagtcggagaggcaggactccgctgctgtggggtttgattacaaggagaagctggccaagcacgagtcccagcaagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagccagagccaaaacgcaaacgccccctgtgtcgcccgcacctcagccaaccgaggagaggctgccctcgagccccgtctatgaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcagaggacagcacctacgatgagtacgagaacgatctggggatcacagccgtcgccctgtacgactaccaggctgcgggcgatgatgagatctcatttgaccctgatgacatcatcaccaacatcgagatgattgacgacggctggtggcgcggggtgtgcaagggccggtacgggctcttcccagccaactatgtggagctgcggcagtagggcccccagcccccccccggagctgcgccctggatcctcacactacagatcaggccttctttggttcttgggtggttttgggttttttctgttttttttttttttttttttttttttttttgaaggtggggaggggaatatacacattgcttttatatttaatacttttgctgatgcttttgaaaatgtttatgccacagaatttgctaatatattgtaatcacattccttaggaggactttggtaattggttttatgcattgatggttttttttttcttttttgccaaattgactgtcacgcggcagcttcagggagctcgcattctcttgtgttcgtgttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtcttaactgtcacccatatggtccctgggccaccgggcagcctggggcggtgtgtgtgccatgtcacagcatggcctctcggccttgggaaggaaggcagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatcca

SEQ ID NO: 62166 - DNA, 2217 bp, Homo sapiens
agtgtgatcagctagagagaggttgcaggtgcatcactcgcagcaagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagccagagccaaaacgcaaacgccccctgtgtcgcccgcacctcagccaaccgaggagaggctgccctcgagccccgtctatgaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcagaggacagcacctacgatgagtacgagaacgatctggggatcacagccgtcgccctgtacgactaccaggctgcgggcgatgatgagatctcatttgaccctgatgacatcatcaccaacatcgagatgattgacgacggctggtggcgcggggtgtgcaagggccggtacgggctcttcccagccaactatgtggagctgcggcagtagggcccccagcccccccccggagctgcgccctggatcctcacactacagatcaggccttctttggttcttgggtggttttgggttttttctgttttttttttttttttttttttttttttttgaaggtggggaggggaatatacacattgcttttatatttaatacttttgctgatgcttttgaaaatgtttatgccacagaatttgctaatatattgtaatcacattccttaggaggactttggtaattggttttatgcattgatggttttttttttcttttttgccaaattgactgtcacgcggcagcttcagggagctcgcattctcttgtgttcgtgttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtcttaactgtcacccatatggtccctgggccaccgggcagcctggggcggtgtgtgtgccatgtcacagcatggcctctcggccttgggaaggaaggcagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatcca

SEQ ID NO: 62167 - DNA, 2177 bp, Homo sapiens
ctaccacagggcatggagaaaagagaaaagtgctctcctgacgcccatgtcctgtctctgcagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagccagagccaaaacgcaaacgccccctgtgtcgcccgcacctcagccaaccgaggagaggctgccctcgagccccgtctatgaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcagaggacagcacctacgatgagtacgagaacgatctggggatcacagccgtcgccctgtacgactaccaggctgcgggcgatgatgagatctcatttgaccctgatgacatcatcaccaacatcgagatgattgacgacggctggtggcgcggggtgtgcaagggccggtacgggctcttcccagccaactatgtggagctgcggcagtagggcccccagcccccccccggagctgcgccctggatcctcacactacagatcaggccttctttggttcttgggtggttttgggttttttctgttttttttttttttttttttttttttttttgaaggtggggaggggaatatacacattgcttttatatttaatacttttgctgatgcttttgaaaatgtttatgccacagaatttgctaatatattgtaatcacattccttaggaggactttggtaattggttttatgcattgatggttttttttttcttttttgccaaattgactgtcacgcggcagcttcagggagctcgcattctcttgtgttcgtgttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtcttaactgtcacccatatggtccctgggccaccgggcagcctggggcggtgtgtgtgccatgtcacagcatggcctctcggccttgggaaggaaggcagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatcca

SEQ ID NO: 62168 - DNA, 3331 bp, Homo sapiens
  misc_feature (131)..(131): n is a, c, g, or t
catggccgggctagcgcttagccagctgcgtggctggacccccgggactcttgcgggccaagacgcgggaagaggcggggcagggggcggggtctgcgcggggacccggatgcggcccgaccgcgacctcnggaaccggaagtagagcctggtgcctgggagcggctggcgcggcggaatccagggccgacccgggccggaccgaccccaggcggcgacggaatcagtccccaatgcctggaaattcctcattggattactgtgttttaaacagaatttcgtgaacagccttttatctccaagcggaaagaaagatgtggaaagcttcagcaggccacgctgtgtccatcgcccaggatgacgcgggggccgatgactgggagaccgaccctgattttgtgaatgatgtgagtgagaaggagcaaagatggggtgccaagacggtgcagggctccgggcaccaggagcatatcaacatacacaagctgagggagaatgtctttcaagagcatcagacccttaaggagaaggaacttgaaacaggaccaaaagcttcccatggctatggagggaaatttggtgtggaacaagaccgaatggataagtcagctgtcggccacgaatatcagtcgaaactttccaagcactgctcgcaggtggactcggtccgtggcttcggaggcaagtttggtgtccagatggacagagttgatcagtctgctgtaggctttgaataccaggggaagactgagaagcatgcctcccagaaagactactccagtggttttggcggcaagtatggcgtgcaggccgaccgagtagacaagagcgcggtgggcttcgactaccagggcaagacggagaagcacgagtcacagagagattactccaaaggtttcggcggcaaatacggtatcgacaaggacaaagtggataagagcgccgttggctttgagtatcaaggcaaaacggagaagcacgagtcccagaaagactatgtgaaagggtttggaggaaaatttggtgtgcagacagacagacaagacaaatgtgcccttggctgggatcaccaggagaaattgcagctgcatgaatcccaaaaagattataagactggttttggaggcaaattcggtgttcagtcggagaggcaggactccgctgctgtggggtttgattacaaggagaagctggccaagcacgagtcccagcaagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagccagagccaaaacgcaaacgccccctgtgtcgcccgcacctcagccaaccgaggagaggctgccctcgagccccgtctatgaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcagaggacagcacctacgatgagtacgagaacgatctggggatcacagccgtcgccctgtacgactaccaggctgcgggcgatgatgagatctcatttgaccctgatgacatcatcaccaacatcgagatgattgacgacggctggtggcgcggggtgtgcaagggccggtacgggctcttcccagccaactatgtggagctgcggcagtagggcccccagcccccccccggagctgcgccctggatcctcacactacagatcaggccttctttggttcttgggtggttttgggttttttctgttttttttttttttttttttttttttttttgaaggtggggaggggaatatacacattgcttttatatttaatacttttgctgatgcttttgaaaatgtttatgccacagaatttgctaatatattgtaatcacattccttaggaggactttggtaattggttttatgcattgatggttttttttttcttttttgccaaattgactgtcacgcggcagcttcagggagctcgcattctcttgtgttcgtgttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtcttaactgtcacccatatggtccctgggccaccgggcagcctggggcggtgtgtgtgccatgtcacagcatggcctctcggccttgggaaggaaggcagtgcctgctctgctgtgagccgccaggaaccctcctcctgtcaatgggggtgtagtatttttgccatgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatcca

SEQ ID NO: 62169 - DNA, 2497 bp, Homo sapiens
  misc_feature (131)..(131): n is a, c, g, or t
catggccgggctagcgcttagccagctgcgtggctggacccccgggactcttgcgggccaagacgcgggaagaggcggggcagggggcggggtctgcgcggggacccggatgcggcccgaccgcgacctcnggaaccggaagtagagcctggtgcctgggagcggctggcgcggcggaatccagggccgacccgggccggaccgaccccaggcggcgacggaatcagtccccaatgcctggaaattcctcattggattactgtgttttaaacagaatttcgtgaacagccttttatctccaagcggaaagaaagatgtggaaagcttcagcaggccacgctgtgtccatcgcccaggatgacgcgggggccgatgactgggagaccgaccctgattttgtgaatgatgtgagtgagaaggagcaaagatggggtgccaagacggtgcagggctccgggcaccaggagcatatcaacatacacaagctgagggagaatgtctttcaagagcatcagacccttaaggagaaggaacttgaaacaggaccaaaagcttcccatggctatggagggaaatttggtgtggaacaagaccgaatggataagtcagctgtcggccacgaatatcagtcgaaactttccaagcactgctcgcaggtggactcggtccgtggcttcggaggcaagtttggtgtccagatggacagagttgatcagtctgctgtaggctttgaataccaggggaagactgagaagcatgcctcccagaaagactactccagtggttttggcggcaagtatggcgtgcaggccgaccgagtagacaagagcgcggtgggcttcgactaccagggcaagacggagaagcacgagtcacagagagattactccaaaggtttcggcggcaaatacggtatcgacaaggacaaagtggataagagcgccgttggctttgagtatcaaggcaaaacggagaagcacgagtcccagaaagactatgtgaaagggtttggaggaaaatttggtgtgcagacagacagacaagacaaatgtgcccttggctgggatcaccaggagaaattgcagctgcatgaatcccaaaaagattataagactggttttggaggcaaattcggtgttcagtcggagaggcaggactccgctgctgtggggtttgattacaaggagaagctggccaagcacgagtcccagcaagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagccagagccaaaacgcaaacgccccctgtgtcgcccgcacctcagccaaccgaggagaggctgccctcgagccccgtctatgaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcagaggacagcacctacgatgagtacgagaacgatctggggatcacagccgtcgccctgtacgactaccaggctgcgggcgatgatgagatctcatttgaccctgatgacatcatcaccaacatcgagatgattgacgacggctggtggcgcggggtgtgcaagggccgcttcagggagctcgcattctcttgtgttcgtgttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatcca

SEQ ID NO: 62170 - DNA, 1553 bp, Homo sapiens
  misc_feature (131)..(131): n is a, c, g, or t
catggccgggctagcgcttagccagctgcgtggctggacccccgggactcttgcgggccaagacgcgggaagaggcggggcagggggcggggtctgcgcggggacccggatgcggcccgaccgcgacctcnggaaccggaagtagagcctggtgcctgggagcggctggcgcggcggaatccagggccgacccgggccggaccgaccccaggcggcgacggaatcagtccccaatgcctggaaattcctcattggattactgtgttttaaacagaatttcgtgaacagccttttatctccaagcggaaagaaagatgtggaaagcttcagcaggccacgctgtgtccatcgcccaggatgacgcgggggccgatgactgggagaccgaccctgattttgtgaatgatgtgagtgagaaggagcaaagatggggtgccaagacggtgcagggctccgggcaccaggagcatatcaacatacacaagctgagggagaatgtctttcaagagcatcagacccttaaggagaaggaacttgaaacaggaccaaaagcttcccatggctatggagggaaatttggtgtggaacaagaccgaatggataagtcagctgtcggccacgaatatcagtcgaaactttccaagcactgctcgcaggtggactcggtccgtggcttcggaggcaagtttggtgtccagatggacagagttgatcagtctgctgtaggctttgaataccaggggaagactgagaagcatgcctcccagaaagactactccagtggttttggcggcaagtatggcgtgcaggccgaccgagtagacaagagcgcggtgggcttcgactaccagggcaagacggagaagcacgagtcacagagagattactccaaaggtttcggcggcaaatacggtatcgacaaggacaaagtggataagagcgccgttggctttgagtatcaaggcaaaacggagaagcacgagtcccagaaagactatgtgaaagggtttggaggaaaatttggtgtgcagacagacagacaagacaaatgtgcccttggctgggatcaccaggagaaattgcagctgcatgaatcccaaaaagattataagactggttttggaggcaaattcggtgttcagtcggagaggcaggactccgctgctgtggggtttgattacaaggagaagctggccaagcacgagtcccagcaagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagcccgagcccaaaccacgcccctagaatggcccaaggggagcctctagatcaccaca

SEQ ID NO: 62171 - DNA, 1609 bp, Homo sapiens
  misc_feature (131)..(131): n is a, c, g, or t
catggccgggctagcgcttagccagctgcgtggctggacccccgggactcttgcgggccaagacgcgggaagaggcggggcagggggcggggtctgcgcggggacccggatgcggcccgaccgcgacctcnggaaccggaagtagagcctggtgcctgggagcggctggcgcggcggaatccagggccgacccgggccggaccgaccccaggcggcgacggaatcagtccccaatgcctggaaattcctcattggattactgtgttttaaacagaatttcgtgaacagccttttatctccaagcggaaagaaagatgtggaaagcttcagcaggccacgctgtgtccatcgcccaggatgacgcgggggccgatgactgggagaccgaccctgattttgtgaatgatgtgagtgagaaggagcaaagatggggtgccaagacggtgcagggctccgggcaccaggagcatatcaacatacacaagctgagggagaatgtctttcaagagcatcagacccttaaggagaaggaacttgaaacaggaccaaaagcttcccatggctatggagggaaatttggtgtggaacaagaccgaatggataagtcagctgtcggccacgaatatcagtcgaaactttccaagcactgctcgcaggtggactcggtccgtggcttcggaggcaagtttggtgtccagatggacagagttgatcagtctgctgtaggctttgaataccaggggaagactgagaagcatgcctcccagaaagactactccagtggttttggcggcaagtatggcgtgcaggccgaccgagtagacaagagcgcggtgggcttcgactaccagggcaagacggagaagcacgagtcacagagagattactccaaaggtttcggcggcaaatacggtatcgacaaggacaaagtggataagagcgccgttggctttgagtatcaaggcaaaacggagaagcacgagtcccagaaagactatgtgaaagggtttggaggaaaatttggtgtgcagacagacagacaagacaaatgtgcccttggctgggatcaccaggagaaattgcagctgcatgaatcccaaaaagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagacgaggagcatctcgtggagcggaggagcatctggcggagacgaggagcatctcgtggagaggaggagcatctcgtggagaggaggagcatctcgtggagcggaggagcatctggcacgagacgaggagtagtgtctggcggaggcgaggagtagtgtctggcagagacgaggagtagtgtctcgctgagacgcaggagtactgtctgccctattaccacgtcgctt

SEQ ID NO: 62172 - DNA, 2354 bp, Homo sapiens
  misc_feature (131)..(131): n is a, c, g, or t
catggccgggctagcgcttagccagctgcgtggctggacccccgggactcttgcgggccaagacgcgggaagaggcggggcagggggcggggtctgcgcggggacccggatgcggcccgaccgcgacctcnggaaccggaagtagagcctggtgcctgggagcggctggcgcggcggaatccagggccgacccgggccggaccgaccccaggcggcgacggaatcagtccccaatgcctggaaattcctcattggattactgtgttttaaacagaatttcgtgaacagccttttatctccaagcggaaagaaagatgtggaaagcttcagcaggccacgctgtgtccatcgcccaggatgacgcgggggccgatgactgggagaccgaccctgattttgtgaatgatgtgagtgagaaggagcaaagatggggtgccaagacggtgcagggctccgggcaccaggagcatatcaacatacacaagctgagggagaatgtctttcaagagcatcagacccttaaggagaaggaacttgaaacaggaccaaaagcttcccatggctatggagggaaatttggtgtggaacaagaccgaatggataagtcagctgtcggccacgaatatcagtcgaaactttccaagcactgctcgcaggtggactcggtccgtggcttcggaggcaagtttggtgtccagatggacagagttgatcagtctgctgtaggctttgaataccaggggaagactgagaagcatgcctcccagaaagactactccagtggttttggcggcaagtatggcgtgcaggccgaccgagtagacaagagcgcggtgggcttcgactaccagggcaagacggagaagcacgagtcacagagagattactccaaaggtttcggcggcaaatacggtatcgacaaggacaaagtggataagagcgccgttggctttgagtatcaaggcaaaacggagaagcacgagtcccagaaaggtgtcttccgttttatcttaccctccagccagcagctagtaatgtgacaggtggtagccacaccggaaaaggaaaaacaaagcgttattgatagcccttaacgtagatgtctctttttcatgaaatgcccaacttgaaaacggcacatccagaaacacagctgctaaataggaactcgcagcttgagtgttatggcgctccagccccagcggcgttgcttatcgtggtggccacaccccgcacgtctgtgttgcccgtgtgagcctgtgctgtctcatggtgcgggtggaagccgcatgcgtgggagcttccatggggtcctgtctggcttagtcacgatgctgaggtcatagactaggttatttcctgccactctccaaggagggcctcttcatggatgttatctaaagtattaccaaagatccggaagggaagagtagattgagtgaatcatatgcgtttaactgtattgaaaacatactttccacctgtgacctgcactacccgatatatgtggttctggcctttcattgtgcatgtagactatgtgaaagggtttggaggaaaatttggtgtgcagacagacagacaagacaaatgtgcccttggctgggatcaccaggagaaattgcagctgcatgaatcccaaaaagattataagactggttttggaggcaaattcggtgttcagtcggagaggcaggactccgctgctgtggggtttgattacaaggagaagctggccaagcacgagtcccagcaaggcacagttgccaccagcctcctaccctccccccgaccctcctgtgcggccacttctagcacagacttcagggctcaccgtcagcacctgcaacacagtcctcctgtgtcaccacttgtcagctgtcaggctgttcggcactttaaacccatttctagtagagcgacactgattttgagtggttcactttcttccctgtgaacttgtgatctgtgtatggcaggatgcgccagttagtgtgtgggtgccatctttctaacccggtgacccatccagtctctggactggggcatctccggtctccagcagcattctgcccgaggctgttctgctgttattggtgactgccgtgagccactgagtcaggccttccagatgaggagagaggtgttggttcaaccaaaccactggccatttgaccaggggcttcgtagcagcaagggccaggagacaggcgtgttctgtgtggtttctgtgtttcatttgtggtggtgtttttggccggggttgggaggttttttgtttgttctgtttgatgacaccatatgtgtgtaacatctccacacagagccacacagtatgtacgtgaagccagctc

SEQ ID NO: 62173 - DNA, 1064 bp, Homo sapiens
  misc_feature (131)..(131): n is a, c, g, or t
catggccgggctagcgcttagccagctgcgtggctggacccccgggactcttgcgggccaagacgcgggaagaggcggggcagggggcggggtctgcgcggggacccggatgcggcccgaccgcgacctcnggaaccggaagtagagcctggtgcctgggagcggctggcgcggcggaatccagggccgacccgggccggaccgaccccaggcggcgacggaatcagtccccaatgcctggaaattcctcattggattactgtgttttaaacagaatttcgtgaacagccttttatctccaagcggaaagaaagatgtggaaagcttcagcaggccacgctgtgtccatcgcccaggatgacgcgggggccgatgactgggagaccgaccctgattttgtgaatgatgtgagtgagaaggagcaaagatggggtgccaagacggtgcagggctccgggcaccaggagcatatcaacatacacaagctgagggagaatgtctttcaagagcatcagacccttaaggagaaggaacttgaaacaggaccaaaagcttcccatggctatggagggaaatttggtgtggaacaagaccgaatggataagtcagctgtcggccacgaatatcagtcgaaactttccaagcactgctcgcaggtggactcggtccgtggcttcggaggcaagtttggtgtccagatggacagagttgatcagtctgctgtaggctttgaataccaggggaagactgagaagcatgcctcccagaaagactactccagtggttttggcggcaagtatggcgtgcaggccgaccgagtagacaagagcgcggtgggcttcgactaccagggcaagacggagaagcacgagtcacagagagattactccaaaggtttcggcggcaaatacggtatcgacaaggacaaagtggataagagcgccgttggctttgagtatcaaggcaaaacggagaagcacgagtcccagaaagactatgtgatcgtggggttgtaacgtattgaattcaacacaccacaatactatgcacgcgtgtgtcgtgga

SEQ ID NO: 62174 - DNA, 385 bp, Homo sapiens
tgtaaaaccttacataccttcttaaatcatttaaaagctaatcctattacttggtttaatgaagttctatgaaatgtgtttgccagcagtgagaagtctttttctttcactagatgagtatttttttaaatgaaaagaggaaatgaaaaatgaggctattgactccccaggaacaggttgcgaactagcggtacctggggattttctaccttcttatctacctaatggaggcaattggcacattttaatgaacaactgcagagcagatgagaagacaggaaggatgttttccctagaaacatgaattgaacatgctggttgtttgaagtaatcaatgactagattttaaatcatataaaataaaatgctttacgttctattttct

SEQ ID NO: 62175 - DNA, 460 bp, Homo sapiens
tacacacacccctaaagttccatgtgctataacttgaacaactcctgtgcatgtcttttaattagcaagtgctagttaagggaaaataaagtgaaactgttaagacttaattaaaatgtgaattgatatggacattgaaatctggaactccacagccagttgttctgcctgtctttgcagtcctgaccaatgaaattaagaagaaaaagtacatcaggaagaaataatgggatgtatgtaatagagtttaaataaaacttaccaggttagaaaagcaaacaaaggtacagtatatctacaacaccttaaaattgctactgaagtttagatttacaagtcacagagtttcacttaatttctgcctgaatatgtgtgaacactcttgggccatgaatgccgaacaaggctttttccttcttcaattggttactacaatcaaagctgaccctcctccaacccc

SEQ ID NO: 62176 - DNA, 206 bp, Homo sapiens
gagaataatagttcccatctactgctctgttctgaaatccaaacctccactcacagctgacctatcgtaacctttgccagcccctcccatcagatgctaggaggcagtttgttctgcaagcttcccagcaaacaccaaaggcccaagcaccacttcaaagtgtcatttctctgtacagaacctctccaagcccagtcacaagccca

SEQ ID NO: 62177 - DNA, 466 bp, Homo sapiens
tggcttctaagggaccatacggtgaataaatgcattaaaatcaaatgggtaattatttctaatctgcatgatcatggatgtttttatggaggaggtaacattgggtttattttaagctgtggtagagttttcaattagccgtggcaagaaggatggcattccagctagagtcagcttggacccagtcggagaacagcaaggccccaaccgtatttgaggagaggtgagagatcaagttaattctaatgaagggattaggtaggaccatgtagttgaaaactcagacgaagaaataagtaaagacgaggttttggaagctcctttctctcgccaagtgtgtaataccaagtctccaaaacagaagatgacacagatcaaagctctattaacttaaggggcagagaatgcccaaggttagtggaatgctcacagagttcccacagtgagaaggttttgctcataatat

SEQ ID NO: 62178 - DNA, 441 bp, Homo sapiens
tgaaccacctcagcagaaagaaatgtaaattatttgcaagttctgcttgtgtctagctcagctcctgaaaacaaggatatatagctcagggagctgacttatgcccttcctcctactttagcacttagtacagagaaggactgttttatgatctgtttttccagatggataatgcagggccaagctgcaccatgttcctaagagaaagccaagaacataagtcacacaagccctcaggaagagaaggaaagaatgagtgacagtagaccgcagatgtgagcaaattcatggaggatggaaactgaatgagggaatggtggctggcttaacttaacagaggaaagtgcattctaaatacctatcataaaagcaacaaagagaataagcctatccactccacacgttggaactgcctgtttaaaagttgatccccggacccca

SEQ ID NO: 62179 - DNA, 550 bp, Homo sapiens
tcaacattatgtttgggtttcagcttccttgagcagggagcttgctcttgagagaagtgacttcagctgaggcatttcccgcagtgtggactgaaagctgagggttatttgctggcagtactcccagaacttgactggactcaaacatctggcctcaagtgatcctcctgctttggcctcctaaagtgttgagattacagacatgaatcaccgcactcagcctgagacatacttctttaattcctgtaacattattttatgctttgatacctgatggataatgcagggccaagctgcaccatgttcctaagagaaagccaagaacataagtcacacaagccctcaggaagagaaggaaagaatgagtgacagtagaccgcagatgtgagcaaattcatggaggatggaaactgaatgagggaatggtggctggcttaacttaacagaggaaagtgcattctaaatacctatcataaaagcaacaaagagaataagcctatccactccacacgttggaactgcctgtttaaaagttgatccccggacccca

SEQ ID NO: 62180 - DNA, 802 bp, Homo sapiens
gaattccccccccccccccccccccgggatgactccatgtgactggctcagggcttggcccacaggaactcctaacaaatctgaaccgaatcaagaaggtgtttcacccaggtgaaacctgcaacagcaggtggctgtccttgcaccctgtcccatccctcatcacggtgagggctcaacttcatgctcactaaagtttctcccagacagagagtgctgctcaaagccaacagggaggtgccgcgtgagggccatcactctgcattttgtccataaagacagccccgacttaccaggatccaacttaagatttctcaacccaaagggatatgaattcagtagaaaccaaccacacttcagtacagtgttgaataaataacaggagatcttcaacactttatcatgaataggctttgtgttagatgattttgcccaactagaggctaacataagtgttctgagcacgtttcagggaggctgagctgagatatgatgtttggtagttaggtgtattaaatgcttttttgacttacaatattttcaatttacagtgggtttctcaggacaaaccccactgcaagtcaggaagcatctgcattttcagcaggactgaaagatcaaatgcagggccattgtaagggcttgcttgcttctgtctgggtataaaaaggcatcaggctgggcgcagtggctcacacctgtaatcccagcactttaggccaaggcgggcagaccagctgaggtcaggagctcaagaccagcctggccaacatggtgaaactccgtctctactagaaataca

SEQ ID NO: 62181 - DNA, 1068 bp, Homo sapiens
ctggcccaccccggcaccatcccggcaagggtctgagtggcagggcctgaacccactgcacagccagacttcggaaggctcggcccagaccccagaccttccccgcccctgagggatctggtggccccacaccttggcgagacaacgttcatggaacccagaggtgtttctactgcggggcagcttggggccagggccctgctctgctgtatgccagcctggtggccagggcaagccccgtgggctctgggagcctcaggggaggggcactcagcagggccatcaggaagagggatgactccatgtgactggctcagggcttggcccacaggaactcctaacaaatctgaaccgaatcaagaaggtgtttcacccaggtgaaacctgcaacagcaggtggctgtccttgcaccctgtcccatccctcatcacggtgagggctcaacttcatgctcactaaagtttctcccagacagagagtgctgctcaaagccaacagggaggtgccgcgtgagggccatcactctgcattttgtccataaagacagccccgacttaccaggatccaacttaagatttctcaacccaaagggatatgaattcagtagaaaccaaccacacttcagtacagtgttgaataaataacaggagatcttcaacactttatcatgaataggctttgtgttagatgattttgcccaactagaggctaacataagtgttctgagcacgtttcagggaggctgagctgagatatgatgtttggtagttaggtgtattaaatgcttttttgacttacaatattttcaatttacagtgggtttctcaggacaaaccccactgcaagtcaggaagcatctgcattttcagcaggactgaaagatcaaatgcagggccattgtaagggcttgcttgcttctgtctgggtataaaaaggcatcaggctgggcgcagtggctcacacctgtaatcccagcactttaggccaaggcgggcagaccagctgaggtcaggagctcaagaccagcctggccaacatggtgaaactccgtctctactagaaataca

SEQ ID NO: 62182 - DNA, 454 bp, Homo sapiens
caacaacaaaaacagatgagctcaaacctgagaaaacctggaatctgcccaaatcaagccgtttatagcttcgaggtattaaacagccactaggacagttgatgaatttgatggagtcagtggcatttcacaagccttcacaggcacggggtcatgaaaggtgcatgggaggatccggaccctttgcgcccagcatgctttgcttgcgatcacctccacatcgcccttcggaggaaagcggcagctggtcaggctcctctgagacctttcaggagagccctgagaggtgaggtgaggacgaatgataaggaactgaggccaccgtgagcaagaagatatagatggcaggaacagtaagggctgttcattttacttgttggggtttgtcccctacttgttctggtatttacatagtttcacgtctctataaatctgataagaaagtgcaaaaaaa

SEQ ID NO: 62183 - DNA, 221 bp, Homo sapiens
tactgtacattccaacttttttgaaataattaagtagaagtcggccagtgcggtggctcacgcctataatcccagctacttgggaggctgaggcacaattgcttgaacccgggaggcggaggttgcagtgagtcgagatcacaccactgcactccagccttggcgatagagggagactccatctcaaaaaaataaaataaaataaaaataaataagattta

SEQ ID NO: 62184 - DNA, 229 bp, Homo sapiens
cttaacaatgttaatgcttccaatccatgagcatggagtgtctttccatatatttgtgtcttctgcaatttcttttagtaatgtttttggctttcactgtacaagtcttttgcctccttggttaaccttattcttaagcatattattatttttggtgctattagaaatggaacagttttaatttccttttcaaatcattcgttgttagttatataaaattcagaaattc

SEQ ID NO: 62185 - DNA, 399 bp, Homo sapiens
ggcatgtaaatattgcaaataaataaattgatttatctcaaaaatctgggaaatggttgtctacattaacaatgataggaaagaactgaaaaggcctagctgggaccctttaacactactactgctgctttctttgaatatcctcagagacaaattcattatgggaagctgtcaaaatcatttagaaccaagtctgatatattgggatcagaatgaatgcttgactttattgaaaaagagaagcataaaaaatcattttaagtaaataatctatgtctgattgaaaacaacgtggatttctctagctgacagattccatcttctatatacatacttgttaactttcgtgttcacatctttattatcttttaatttttgcttttctatcatagaaagatc

SEQ ID NO: 62186 - DNA, 199 bp, Homo sapiens
acctctgcattaacactccagcacctttggttagccaatttggccttatttgtgtctccaccattggattatctgtccatcaaggtcaggaatgttttcgggttaccccactgtccccaactttgaatatgttcactgcctggaaaatgtttatctgaatataaggcatcaagccagaacttgcccaaaacttaaccta

SEQ ID NO: 62187 - DNA, 383 bp, Homo sapiens
atgtttggatatatttgactattccgatcatgaaaacagaaattaccctgcctactacaaggacagactgatgggaaattatgcacctggtcaacttagcttttaagcagacgatgctgtaaaaactaacggcttctctgatatttattgtaagttttagtactgatctccttttccagtgctgcacactcctgtgtttggaactttaatagctttgcaacgaaatcctatatccggtttcctataatttaactgaagaaaaacacatccaaataaaggtctatattaacagaccagatagcatcagaaatcatgtgactattatgattatcagaatatgtcttaactttttagggcaaaattaacactgaaagttctagctt

SEQ ID NO: 62188 - DNA, 1925 bp, Homo sapiens
tgcagagaagaggaggttggtgtggagcacaggcagcaccgagcctgccccgtgagctgagggcctgcagtctgcggctggaatcaggatagacaccaaggcaggacccccagagatgctgaagcctctttggaaagcagcagtggcccccacatggccatgctccatgccgccccgccgcccgtgggacagagaggctggcacgttgcaggtcctgggagcgctggctgtgctgtggctgggctccgtggctcttatctgcctcctgtggcaagtgccccgtcctcccacctggggccaggtgcagcccaaggacgtgcccaggtcctgggagcatggctccagcccagcttgggagcccctggaagcagaggccaggcagcagagggactcctgccagcttgtccttgtggaaagcatcccccaggacctgccatctgcagccggcagcccctctgcccagcctctgggccaggcctggctgcagctgctggacactgcccaggagagcgtccacgtggcttcatactactggtccctcacagggcctgacatcggggtcaacgactcgtcttcccagctgggagaggctcttctgcagaagctgcagcagctgctgggcaggaacatttccctggctgtggccaccagcagcccgacactggccaggacatccaccgacctgcaggttctggctgcccgaggtgcccatgtacgacaggtgcccatggggcggctcaccaggggtgttttgcactccaaattctgggttgtggatggacggcacatatacatgggcagtgccaacatggactggcggtctctgacgcaggtgaaggagcttggcgctgtcatctataactgcagccacctggcccaagacctggagaagaccttccagacctactgggtactgggggtgcccaaggctgtcctccccaaaacctggcctcagaacttctcatctcacttcaaccgtttccagcccttccacggcctctttgatggggtgcccaccactgcctacttctcagcgtcgccaccagcactctgtccccagggccgcacccgggacctggaggcgctgctggcggtgatggggagcgcccaggagttcatctatgcctccgtgatggagtatttccccaccacgcgcttcagccaccccccgaggtactggccggtgctggacaacgcgctgcgggcggcagccttcggcaagggcgtgcgcgtgcgcctgctggtcggctgcggactcaacacggaccccaccatgttcccctacctgcggtccctgcaggcgctcagcaaccccgcggccaacgtctctgtggacgtgaaagtcttcatcgtgccggtggggaaccattccaacatcccattcagcagggtgaaccacagcaagttcatggtcacggagaaggcagcctacataggcacctccaactggtcggaggattacttcagcagcacggcgggggtgggcttggtggtcacccagagccctggcgcgcagcccgcgggggccacggtgcaggagcagctgcggcagctctttgagcgggactggagttcgcgctacgccgtcggcctggacggacaggctccgggccaggactgcgtttggcagggctgaggggggcctctttttctctcggcgaccccgccccgcacgcgccctcccctctgaccccggcctgggcttcagccgcttcctcccgcaagcagcccgggtccgcactgcgccaggagccgcctgcgaccgcccgggcgtcgcaaaccgcccgcctgctctctgatttccgagtccagccccccctgagccccacctcctccagggagccctccaggaagccccttccctgactcctggcccacaggccaggcctaaaaaaaactcgtggcttcaaaaaaaaacctctgtg

SEQ ID NO: 62189 - DNA, 2006 bp, Homo sapiens
tgcagagaagaggaggttggtgtggagcacaggcagcaccgagcctgccccgtgagctgagggcctgcagtctgcggctggaatcaggatagacaccaaggcaggacccccagagatgctgaagcctctttggaaagcagcagtggcccccacatggccatgctccatgccgccccgccgcccgtgggacagagaggctggcacgttgcaggtcctgggagcgctggctgtgctgtggctgggctccgtggctcttatctgcctcctgtggcaagtgccccgtcctcccacctggggccaggtgcagcccaaggacgtgcccaggtcctgggagcatggctccagcccagcttgggagcccctggaagcagaggccaggcagcagagggactcctgccagcttgtccttgtggaaagcatcccccaggacctgccatctgcagccggcagcccctctgcccagcctctgggccaggcctggctgcagctgctggacactgcccaggagagcgtccacgtggcttcatactactggtccctcacagggcctgacatcggggtcaacgactcgtcttcccagctgggagaggctcttctgcagaagctgcagcagctgctgggcaggaacatttccctggctgtggccaccagcagcccgacactggccaggacatccaccgacctgcaggttctggctgcccgaggtgcccatgtacgacaggtgcccatggggcggctcaccaggggtgttttgcactccaaattctgggttgtggatggacggcacatatacatgggcagtgccaacatggactggcggtctctgacgcaggtgaaggagcttggcgctgtcatctataactgcagccacctggcccaagacctggagaagaccttccagacctactgggtactgggggtgcccaaggctgtcctccccaaaacctggcctcagaacttctcatctcacttcaaccgtttccagcccttccacggcctctttgatggggtgcccaccactgcctacttctcagcgtcgccaccagcactctgtccccagggccgcacccgggacctggaggcgctgctggcggtgatggggagcgcccaggagttcatctatgcctccgtgatggagtatttccccaccacgcgcttcagccaccccccgaggtactggccggtgctggacaacgcgctgcgggcggcagccttcggcaagggcgtgcgcgtgcgcctgctggtcggctgcggactcaacacggaccccaccatgttcccctacctgcggtccctgcaggcgctcagcaaccccgcggccaacgtctctgtggacgtggtgagggcgtgctcccggccgggcgtgggaaaggcggccctcctgccgcccttcctgacgcgctgcctctgctcccctaagaaagtcttcatcgtgccggtggggaaccattccaacatcccattcagcagggtgaaccacagcaagttcatggtcacggagaaggcagcctacataggcacctccaactggtcggaggattacttcagcagcacggcgggggtgggcttggtggtcacccagagccctggcgcgcagcccgcgggggccacggtgcaggagcagctgcggcagctctttgagcgggactggagttcgcgctacgccgtcggcctggacggacaggctccgggccaggactgcgtttggcagggctgaggggggcctctttttctctcggcgaccccgccccgcacgcgccctcccctctgaccccggcctgggcttcagccgcttcctcccgcaagcagcccgggtccgcactgcgccaggagccgcctgcgaccgcccgggcgtcgcaaaccgcccgcctgctctctgatttccgagtccagccccccctgagccccacctcctccagggagccctccaggaagccccttccctgactcctggcccacaggccaggcctaaaaaaaactcgtggcttcaaaaaaaaacctctgtg

SEQ ID NO: 62190 - DNA, 377 bp, Homo sapiens
ggagtggggtgtagatttttcctggaggtgaaggttctcagccctaccctctagcccgcccacccagctccagccgtctgtttctgtctcggatgagagggggcctctcaggacaaagaggaagtagctggaaggggaaggagccagctgcagagaggaggaggtgagctgcagagaagaggaggttggtgtggagcacaggcagcaccgagcctgccccgtgagctgagggcctgcagtctgcggctggaatcaggatagacaccaaggcaggacccccagaggtatgtgccaatgaggccagggcagctgagaaaagccaggcatggggaaagggctgctgtctgcctccctatggcctcagcctcccagcaacc

SEQ ID NO: 62191 - DNA, 697 bp, Homo sapiens
tgcagagaagaggaggttggtgtggagcacaggcagcaccgagcctgccccgtgagctgagggcctgcagtctgcggctggaatcaggatagacaccaaggcaggacccccagagatgctgaagcctctttggaaagcagcagtggcccccacatggccatgctccatgccgccccgccgcccgtgggacagagaggctggcacgttgcaggtcctgggagcgctggctgtgctgtggctgggctccgtggctcttatctgcctcctgtggcaagtgccccgtcctcccacctggggccaggtgcagcccaaggacgtgcccaggtcctgggagcatggctccagcccagcttgggagcccctggaagcagaggccaggcagcagagggactcctgccagcttgtccttgtggaaagcatcccccaggacctgccatctgcagccggcagcccctctgcccagcctctgggccaggcctggctgcagctgctggacactgcccaggagagcgtccacgtggcttcatactactggtccctcacagggcctgacatcggggtcaacgactcgtcttcccagctggtgcgccccgccctggccccaccgcatcctggtgctggaaacacagcaagtcaggctgcctatctatgcaggcgtctcgggcaccaggcccgggggctcagcttggtggtaggg

SEQ ID NO: 62192 - DNA, 403 bp, Homo sapiens
  misc_feature (299)..(299): n is a, c, g, or t
  misc_feature (310)..(310): n is a, c, g, or t
  misc_feature (332)..(332): n is a, c, g, or t
  misc_feature (371)..(371): n is a, c, g, or t
tcccggaggcccaagaaggtctgcatcgtgaaggtggtggggacacggaacctgtggaagaacattgtggtcctgtgtgtgaactcgctgacggggtacgggatccaccactgctttgccaggagcatgatgggccgttagaaacatttctttgttctggaaacaaagtactgttgaaaccagcttggaattttttttttttttttttttttcaaaaaggcaactttttttttttcttggcatcaatgaatatgcacttcagaaatctacagagaacttttttcacttttgtatttgtnccacagcattntagccaggagtacaaaataggngctcttcaagcagcacatgaagatggcccaggagccttnaagccatccagagcagcagagcagcacctaaa

SEQ ID NO: 62193 - DNA, 578 bp, Homo sapiens
gagggggagcggctgtgtggatgtcggagaagccgcgggcgagatcacctcttaggcagagcagtgggcgcagatgccatggcgggaagcaggcctttctgaattcttagcagcgatctccaggggcactctaaccttgcaagaaagaggctgccagtcttgcatcagatgcagaaaccagggcgcagagtagcctgcccctcctgtgacttccccgtctcgggaaatggcaccatcatcatctacctggtggctccggccagaaaacagggaggcatctttggatcatctcaccctcaccacccacacccgggccaccaccaagactcttcaattctacctccaaaataaatccctaccccacttccctctgttctcgttgccacccctgtgtcaagccatcaccagcttggccctggaggccagcacagcctccttcccgcctccctgcctcctctctacccccaacagccagaataacttgcagaaaatgtaaatcaggccccatctcattctccttcttaaaccgcccctttccccaagggcttcctattgcatttgcaccaaaatcgacaccc

SEQ ID NO: 62194 - DNA, 457 bp, Homo sapiens
agtgctgacagattgggtgtctccggtgcgccggcggctgccgcttaagtagcttcctgtcagggagtcaggggtcacctcatccccgctctgttcaaaacagtactgacctcttcggggtgcctcccacgcctgtctactgcacgagcatgtgtttagtgtcaactctgcgatccagaggaggccagccctgcccaccccacagcccccagaggctgccaggcgccaatatggggtaactcagcgccccctcccttgccattggttgacgatgcctggaatcccaccatcagagctttgttaaggttgctgtgggatgggtggcagggaggcagcaaaagacaagaaggtggtggggacctctggcttgtggatttcataatcagacctttatggtgggcttgggtaggagatcaggcaatactaaataataataaaaacaaatttcacacttgct

SEQ ID NO: 62195 - DNA, 567 bp, Homo sapiens
gagggggagcggctgtgtggatgtcggagaagccgcgggcgagatcacctcttaggcagagcagtgggcgcagatgccatggcgggaagcaggcctttctgaattcttagcagcgatctccaggggcactctaaccttgcaagaaagaggctgccagtcttgcatcagatgcagaaaccagggcgcagagtaggagctagagcatcttggatggagaaacctcggcaaagacaaaggcccattgtcccccttccccggccttctgccagctccctccccagtcaccagaggaggccagccctgcccaccccacagcccccagaggctgccaggcgccaatatggggtaactcagcgccccctcccttgccattggttgacgatgcctggaatcccaccatcagagctttgttaaggttgctgtgggatgggtggcagggaggcagcaaaagacaagaaggtggtggggacctctggcttgtggatttcataatcagacctttatggtgggcttgggtaggagatcaggcaatactaaataataataaaaacaaatttcacacttgct

SEQ ID NO: 62196 - DNA, 286 bp, Homo sapiens
ccttggtgtcctcttgtcttctttccttgtgtgacttggttttccagtctgtgaaatgcggtgggtgcatccaactccaagcctgtctctgccctgggtcctggagcctggaggacgaatgaggtcatgtttttctaggagctagagcatcttggatggagaaacctcggcaaagacaaaggcccattgtcccccttccccggccttctgccagctccctccccagtcaccagaggaggccagccctgcccaccccacagcccccagaggctgccaggcgccaata

SEQ ID NO: 62197 - DNA, 389 bp, Homo sapiens
cgtatgtatcttttatttacactgcacaccttgcagcatccttaccttgcagagtactgagtcctggcttcatgaatttcatgtcaagtaaatgggttttagtcatccctagttcatgtgcatgtgccgagaaaaaggggagcttctaaaacatgtgcgcaaaccacaggaaacagtgcaatcctgtgtgtctcctattccacttactcctcaaggccccaaggtaggacgcatgtttggtggctttctggcttacaagttccagtgcctactcccattccctcagaggtttgctgtgatcactgagggaagcagaatggagcatcgtgtggtccttactggagactccttgcagcacctgaaacaacccaatgttgttagaggcaaat

SEQ ID NO: 62198 - DNA, 219 bp, Homo sapiens
taatgttgttaatactgtccttggtgctagacttccctgaatgtgaataagacaaggtttttttttaaaaaaatgatttatattatatcatttattctctttgtctaattggcatttgtaaggttgtagttatattgtcttcaagtattcatgtagattttggaggaggaagtataaaggaagtgaaaaagagtttggttgtcaggacaaacaaggagc

SEQ ID NO: 62199 - DNA, 1586 bp, Homo sapiens
aaggtgggcctggaagataacagctagtaggctaaggtcagacactgacacttgcagttgtctttggtagttttttgcactaacttcaggaaccagctcatgatctcaggatgtatggaaaaataatctttgtattactattgtcagcaattgtgagcatatcagcatcaagtaccactggtgtggcaatgcacacttcaacctcttcttcagtcacaaagagttacatctcatcacagacaaatgatacgcacaaacgggacacatatgcagccactcctagagctcatgaagtttcagaaatttctgttagaactgtttaccctccagaagaggaaaccggagaaagggtacaacttgcccatcatttctctgaaccagagataacactcattatttttggggtgatggctggtgttattggaacgatcctcttaatttcttacggtattcgccgactgataaagaaaagcccatctgatgtaaaacctctcccctcacctgacacagacgtgcctttaagttctgttgaaatagaaaatccagagacaagtgatcaatgagaatctgttcaccaaaccaaatgtggaaagaacacaaagaagacataagacttcagtcaagtgaaaaattaacatgtggactggacactccaataaattatatacctgcctaagttgtacaatttcagaatgcaattttcattataatgagttccagtgactcaatgatggggaaaaaaatctctgctcattaatatttcaagataaagaacaaatgtttccttgaatgcttgcttttgtgtgttagcataatttttagaattgtttgagaattctgatccaaaactttagttgaattcatctacgtttgtttaatattaacttaacctattctattgtattataatgatgattctgtcaaatgaaaggcttgaaatacctagatgaagtttagattttcttcctattgtaaacttttgagtctggtttcattgttttaaataaattaaggggacactaaagtcctatcattcatttccttcattgctgaacaggcaagatataatattacatgaatgattactatattttgttcacactaataaagcttatgctcagaaatgccatacacacacacaaacacacacatttatcatttaatgcataaatcaacacaaaaggttttcccattaatatgaaatattacatatatataagtgccatatttaaaataatttgtctaacagtagaactatgtcggagcactcactgaagcttgcattccactgaaagagttatttgtgtaagtagagtatccggagaaggaaaagaacttacgacctttctttataacagaaactcaactctaaattcaacaagatgtgcaaaccggacatgcaggtgaatattttaataggttactataaggttctcaattaaattctttaatctgtccagtcccagtttctcttattaataaaactttggaaattgctttaaaccatttaaaggaaatttctagatatagaaactaaggactgtgactatacagctgtcactcatttgtagtaaaacttaaaaagc

SEQ ID NO: 62200 - DNA, 1627 bp, Homo sapiens
gaataatctaagcctgaaatagttgagcaattgtgagcatatcagcatcaagtaccactggtgtggcaatgcacacttcaacctcttcttcagtcacaaagagttacatctcatcacagacaaatgggataacactcattaattggtgggcgatggctcgtgttatttttgaggtgatgcttgttgttgttggaatgatcatcttaatttcttactgtattcgatgactgataaaggttttcatgcctctgggattgagattagaggaagaaagcaaagaaaggacatttttttacttcactgttcatggtgtaattgtgtgcctgacggctgtagctactaacttggcttacgttgactggctactaagggactctaggagtcagaaactaaatgctgagtctctcaaaggcgtagagagaatttcagagggccttaccatgacatgaggattaaactccagttctgcccgattctcatcacgaaatccttatcccatgcctcattgtgtttggtgtccccttgcctaggggacagtcctcctgggtaagatcagcaagataactcttcagtcacattccatttgatactttgaatactctggggtccttacccaccaaatggatggaattcagctgctcaatcactgcctttctcagaactcggttgtccaaccacaattccctttcccttaggatagggctatattggcaaaatgccgcccgaacagactgctgacagtaaaccaaatattagtttctctcaccttcttgaaggcatttacagtctttgtaagcttttctcctagattttccctttcctgttcctgcttagattctaagaatgaagtgcatccttctccttttcttcattaggtgaagtgggatttacccattaccatatattcaccaccaggtcactgacgagagactccagtgaatcgctttccctctgcattcctctccttgtacagactagagggtcacattgtgtaaagcctaacatagccctgcaaagagatctggccccagcagtgaacacaaactcagtaattctctttagagtgaggtggtaatcagtgcctcttggtttcagccgtggtcctagtggctacttatggaagaataggaatagtttcacaacatcctgtaacattggcttacctgtatattatatgccacccgtaaccataaaaacaccaggatttaggttccttgaaggtaatgactatgggtccctctctgtggaagaatactgaatagaagagagaaatcactcaatatgtggaatgactgatatggtttggctgtgttcccactcaaatctcatcttgaattgtagttccaataatccccacatgtcatgggaggaacccagtgggaggtacttgaatcattgcggtggtttcccctgtgctattctcatgatagtgagtaaattctcacataatctgatagttttataaaggagcttcccccttcactcagctctcattcttctccttcctgccactatgtaagaaagatgtgtttgtttcccctttggtcatgattgtaagtatcctgagaccttcccagccatgcaaaactgtagatcaataaaacctctttcctttataaattacaca

SEQ ID NO: 62201 - DNA, 523 bp, Homo sapiens
ggatattgaggaaatattaagattcttcttatagtatttaacctattagtgtaaaaaatatttaaaataatatatttacatatgtttaaaacttggcctccaaagtgctgggattacaggtgtgagccactgcgcccggccctaattagggtttttataaaaccaaaagaacttggcaacacccctaggtaccctttagaagcctccaattggctacagcctgtgaaggattggcctgtgaccaatcagaggctgaagtggagtcttagctcatgggtcaagcagaggctgaagtggaaacttcttgtctttttatcacaggcatgaggatgtggcctgcatgctgcctgatcttgcctagaaccggctgcacctgctgttctcttgtttatgcaaactggctgcacctgctattcctttgcttatgcccctacccctggctatcctaattccctgttctcctgcctcactattactgtattctctacttctaaataaaaataaaacaaaatacaaaccgttt

SEQ ID NO: 62202 - DNA, 426 bp, Homo sapiens
ctatttggagaattcatatggcaatcgtttataaacacatgatggaatcaggtggcaggccaagttaaagagcaaggccagaaaagaacttaaaagagaagagaaaacatagacagtttaggaacaatagatcatgtcttctccatgatttggaggtaaactgattacctatcagctgataaatagagaaaggttttagaactcttcccttgagtagactaatgagaggtgtcagagaagatgttttctgttatttgtgtgctctccaggaaactttgagcattcagctgaggggccaagttggctgcctctgagaagaagcccttccacctccactccactgcacttgggtgccattcccctcatttgaatgtctccaagagatgagcaaaggtacatctacagagttcagggtattgagctcat

SEQ ID NO: 62203 - DNA, 900 bp, Homo sapiens
  misc_feature (1)..(1): n is a, c, g, or t
  misc_feature (13)..(13): n is a, c, g, or t
  misc_feature (29)..(29): n is a, c, g, or t
nttccccgggcantgcagcaacggcagantatgctggtctgaaagtagcacgacggcaaatgcgggatgctgctggccgtcgacattttcatgcgtctcagtgccctaggcccacaagtcccgtgtctacagacagcaacatgagtgccgccgtaatgcagaaaaccagaccagccaagaaactgaaacaccagccaggacatctgcgcagagaaacctacacagatgatcttccaccacctcctgtgccgccacctgctataaagtcacctactgcccaatccaagacacagctggaagtacgacctgtagtggtgccaaaactcccttctatggatgcaagaacagacaaatggagaaacgggacaacttgtccatcgtttcactgtaccaggtatgttaatatttgacaaagaataaaagtcattccattttaaactatccattgcttgtttcaaatgcctaagaaaatgtgtctatcttaaaacagaagagcatatgttgttaactttattcacacgaaattgtaaagacaaagaaaatattctctttttaaaattaaaataggcatttcttatttttaaaaacattttgggggccaggggccgtggctcatgcctataatccctataattttgggaggccaagcctggctaatcacttgagcccaggaatttgagaacagcctgggcaatatggcaaaatctatctctacaaaaaatacaaaaattagctgggatggggcatgcacctgtagtctcaactgcttgggaggctggctgaggtgggaggatcggatccattgcctgagcctgggagtttgaggctgcagtgagctatgactgtgccactgtactctagccttggtaagaccctgtctcaaaaacaaatacataagta

SEQ ID NO: 62204 - DNA, 2614 bp, Homo sapiens
  misc_feature (1667)..(1668): n is a, c, g, or t
ccccccgggggggggggtatccctttttttggggggcatagttttttgcactaacttcaggaaccagctcatgatctcaggatgtatggaaaaataatctttgtattactattgtcagcaattgtgagcatatcagcatcaagtaccactggtgtggcaatgcacacttcaacctcttcttcagtcacaaagagttacatctcatcacagacaaatgatacgcacaaacgggacacatatgcagccactcctagagctcatgaagtttcagaaatttctgttagaactgtttaccctccagaagaggaaaccggagaaagggtacaacttgcccatcatttctctgaaccagagataacactcattatttttggggtgatggctggtgttattggaacgatcctcttaatttcttacggtattcgccgactgataaagaaaagcccatctgatgtaaaacctctcccctcacctgacacagacgtgcctttaagttctgttgaaatagaaaatccagagacaagtgatcaatgagaatctgttcaccaaaccaaatgtggaaagaacacaaagaagacataagacttcagtcaagtgaaaaattaacatgtggactggacactccaataaattatatacctgcctaagttgtacaatttcagaatgcaattttcattataatgagttccagtgactcaatgatggggaaaaaaatctctgctcattaatatttcaagataaagaacaaatgtttccttgaatgcttgcttttgtgtgttagcataatttttagaattgtttgagaattctgatccaaaactttagttgaattcatctacgtttgtttaatattaacttaacctattctattgtattataatgatgattctgtcaaatgaaaggcttgaaatacctagatgaagtttagattttcttcctattgtaaacttttgagtctggtttcattgttttaaataaattaaggggacactaaagtcctatcattcatttccttcattgctgaacaggcaagatataatattacatgaatgattactatattttgttcacactaataaagcttatgctcagaaatgccatacacacacacaaacacacacatttatcatttaatgcataaatcaacacaaaaggttttcccattaatatgaaatattacatatatataagtgccatatttaaaataatttgtctaacagtagaactatgtcggagcactcactgaagcttgcattccactgaaagagttatttgtgtaagtagagtatccggagaaggaaaagaacttacgacctttctttataacagaaactcaactctaaattcaacaagatgtgcaaaccggacatgcaggtgaatattttaataggttactataaggttctcaattaaattctttaatctgtccagtcccagtttctcttattaataaaactttggaaattgctttaaaccatttaaaggaaatttctagatatagaaactaaggactgtgactatacagctgtcactcatttgtagtaaaacttaaaaagcaaaaacaaaaaacaaaaaagaccttcctgtgatactttatttccgaactaataaaaatctatatgactttttattattgtgtgataaccaagtaaatgttttctattttnnatattttcaggcatggtaacagaaatttaccttttaataaattaaaaaatctaaattttaacctacttgtatgttcggagagtgtttttgtactatattgactacttaaaatagagaatgagactaagaagggaacatttctgttgatacatgttttttaaaagtaatttttaagagcattattaggttaatttaatccaattaatgacccaaatgccaaggtaattttaaatttacatttttaataaaagcaacatgttgaaacaagagagggtgagattaacctttttgctaaagtaatttacaagtcaaagacaggaagagatcagagtgaatgtgccttcttaaccagagctacagaatttagtgaataattaaagtacaaactgctttgacctccttgaacttttccaagcaatttctctgtacttctatatatgaatgtcttagccaattttctgctactataacagaatacgacagactgggtaatttaaaaagaaaagaaatttattttcttcctagttctggaggctgggaaggcgaagggcatggcactgacatctgccttgtaactgatgagaaccttcttactgcatgataacaaagcagcaaggcaagcaaaagcgtaagatgaagagagaggaaatgaagccaaacacatcctttcatcagaagcccattccctctataaggcgttactacatttatgagaatggagtcctcatgacctaatcgtgaccttaaaggcccctcccaacactgttacaatggcaattaaatttcaacaaaggttccagaggtgacattcgaatcagcaatgaaattttcatagttaaatttggtattcgtgggggaagaaatgaccatttcccttgtatttttataattaaatcagcaaaatattgtaataaagaaatctttcctgtgaagataccatgacccc

SEQ ID NO: 62205 - DNA, 582 bp, Homo sapiens
aaggtgggcctggaagataacagctagtaggctaaggtcagacactgacacttgcagttgtctttggtagttttttgcactaacttcaggaaccagctcatgatctcaggatgtatggaaaaataatctttgtattactattgtcagaaattgtgagcatatcagcattaagtaccactgaggtggcaatgcacacttcaacctcttcttcagtcacaaagagttacatctcatcacagacaaatggagaaacgggacaacttgtccatcgtttcactgtaccagctcctgtagtgataatactcattattttgtgtgtgatggctggtattattggaacgatcctcttaatttcttacagtattcgccgactgataaaggcatgaggatgtggcctgcatgctgcctgatcttgcctagaaccggctgcacctgctgttctcttgtttatgcaaactggctgcacctgctattcctttgcttatgcccctacccctggctatcctaattccctgttctcctgcctcactattactgtattctctacttctaaataaaaataaaacaaaatacaaaccgttt

SEQ ID NO: 62206 - DNA, 1747 bp, Homo sapiens
aaggtgggcctggaagataacagctagtaggctaaggtcagacactgacacttgcagttgtctttggtagttttttgcactaacttcaggaaccagctcatgatctcaggatgtatggaaaaataatctttgtattactattgtcagcaattgtgagcatatcagcatcaagtaccactggtgtggcaatgcacacttcaacctcttcttcagtcacaaagagttacatctcatcacagacaaatgggataacactcattaattggtgggcgatggctcgtgttatttttgaggtgatgcttgttgttgttggaatgatcatcttaatttcttactgtattcgatgactgataaaggttttcatgcctctgggattgagattagaggaagaaagcaaagaaaggacatttttttacttcactgttcatggtgtaattgtgtgcctgacggctgtagctactaacttggcttacgttgactggctactaagggactctaggagtcagaaactaaatgctgagtctctcaaaggcgtagagagaatttcagagggccttaccatgacatgaggattaaactccagttctgcccgattctcatcacgaaatccttatcccatgcctcattgtgtttggtgtccccttgcctaggggacagtcctcctgggtaagatcagcaagataactcttcagtcacattccatttgatactttgaatactctggggtccttacccaccaaatggatggaattcagctgctcaatcactgcctttctcagaactcggttgtccaaccacaattccctttcccttaggatagggctatattggcaaaatgccgcccgaacagactgctgacagtaaaccaaatattagtttctctcaccttcttgaaggcatttacagtctttgtaagcttttctcctagattttccctttcctgttcctgcttagattctaagaatgaagtgcatccttctccttttcttcattaggtgaagtgggatttacccattaccatatattcaccaccaggtcactgacgagagactccagtgaatcgctttccctctgcattcctctccttgtacagactagagggtcacattgtgtaaagcctaacatagccctgcaaagagatctggccccagcagtgaacacaaactcagtaattctctttagagtgaggtggtaatcagtgcctcttggtttcagccgtggtcctagtggctacttatggaagaataggaatagtttcacaacatcctgtaacattggcttacctgtatattatatgccacccgtaaccataaaaacaccaggatttaggttccttgaaggtaatgactatgggtccctctctgtggaagaatactgaatagaagagagaaatcactcaatatgtggaatgactgatatggtttggctgtgttcccactcaaatctcatcttgaattgtagttccaataatccccacatgtcatgggaggaacccagtgggaggtacttgaatcattgcggtggtttcccctgtgctattctcatgatagtgagtaaattctcacataatctgatagttttataaaggagcttcccccttcactcagctctcattcttctccttcctgccactatgtaagaaagatgtgtttgtttcccctttggtcatgattgtaagtatcctgagaccttcccagccatgcaaaactgtagatcaataaaacctctttcctttataaattacaca

SEQ ID NO: 62207 - DNA, 1766 bp, Homo sapiens
aaggtgggcctggaagataacagctagtaggctaaggtcagacactgacacttgcagttgtctttggtagttttttgcactaacttcaggaaccagctcatgatctcaggatgtatggaaaaataatctttgtattactattgtcaggtaagtgattttatttcatcaattgtgagcatatcagcatcaagtaccactggtgtggcaatgcacacttcaacctcttcttcagtcacaaagagttacatctcatcacagacaaatgggataacactcattaattggtgggcgatggctcgtgttatttttgaggtgatgcttgttgttgttggaatgatcatcttaatttcttactgtattcgatgactgataaaggttttcatgcctctgggattgagattagaggaagaaagcaaagaaaggacatttttttacttcactgttcatggtgtaattgtgtgcctgacggctgtagctactaacttggcttacgttgactggctactaagggactctaggagtcagaaactaaatgctgagtctctcaaaggcgtagagagaatttcagagggccttaccatgacatgaggattaaactccagttctgcccgattctcatcacgaaatccttatcccatgcctcattgtgtttggtgtccccttgcctaggggacagtcctcctgggtaagatcagcaagataactcttcagtcacattccatttgatactttgaatactctggggtccttacccaccaaatggatggaattcagctgctcaatcactgcctttctcagaactcggttgtccaaccacaattccctttcccttaggatagggctatattggcaaaatgccgcccgaacagactgctgacagtaaaccaaatattagtttctctcaccttcttgaaggcatttacagtctttgtaagcttttctcctagattttccctttcctgttcctgcttagattctaagaatgaagtgcatccttctccttttcttcattaggtgaagtgggatttacccattaccatatattcaccaccaggtcactgacgagagactccagtgaatcgctttccctctgcattcctctccttgtacagactagagggtcacattgtgtaaagcctaacatagccctgcaaagagatctggccccagcagtgaacacaaactcagtaattctctttagagtgaggtggtaatcagtgcctcttggtttcagccgtggtcctagtggctacttatggaagaataggaatagtttcacaacatcctgtaacattggcttacctgtatattatatgccacccgtaaccataaaaacaccaggatttaggttccttgaaggtaatgactatgggtccctctctgtggaagaatactgaatagaagagagaaatcactcaatatgtggaatgactgatatggtttggctgtgttcccactcaaatctcatcttgaattgtagttccaataatccccacatgtcatgggaggaacccagtgggaggtacttgaatcattgcggtggtttcccctgtgctattctcatgatagtgagtaaattctcacataatctgatagttttataaaggagcttcccccttcactcagctctcattcttctccttcctgccactatgtaagaaagatgtgtttgtttcccctttggtcatgattgtaagtatcctgagaccttcccagccatgcaaaactgtagatcaataaaacctctttcctttataaattacaca

SEQ ID NO: 62208 - DNA, 665 bp, Homo sapiens
aaggtgggcctggaagataacagctagtaggctaaggtcagacactgacacttgcagttgtctttggtagttttttgcactaacttcaggaaccagctcatgatctcaggatgtatggaaaaataatctttgtattactattgtcaggagatggagccaaccctgaaaattctgggagaagaggacagaaggcagagggaagagcaagagcaaaaattctgaaacaggagaaattgtgagcatatcagcattaagtaccactgaggtggcaatgcacacttcaacctcttcttcagtcacaaagagttacatctcatcacagacaaatggagaaacgggacaacttgtccatcgtttcactgtaccagctcctgtagtgataatactcattattttgtgtgtgatggctggtattattggaacgatcctcttaatttcttacagtattcgccgactgataaaggcatgaggatgtggcctgcatgctgcctgatcttgcctagaaccggctgcacctgctgttctcttgtttatgcaaactggctgcacctgctattcctttgcttatgcccctacccctggctatcctaattccctgttctcctgcctcactattactgtattctctacttctaaataaaaataaaacaaaatacaaaccgttt

SEQ ID NO: 62209 - DNA, 2555 bp, Homo sapiens
  misc_feature (1608)..(1609): n is a, c, g, or t
aaggtgggcctggaagataacagctagtaggctaaggtcagacactgacacttgcagttgtctttggtagttttttgcactaacttcaggaaccagctcatgatctcaggatgtatggaaaaataatctttgtattactattgtcagaaattgtgagcatatcagcattaagtaccactgaggtggcaatgcacacttcaacctcttcttcagtcacaaagagttacatctcatcacagacaaatgagaaagggtacaacttgcccatcatttctctgaaccagctcctgtagtgataatactcattattttgtgtgtgatggctggtattattggaacgatcctcttaatttcttacagtattcgccgactgataaagaaaagcccatctgatgtaaaacctctcccctcacctgacacagacgtgcctttaagttctgttgaaatagaaaatccagagacaagtgatcaatgagaatctgttcaccaaaccaaatgtggaaagaacacaaagaagacataagacttcagtcaagtgaaaaattaacatgtggactggacactccaataaattatatacctgcctaagttgtacaatttcagaatgcaattttcattataatgagttccagtgactcaatgatggggaaaaaaatctctgctcattaatatttcaagataaagaacaaatgtttccttgaatgcttgcttttgtgtgttagcataatttttagaattgtttgagaattctgatccaaaactttagttgaattcatctacgtttgtttaatattaacttaacctattctattgtattataatgatgattctgtcaaatgaaaggcttgaaatacctagatgaagtttagattttcttcctattgtaaacttttgagtctggtttcattgttttaaataaattaaggggacactaaagtcctatcattcatttccttcattgctgaacaggcaagatataatattacatgaatgattactatattttgttcacactaataaagcttatgctcagaaatgccatacacacacacaaacacacacatttatcatttaatgcataaatcaacacaaaaggttttcccattaatatgaaatattacatatatataagtgccatatttaaaataatttgtctaacagtagaactatgtcggagcactcactgaagcttgcattccactgaaagagttatttgtgtaagtagagtatccggagaaggaaaagaacttacgacctttctttataacagaaactcaactctaaattcaacaagatgtgcaaaccggacatgcaggtgaatattttaataggttactataaggttctcaattaaattctttaatctgtccagtcccagtttctcttattaataaaactttggaaattgctttaaaccatttaaaggaaatttctagatatagaaactaaggactgtgactatacagctgtcactcatttgtagtaaaacttaaaaagcaaaaacaaaaaacaaaaaagaccttcctgtgatactttatttccgaactaataaaaatctatatgactttttattattgtgtgataaccaagtaaatgttttctattttnnatattttcaggcatggtaacagaaatttaccttttaataaattaaaaaatctaaattttaacctacttgtatgttcggagagtgtttttgtactatattgactacttaaaatagagaatgagactaagaagggaacatttctgttgatacatgttttttaaaagtaatttttaagagcattattaggttaatttaatccaattaatgacccaaatgccaaggtaattttaaatttacatttttaataaaagcaacatgttgaaacaagagagggtgagattaacctttttgctaaagtaatttacaagtcaaagacaggaagagatcagagtgaatgtgccttcttaaccagagctacagaatttagtgaataattaaagtacaaactgctttgacctccttgaacttttccaagcaatttctctgtacttctatatatgaatgtcttagccaattttctgctactataacagaatacgacagactgggtaatttaaaaagaaaagaaatttattttcttcctagttctggaggctgggaaggcgaagggcatggcactgacatctgccttgtaactgatgagaaccttcttactgcatgataacaaagcagcaaggcaagcaaaagcgtaagatgaagagagaggaaatgaagccaaacacatcctttcatcagaagcccattccctctataaggcgttactacatttatgagaatggagtcctcatgacctaatcgtgaccttaaaggcccctcccaacactgttacaatggcaattaaatttcaacaaaggttccagaggtgacattcgaatcagcaatgaaattttcatagttaaatttggtattcgtgggggaagaaatgaccatttcccttgtatttttataattaaatcagcaaaatattgtaataaagaaatctttcctgtgaagataccatgacccc

SEQ ID NO: 62210 - DNA, 2612 bp, Homo sapiens
  misc_feature (1665)..(1666): n is a, c, g, or t
aaggtgggcctggaagataacagctagtaggctaaggtcagacactgacacttgcagttgtctttggtagttttttgcactaacttcaggaaccagctcatgatctcaggatgtatggaaaaataatctttgtattactattgtcagaaattgtgagcatatcagcattaagtaccactgaggtggcaatgcacacttcaacctcttcttcagtcacaaagagttacatctcatcacagacaaatgatacgcacaaacgggacacatatgcagccactcctagagctcatgaagtttcagaaatttctgttagaactgtttaccctccagaagaggaaaccctcctgtagtgataatactcattattttgtgtgtgatggctggtattattggaacgatcctcttaatttcttacagtattcgccgactgataaagaaaagcccatctgatgtaaaacctctcccctcacctgacacagacgtgcctttaagttctgttgaaatagaaaatccagagacaagtgatcaatgagaatctgttcaccaaaccaaatgtggaaagaacacaaagaagacataagacttcagtcaagtgaaaaattaacatgtggactggacactccaataaattatatacctgcctaagttgtacaatttcagaatgcaattttcattataatgagttccagtgactcaatgatggggaaaaaaatctctgctcattaatatttcaagataaagaacaaatgtttccttgaatgcttgcttttgtgtgttagcataatttttagaattgtttgagaattctgatccaaaactttagttgaattcatctacgtttgtttaatattaacttaacctattctattgtattataatgatgattctgtcaaatgaaaggcttgaaatacctagatgaagtttagattttcttcctattgtaaacttttgagtctggtttcattgttttaaataaattaaggggacactaaagtcctatcattcatttccttcattgctgaacaggcaagatataatattacatgaatgattactatattttgttcacactaataaagcttatgctcagaaatgccatacacacacacaaacacacacatttatcatttaatgcataaatcaacacaaaaggttttcccattaatatgaaatattacatatatataagtgccatatttaaaataatttgtctaacagtagaactatgtcggagcactcactgaagcttgcattccactgaaagagttatttgtgtaagtagagtatccggagaaggaaaagaacttacgacctttctttataacagaaactcaactctaaattcaacaagatgtgcaaaccggacatgcaggtgaatattttaataggttactataaggttctcaattaaattctttaatctgtccagtcccagtttctcttattaataaaactttggaaattgctttaaaccatttaaaggaaatttctagatatagaaactaaggactgtgactatacagctgtcactcatttgtagtaaaacttaaaaagcaaaaacaaaaaacaaaaaagaccttcctgtgatactttatttccgaactaataaaaatctatatgactttttattattgtgtgataaccaagtaaatgttttctattttnnatattttcaggcatggtaacagaaatttaccttttaataaattaaaaaatctaaattttaacctacttgtatgttcggagagtgtttttgtactatattgactacttaaaatagagaatgagactaagaagggaacatttctgttgatacatgttttttaaaagtaatttttaagagcattattaggttaatttaatccaattaatgacccaaatgccaaggtaattttaaatttacatttttaataaaagcaacatgttgaaacaagagagggtgagattaacctttttgctaaagtaatttacaagtcaaagacaggaagagatcagagtgaatgtgccttcttaaccagagctacagaatttagtgaataattaaagtacaaactgctttgacctccttgaacttttccaagcaatttctctgtacttctatatatgaatgtcttagccaattttctgctactataacagaatacgacagactgggtaatttaaaaagaaaagaaatttattttcttcctagttctggaggctgggaaggcgaagggcatggcactgacatctgccttgtaactgatgagaaccttcttactgcatgataacaaagcagcaaggcaagcaaaagcgtaagatgaagagagaggaaatgaagccaaacacatcctttcatcagaagcccattccctctataaggcgttactacatttatgagaatggagtcctcatgacctaatcgtgaccttaaaggcccctcccaacactgttacaatggcaattaaatttcaacaaaggttccagaggtgacattcgaatcagcaatgaaattttcatagttaaatttggtattcgtgggggaagaaatgaccatttcccttgtatttttataattaaatcagcaaaatattgtaataaagaaatctttcctgtgaagataccatgacccc

SEQ ID NO: 62211 - DNA, 1111 bp, Homo sapiens
aaggtgggcctggaagataacagctagtaggctaaggtcagacactgacacttgcagttgtctttggtagttttttgcactaacttcaggaaccagctcatgatctcaggatgtatggaaaaataatctttgtattactattgtcagcaattgtgagcatatcagcatcaagtaccactggtgtggcaatgcacacttcaacctcttcttcagtcacaaagagttacatctcatcacagacaaatgatacgcacaaacgggacacatatgcagccactcctagagctcatgaagtttcagaaatttctgttagaactgtttaccctccagaagaggaaaccggagaaagggtacaacttgcccatcatttctctgaaccagagataacactcattatttttggggtgatgcttgttgttgttggaatgatcatcttaatttcttactgtattcgatgactgataaaggtgagaattcagtttttaattttgctctaaataccagtgtgaacagctctcggagggtttattcctctgagttcagttaaactcaaaagagaaacagaactgcataaaattccatctttttcaactggacacatagaagtcactgtgtttctctagcataatttattttttgcatttgcccaattaaagggagcctctaaatataaatctgtcccccattttcccaatgaaagctctccctaagtttttgtctaacttgctttcacatattttgatggatattgaggaaatattaagatgctacttatagtatttaccctattagtgaataaaatgtttaaaataatatatttacatatgtttaaaactttgggggaggccaaggcaggaggattgtttgagctcaggagtttgagaccagcctgagcaaaaaggtgaaacctagtctatacaaaaaatatgaaaattagaaaggcgtggtggtgcacacgtgtagtatcagccactcagggggctgaagtgggaggattgcttcagcctgggaaataaaggctgcagtgaactgtgatcatgctactgcactccagcttgggcaacagagaccctgtctcaataaatatataaataaataaataaaaataaac

SEQ ID NO: 62212 - DNA, 706 bp, Homo sapiens
aaggtgggcctggaagataacagctagtaggctaaggtcagacactgacacttgcagttgtctttggtagttttttgcactaacttcaggaaccagctcatgatctcaggatgtatggaaaaataatctttgtattactattgtcaggaaactttgagcattcagctgaggggccaagttggctgcctctgagaagaagcccttccacctccactccactgcacttgggtgccattcccctcatttgaatgtctccaagagatgagcaaagaaattgtgagcatatcagcattaagtaccactgaggtggcaatgcacacttcaacctcttcttcagtcacaaagagttacatctcatcacagacaaatggagaaacgggacaacttgtccatcgtttcactgtaccagctcctgtagtgataatactcattattttgtgtgtgatggctggtattattggaacgatcctcttaatttcttacagtattcgccgactgataaaggcatgaggatgtggcctgcatgctgcctgatcttgcctagaaccggctgcacctgctgttctcttgtttatgcaaactggctgcacctgctattcctttgcttatgcccctacccctggctatcctaattccctgttctcctgcctcactattactgtattctctacttctaaataaaaataaaacaaaatacaaaccgttt

SEQ ID NO: 62213 - DNA, 487 bp, Homo sapiens
aaggtgggcctggaagataacagctagtaggctaaggtcagacactgacacttgcagttgtctttggtagttttttgcactaacttcaggaaccagctcatgatctcaggatgtatggaaaaataatctttgtattactattgtcagaaattgtgagcatatcagcattaagtaccactgaggtggcaatgcacacttcaacctcttcttcagtcacaaagagttacatctcatcacagacaaatggagaaacgggacaacttgtccatcgtttcactgtaccaggcatgaggatgtggcctgcatgctgcctgatcttgcctagaaccggctgcacctgctgttctcttgtttatgcaaactggctgcacctgctattcctttgcttatgcccctacccctggctatcctaattccctgttctcctgcctcactattactgtattctctacttctaaataaaaataaaacaaaatacaaaccgttt

SEQ ID NO: 62214 - DNA, 1019 bp, Homo sapiens
aaggtgggcctggaagataacagctagtaggctaaggtcagacactgacacttgcagttgtctttggtagttttttgcactaacttcaggaaccagctcatgatctcaggatgtatggaaaaataatctttgtattactattgtcaggtaagtgattttatttcatcaattgtgagcatatcagcatcaagtaccactggtgtggcaatgcacacttcaacctcttcttcagtcacaaagagttacatctcatcacagacaaatgggataacactcattaattggtgggcgatggctcgtgttatttttgaggtgatgcttgttgttgttggaatgatcatcttaatttcttactgtattcgatgactgataaaggtgagaattcagtttttaattttgctctaaataccagtgtgaacagctctcggagggtttattcctctgagttcagttaaactcaaaagagaaacagaactgcataaaattccatctttttcaactggacacatagaagtcactgtgtttctctagcataatttattttttgcatttgcccaattaaagggagcctctaaatataaatctgtcccccattttcccaatgaaagctctccctaagtttttgtctaacttgctttcacatattttgatggatattgaggaaatattaagatgctacttatagtatttaccctattagtgaataaaatgtttaaaataatatatttacatatgtttaaaactttgggggaggccaaggcaggaggattgtttgagctcaggagtttgagaccagcctgagcaaaaaggtgaaacctagtctatacaaaaaatatgaaaattagaaaggcgtggtggtgcacacgtgtagtatcagccactcagggggctgaagtgggaggattgcttcagcctgggaaataaaggctgcagtgaactgtgatcatgctactgcactccagcttgggcaacagagaccctgtctcaataaatatataaataaataaataaaaataaac

SEQ ID NO: 62215 - DNA, 791 bp, Homo sapiens
aaggtgggcctggaagataacagctagtaggctaaggtcagacactgacacttgcagttgtctttggtagttttttgcactaacttcaggaaccagctcatgatctcaggatgtatggaaaaataatctttgtattactattgtcagaaattgtgagcatatcagcattaagtaccactgaggtggcaatgcacacttcaacctcttcttcagtcacaaagagttacatctcatcacagacaaatggagaaacgggacaacttgtccatcgtttcactgtaccaggtatgttaatatttgacaaagaataaaagtcattccattttaaactatccattgcttgtttcaaatgcctaagaaaatgtgtctatcttaaaacagaagagcatatgttgttaactttattcacacgaaattgtaaagacaaagaaaatattctctttttaaaattaaaataggcatttcttatttttaaaaacattttgggggccaggggccgtggctcatgcctataatccctataattttgggaggccaagcctggctaatcacttgagcccaggaatttgagaacagcctgggcaatatggcaaaatctatctctacaaaaaatacaaaaattagctgggatggggcatgcacctgtagtctcaactgcttgggaggctggctgaggtgggaggatcggatccattgcctgagcctgggagtttgaggctgcagtgagctatgactgtgccactgtactctagccttggtaagaccctgtctcaaaaacaaatacataagta

SEQ ID NO: 62216 - DNA, 2726 bp, Homo sapiens
  misc_feature (1779)..(1780): n is a, c, g, or t
aaggtgggcctggaagataacagctagtaggctaaggtcagacactgacacttgcagttgtctttggtagttttttgcactaacttcaggaaccagctcatgatctcaggatgtatggaaaaataatctttgtattactattgtcaggagatggagccaaccctgaaaattctgggagaagaggacagaaggcagagggaagagcaagagcaaaaattctgaaacaggagaaattgtgagcatatcagcattaagtaccactgaggtggcaatgcacacttcaacctcttcttcagtcacaaagagttacatctcatcacagacaaatgatacgcacaaacgggacacatatgcagccactcctagagctcatgaagtttcagaaatttctgttagaactgtttaccctccagaagaggaaaccggagaaagggtacaacttgcccatcatttctctgaaccagagataacactcattatttttggggtgatggctggtgttattggaacgatcctcttaatttcttacggtattcgccgactgataaagaaaagcccatctgatgtaaaacctctcccctcacctgacacagacgtgcctttaagttctgttgaaatagaaaatccagagacaagtgatcaatgagaatctgttcaccaaaccaaatgtggaaagaacacaaagaagacataagacttcagtcaagtgaaaaattaacatgtggactggacactccaataaattatatacctgcctaagttgtacaatttcagaatgcaattttcattataatgagttccagtgactcaatgatggggaaaaaaatctctgctcattaatatttcaagataaagaacaaatgtttccttgaatgcttgcttttgtgtgttagcataatttttagaattgtttgagaattctgatccaaaactttagttgaattcatctacgtttgtttaatattaacttaacctattctattgtattataatgatgattctgtcaaatgaaaggcttgaaatacctagatgaagtttagattttcttcctattgtaaacttttgagtctggtttcattgttttaaataaattaaggggacactaaagtcctatcattcatttccttcattgctgaacaggcaagatataatattacatgaatgattactatattttgttcacactaataaagcttatgctcagaaatgccatacacacacacaaacacacacatttatcatttaatgcataaatcaacacaaaaggttttcccattaatatgaaatattacatatatataagtgccatatttaaaataatttgtctaacagtagaactatgtcggagcactcactgaagcttgcattccactgaaagagttatttgtgtaagtagagtatccggagaaggaaaagaacttacgacctttctttataacagaaactcaactctaaattcaacaagatgtgcaaaccggacatgcaggtgaatattttaataggttactataaggttctcaattaaattctttaatctgtccagtcccagtttctcttattaataaaactttggaaattgctttaaaccatttaaaggaaatttctagatatagaaactaaggactgtgactatacagctgtcactcatttgtagtaaaacttaaaaagcaaaaacaaaaaacaaaaaagaccttcctgtgatactttatttccgaactaataaaaatctatatgactttttattattgtgtgataaccaagtaaatgttttctattttnnatattttcaggcatggtaacagaaatttaccttttaataaattaaaaaatctaaattttaacctacttgtatgttcggagagtgtttttgtactatattgactacttaaaatagagaatgagactaagaagggaacatttctgttgatacatgttttttaaaagtaatttttaagagcattattaggttaatttaatccaattaatgacccaaatgccaaggtaattttaaatttacatttttaataaaagcaacatgttgaaacaagagagggtgagattaacctttttgctaaagtaatttacaagtcaaagacaggaagagatcagagtgaatgtgccttcttaaccagagctacagaatttagtgaataattaaagtacaaactgctttgacctccttgaacttttccaagcaatttctctgtacttctatatatgaatgtcttagccaattttctgctactataacagaatacgacagactgggtaatttaaaaagaaaagaaatttattttcttcctagttctggaggctgggaaggcgaagggcatggcactgacatctgccttgtaactgatgagaaccttcttactgcatgataacaaagcagcaaggcaagcaaaagcgtaagatgaagagagaggaaatgaagccaaacacatcctttcatcagaagcccattccctctataaggcgttactacatttatgagaatggagtcctcatgacctaatcgtgaccttaaaggcccctcccaacactgttacaatggcaattaaatttcaacaaaggttccagaggtgacattcgaatcagcaatgaaattttcatagttaaatttggtattcgtgggggaagaaatgaccatttcccttgtatttttataattaaatcagcaaaatattgtaataaagaaatctttcctgtgaagataccatgacccc

SEQ ID NO: 62217 - DNA, 2544 bp, Homo sapiens
  misc_feature (1597)..(1598): n is a, c, g, or t
aaggtgggcctggaagataacagctagtaggctaaggtcagacactgacacttgcagttgtctttggtagttttttgcactaacttcaggaaccagctcatgatctcaggatgtatggaaaaataatctttgtattactattgtcagatacgcacaaacgggacacatatgcagccactcctagagctcatgaagtttcagaaatttctgttagaactgtttaccctccagaagaggaaaccggagaaagggtacaacttgcccatcatttctctgaaccagagataacactcattatttttggggtgatggctggtgttattggaacgatcctcttaatttcttacggtattcgccgactgataaagaaaagcccatctgatgtaaaacctctcccctcacctgacacagacgtgcctttaagttctgttgaaatagaaaatccagagacaagtgatcaatgagaatctgttcaccaaaccaaatgtggaaagaacacaaagaagacataagacttcagtcaagtgaaaaattaacatgtggactggacactccaataaattatatacctgcctaagttgtacaatttcagaatgcaattttcattataatgagttccagtgactcaatgatggggaaaaaaatctctgctcattaatatttcaagataaagaacaaatgtttccttgaatgcttgcttttgtgtgttagcataatttttagaattgtttgagaattctgatccaaaactttagttgaattcatctacgtttgtttaatattaacttaacctattctattgtattataatgatgattctgtcaaatgaaaggcttgaaatacctagatgaagtttagattttcttcctattgtaaacttttgagtctggtttcattgttttaaataaattaaggggacactaaagtcctatcattcatttccttcattgctgaacaggcaagatataatattacatgaatgattactatattttgttcacactaataaagcttatgctcagaaatgccatacacacacacaaacacacacatttatcatttaatgcataaatcaacacaaaaggttttcccattaatatgaaatattacatatatataagtgccatatttaaaataatttgtctaacagtagaactatgtcggagcactcactgaagcttgcattccactgaaagagttatttgtgtaagtagagtatccggagaaggaaaagaacttacgacctttctttataacagaaactcaactctaaattcaacaagatgtgcaaaccggacatgcaggtgaatattttaataggttactataaggttctcaattaaattctttaatctgtccagtcccagtttctcttattaataaaactttggaaattgctttaaaccatttaaaggaaatttctagatatagaaactaaggactgtgactatacagctgtcactcatttgtagtaaaacttaaaaagcaaaaacaaaaaacaaaaaagaccttcctgtgatactttatttccgaactaataaaaatctatatgactttttattattgtgtgataaccaagtaaatgttttctattttnnatattttcaggcatggtaacagaaatttaccttttaataaattaaaaaatctaaattttaacctacttgtatgttcggagagtgtttttgtactatattgactacttaaaatagagaatgagactaagaagggaacatttctgttgatacatgttttttaaaagtaatttttaagagcattattaggttaatttaatccaattaatgacccaaatgccaaggtaattttaaatttacatttttaataaaagcaacatgttgaaacaagagagggtgagattaacctttttgctaaagtaatttacaagtcaaagacaggaagagatcagagtgaatgtgccttcttaaccagagctacagaatttagtgaataattaaagtacaaactgctttgacctccttgaacttttccaagcaatttctctgtacttctatatatgaatgtcttagccaattttctgctactataacagaatacgacagactgggtaatttaaaaagaaaagaaatttattttcttcctagttctggaggctgggaaggcgaagggcatggcactgacatctgccttgtaactgatgagaaccttcttactgcatgataacaaagcagcaaggcaagcaaaagcgtaagatgaagagagaggaaatgaagccaaacacatcctttcatcagaagcccattccctctataaggcgttactacatttatgagaatggagtcctcatgacctaatcgtgaccttaaaggcccctcccaacactgttacaatggcaattaaatttcaacaaaggttccagaggtgacattcgaatcagcaatgaaattttcatagttaaatttggtattcgtgggggaagaaatgaccatttcccttgtatttttataattaaatcagcaaaatattgtaataaagaaatctttcctgtgaagataccatgacccc

SEQ ID NO: 62218 - DNA, 483 bp, Homo sapiens
aaggtgggcctggaagataacagctagtaggctaaggtcagacactgacacttgcagttgtctttggtagttttttgcactaacttcaggaaccagctcatgatctcaggatgtatggaaaaataatctttgtattactattgtcaggagaaacgggacaacttgtccatcgtttcactgtaccagctcctgtagtgataatactcattattttgtgtgtgatggctggtattattggaacgatcctcttaatttcttacagtattcgccgactgataaaggcatgaggatgtggcctgcatgctgcctgatcttgcctagaaccggctgcacctgctgttctcttgtttatgcaaactggctgcacctgctattcctttgcttatgcccctacccctggctatcctaattccctgttctcctgcctcactattactgtattctctacttctaaataaaaataaaacaaaatacaaaccgttt

SEQ ID NO: 62219 - DNA, 468 bp, Homo sapiens
aaggtgggcctggaagataacagctagtaggctaaggtcagacactgacacttgcagttgtctttggtagttttttgcactaacttcaggaaccagctcatgatctcaggatgtatggaaaaataatctttgtattactattgtcagttgtcccagcaccatttgttgaagagactatcctttgcccattgaatggtcttgacacccttcttgaaagttaattggccatggatatatgagtttatttctggagtctcaattctatccgaagaatatgtctgttcttggggcaaaatcacacagattttattgctgttacttggttataagttttgcattcatgaagtatgattcaccaaactgtgttcttcttcaagattgttttggctatttagatccctaataatttcacagaaattttaggattaggttttccattcttgcaaaaaaattatgcgcattttaact

SEQ ID NO: 62220 - DNA, 2643 bp, Homo sapiens
  misc_feature (1696)..(1697): n is a, c, g, or t
aaggtgggcctggaagataacagctagtaggctaaggtcagacactgacacttgcagttgtctttggtagttttttgcactaacttcaggaaccagctcatgatctcaggatgtatggaaaaataatctttgtattactattgtcagcaattgtgagcatatcagcatcaagtaccactggtgtggcaatgcacacttcaacctcttcttcagtcacaaagagttacatctcatcacagacaaatgatacgcacaaacgggacacatatgcagccactcctagagctcatgaagtttcagaaatttctgttagaactgtttaccctccagaagaggaaaccggagaaagggtacaacttgcccatcatttctctgaaccagagataacactcattatttttggggtgatggctggtgttattggaacgatcctcttaatttcttacggtattcgccgactgataaagaaaagcccatctgatgtaaaacctctcccctcacctgacacagacgtgcctttaagttctgttgaaatagaaaatccagagacaagtgatcaatgagaatctgttcaccaaaccaaatgtggaaagaacacaaagaagacataagacttcagtcaagtgaaaaattaacatgtggactggacactccaataaattatatacctgcctaagttgtacaatttcagaatgcaattttcattataatgagttccagtgactcaatgatggggaaaaaaatctctgctcattaatatttcaagataaagaacaaatgtttccttgaatgcttgcttttgtgtgttagcataatttttagaattgtttgagaattctgatccaaaactttagttgaattcatctacgtttgtttaatattaacttaacctattctattgtattataatgatgattctgtcaaatgaaaggcttgaaatacctagatgaagtttagattttcttcctattgtaaacttttgagtctggtttcattgttttaaataaattaaggggacactaaagtcctatcattcatttccttcattgctgaacaggcaagatataatattacatgaatgattactatattttgttcacactaataaagcttatgctcagaaatgccatacacacacacaaacacacacatttatcatttaatgcataaatcaacacaaaaggttttcccattaatatgaaatattacatatatataagtgccatatttaaaataatttgtctaacagtagaactatgtcggagcactcactgaagcttgcattccactgaaagagttatttgtgtaagtagagtatccggagaaggaaaagaacttacgacctttctttataacagaaactcaactctaaattcaacaagatgtgcaaaccggacatgcaggtgaatattttaataggttactataaggttctcaattaaattctttaatctgtccagtcccagtttctcttattaataaaactttggaaattgctttaaaccatttaaaggaaatttctagatatagaaactaaggactgtgactatacagctgtcactcatttgtagtaaaacttaaaaagcaaaaacaaaaaacaaaaaagaccttcctgtgatactttatttccgaactaataaaaatctatatgactttttattattgtgtgataaccaagtaaatgttttctattttnnatattttcaggcatggtaacagaaatttaccttttaataaattaaaaaatctaaattttaacctacttgtatgttcggagagtgtttttgtactatattgactacttaaaatagagaatgagactaagaagggaacatttctgttgatacatgttttttaaaagtaatttttaagagcattattaggttaatttaatccaattaatgacccaaatgccaaggtaattttaaatttacatttttaataaaagcaacatgttgaaacaagagagggtgagattaacctttttgctaaagtaatttacaagtcaaagacaggaagagatcagagtgaatgtgccttcttaaccagagctacagaatttagtgaataattaaagtacaaactgctttgacctccttgaacttttccaagcaatttctctgtacttctatatatgaatgtcttagccaattttctgctactataacagaatacgacagactgggtaatttaaaaagaaaagaaatttattttcttcctagttctggaggctgggaaggcgaagggcatggcactgacatctgccttgtaactgatgagaaccttcttactgcatgataacaaagcagcaaggcaagcaaaagcgtaagatgaagagagaggaaatgaagccaaacacatcctttcatcagaagcccattccctctataaggcgttactacatttatgagaatggagtcctcatgacctaatcgtgaccttaaaggcccctcccaacactgttacaatggcaattaaatttcaacaaaggttccagaggtgacattcgaatcagcaatgaaattttcatagttaaatttggtattcgtgggggaagaaatgaccatttcccttgtatttttataattaaatcagcaaaatattgtaataaagaaatctttcctgtgaagataccatgacccc

SEQ ID NO: 62221 - DNA, 1759 bp, Homo sapiens
  misc_feature (1696)..(1697): n is a, c, g, or t
aaggtgggcctggaagataacagctagtaggctaaggtcagacactgacacttgcagttgtctttggtagttttttgcactaacttcaggaaccagctcatgatctcaggatgtatggaaaaataatctttgtattactattgtcagcaattgtgagcatatcagcatcaagtaccactggtgtggcaatgcacacttcaacctcttcttcagtcacaaagagttacatctcatcacagacaaatgatacgcacaaacgggacacatatgcagccactcctagagctcatgaagtttcagaaatttctgttagaactgtttaccctccagaagaggaaaccggagaaagggtacaacttgcccatcatttctctgaaccagagataacactcattatttttggggtgatggctggtgttattggaacgatcctcttaatttcttacggtattcgccgactgataaagaaaagcccatctgatgtaaaacctctcccctcacctgacacagacgtgcctttaagttctgttgaaatagaaaatccagagacaagtgatcaatgagaatctgttcaccaaaccaaatgtggaaagaacacaaagaagacataagacttcagtcaagtgaaaaattaacatgtggactggacactccaataaattatatacctgcctaagttgtacaatttcagaatgcaattttcattataatgagttccagtgactcaatgatggggaaaaaaatctctgctcattaatatttcaagataaagaacaaatgtttccttgaatgcttgcttttgtgtgttagcataatttttagaattgtttgagaattctgatccaaaactttagttgaattcatctacgtttgtttaatattaacttaacctattctattgtattataatgatgattctgtcaaatgaaaggcttgaaatacctagatgaagtttagattttcttcctattgtaaacttttgagtctggtttcattgttttaaataaattaaggggacactaaagtcctatcattcatttccttcattgctgaacaggcaagatataatattacatgaatgattactatattttgttcacactaataaagcttatgctcagaaatgccatacacacacacaaacacacacatttatcatttaatgcataaatcaacacaaaaggttttcccattaatatgaaatattacatatatataagtgccatatttaaaataatttgtctaacagtagaactatgtcggagcactcactgaagcttgcattccactgaaagagttatttgtgtaagtagagtatccggagaaggaaaagaacttacgacctttctttataacagaaactcaactctaaattcaacaagatgtgcaaaccggacatgcaggtgaatattttaataggttactataaggttctcaattaaattctttaatctgtccagtcccagtttctcttattaataaaactttggaaattgctttaaaccatttaaaggaaatttctagatatagaaactaaggactgtgactatacagctgtcactcatttgtagtaaaacttaaaaagcaaaaacaaaaaacaaaaaagaccttcctgtgatactttatttccgaactaataaaaatctatatgactttttattattgtgtgataaccaagtaaatgttttctattttnnatattttcaggcatggtaacagaaatttaccttttaataaattaaaaaatctaaattttaac

SEQ ID NO: 62222 - DNA, 1858 bp, Homo sapiens
aaggtgggcctggaagataacagctagtaggctaaggtcagacactgacacttgcagttgtctttggtagttttttgcactaacttcaggaaccagctcatgatctcaggatgtatggaaaaataatctttgtattactattgtcagcaattgtgagcatatcagcatcaagtaccactggtgtggcaatgcacacttcaacctcttcttcagtcacaaagagttacatctcatcacagacaaatgatacgcacaaacgggacacatatgcagccactcctagagctcatgaagtttcagaaatttctgttagaactgtttaccctccagaagaggaaaccggagaaagggtacaacttgcccatcatttctctgaaccagagataacactcattatttttggggtgatgcttgttgttgttggaatgatcatcttaatttcttactgtattcgatgactgataaaggttttcatgcctctgggattgagattagaggaagaaagcaaagaaaggacatttttttacttcactgttcatggtgtaattgtgtgcctgacggctgtagctactaacttggcttacgttgactggctactaagggactctaggagtcagaaactaaatgctgagtctctcaaaggcgtagagagaatttcagagggccttaccatgacatgaggattaaactccagttctgcccgattctcatcacgaaatccttatcccatgcctcattgtgtttggtgtccccttgcctaggggacagtcctcctgggtaagatcagcaagataactcttcagtcacattccatttgatactttgaatactctggggtccttacccaccaaatggatggaattcagctgctcaatcactgcctttctcagaactcggttgtccaaccacaattccctttcccttaggatagggctatattggcaaaatgccgcccgaacagactgctgacagtaaaccaaatattagtttctctcaccttcttgaaggcatttacagtctttgtaagcttttctcctagattttccctttcctgttcctgcttagattctaagaatgaagtgcatccttctccttttcttcattaggtgaagtgggatttacccattaccatatattcaccaccaggtcactgacgagagactccagtgaatcgctttccctctgcattcctctccttgtacagactagagggtcacattgtgtaaagcctaacatagccctgcaaagagatctggccccagcagtgaacacaaactcagtaattctctttagagtgaggtggtaatcagtgcctcttggtttcagccgtggtcctagtggctacttatggaagaataggaatagtttcacaacatcctgtaacattggcttacctgtatattatatgccacccgtaaccataaaaacaccaggatttaggttccttgaaggtaatgactatgggtccctctctgtggaagaatactgaatagaagagagaaatcactcaatatgtggaatgactgatatggtttggctgtgttcccactcaaatctcatcttgaattgtagttccaataatccccacatgtcatgggaggaacccagtgggaggtacttgaatcattgcggtggtttcccctgtgctattctcatgatagtgagtaaattctcacataatctgatagttttataaaggagcttcccccttcactcagctctcattcttctccttcctgccactatgtaagaaagatgtgtttgtttcccctttggtcatgattgtaagtatcctgagaccttcccagccatgcaaaactgtagatcaataaaacctctttcctttataaattacaca

SEQ ID NO: 62223 - DNA, 2517 bp, Homo sapiens
  misc_feature (1570)..(1571): n is a, c, g, or t
aaggtgggcctggaagataacagctagtaggctaaggtcagacactgacacttgcagttgtctttggtagttttttgcactaacttcaggaaccagctcatgatctcaggatgtatggaaaaataatctttgtattactattgtcagaaattgtgagcatatcagcattaagtaccactgaggtggcaatgcacacttcaacctcttcttcagtcacaaagagttacatctcatcacagacaaatgctcctgtagtgataatactcattattttgtgtgtgatggctggtattattggaacgatcctcttaatttcttacagtattcgccgactgataaagaaaagcccatctgatgtaaaacctctcccctcacctgacacagacgtgcctttaagttctgttgaaatagaaaatccagagacaagtgatcaatgagaatctgttcaccaaaccaaatgtggaaagaacacaaagaagacataagacttcagtcaagtgaaaaattaacatgtggactggacactccaataaattatatacctgcctaagttgtacaatttcagaatgcaattttcattataatgagttccagtgactcaatgatggggaaaaaaatctctgctcattaatatttcaagataaagaacaaatgtttccttgaatgcttgcttttgtgtgttagcataatttttagaattgtttgagaattctgatccaaaactttagttgaattcatctacgtttgtttaatattaacttaacctattctattgtattataatgatgattctgtcaaatgaaaggcttgaaatacctagatgaagtttagattttcttcctattgtaaacttttgagtctggtttcattgttttaaataaattaaggggacactaaagtcctatcattcatttccttcattgctgaacaggcaagatataatattacatgaatgattactatattttgttcacactaataaagcttatgctcagaaatgccatacacacacacaaacacacacatttatcatttaatgcataaatcaacacaaaaggttttcccattaatatgaaatattacatatatataagtgccatatttaaaataatttgtctaacagtagaactatgtcggagcactcactgaagcttgcattccactgaaagagttatttgtgtaagtagagtatccggagaaggaaaagaacttacgacctttctttataacagaaactcaactctaaattcaacaagatgtgcaaaccggacatgcaggtgaatattttaataggttactataaggttctcaattaaattctttaatctgtccagtcccagtttctcttattaataaaactttggaaattgctttaaaccatttaaaggaaatttctagatatagaaactaaggactgtgactatacagctgtcactcatttgtagtaaaacttaaaaagcaaaaacaaaaaacaaaaaagaccttcctgtgatactttatttccgaactaataaaaatctatatgactttttattattgtgtgataaccaagtaaatgttttctattttnnatattttcaggcatggtaacagaaatttaccttttaataaattaaaaaatctaaattttaacctacttgtatgttcggagagtgtttttgtactatattgactacttaaaatagagaatgagactaagaagggaacatttctgttgatacatgttttttaaaagtaatttttaagagcattattaggttaatttaatccaattaatgacccaaatgccaaggtaattttaaatttacatttttaataaaagcaacatgttgaaacaagagagggtgagattaacctttttgctaaagtaatttacaagtcaaagacaggaagagatcagagtgaatgtgccttcttaaccagagctacagaatttagtgaataattaaagtacaaactgctttgacctccttgaacttttccaagcaatttctctgtacttctatatatgaatgtcttagccaattttctgctactataacagaatacgacagactgggtaatttaaaaagaaaagaaatttattttcttcctagttctggaggctgggaaggcgaagggcatggcactgacatctgccttgtaactgatgagaaccttcttactgcatgataacaaagcagcaaggcaagcaaaagcgtaagatgaagagagaggaaatgaagccaaacacatcctttcatcagaagcccattccctctataaggcgttactacatttatgagaatggagtcctcatgacctaatcgtgaccttaaaggcccctcccaacactgttacaatggcaattaaatttcaacaaaggttccagaggtgacattcgaatcagcaatgaaattttcatagttaaatttggtattcgtgggggaagaaatgaccatttcccttgtatttttataattaaatcagcaaaatattgtaataaagaaatctttcctgtgaagataccatgacccc

SEQ ID NO: 62224 - DNA, 557 bp, Homo sapiens
aaggtgggcctggaagataacagctagtaggctaaggtcagacactgacacttgcagttgtctttggtagttttttgcactaacttcaggaaccagctcatgatctcaggatgtatggaaaaataatctttgtattactattgtcagcaattgtgagcatatcagcatcaagtaccactggtgtggcaatgcacacttcaacctcttcttcagtcacaaagagttacatctcatcacagacaaatgggataacactcattaattggtgggcgatggctcgtgttatttttgaggtgatgcttgttgttgttggaatgatcatcttaatttcttactgtattcgatgactgataaaggcatgaggatgtggcctgcatgctgcctgatcttgcctagaaccagctgcacctgctgttctcttgcttatgcaaactggctgcacctgctattcctttgcttatgccccaacccttggctatcctaactccctgttctcctgcctattactgtattctctacttctaaataaaaataaaacaaaatacaaattatttgca

SEQ ID NO: 62225 - DNA, 435 bp, Homo sapiens
ggagaatggtgtggaaactgccctgtttttacatcaagataaaagcttcaggaagttactggagagtggaatgcaggggtcattctggataacacaaaataactatttgattagaccaaccatttggtctctaaaattgggtgctaaagacaaagataggaaattcaaaaaatcaccacctgtagaagaaaaatcagttaataatttgacagatttaagggcctcacctttctctcacagaactttacctcataacaccctgtttgggaaaattggaaaatatcttctccttacctcctaggggataaacaagagtttaaatgttgccaccaactcaaacaaaacacacctcattctttatgttctggagggagagggagtccttattttgcttcaaagtttcctttctggagcttcttttttttaagtaaaaaa

SEQ ID NO: 62226 - DNA, 242 bp, Homo sapiens
  misc_feature (2)..(5): n is a, c, g, or t
  misc_feature (130)..(130): n is a, c, g, or t
cnnnnaaactagttagtattctgatattctccatcacactcaaaactcaaatgttatgcctctgatacaaaggcaacatttcaagctgttgaagcctaaagctatcttgcaataagtttctttagcattnccagtctccaaattcatccctttttacttttgaaaaacaattacaaatgaatttcagttgaaggaataaacaaattcaaagtatacaaattacatttgctaaaatgaatgaa

SEQ ID NO: 62227 - DNA, 711 bp, Homo sapiens
attgattggctgtgagtgtactgaatgcatctcaactcagctgaggttcacctgtgttcagaaatccaggaaggagggcaatgttgttctcatggtggagagttgaagctcaaggagggagggactgacctaattacatgcacttaaagcacattaactcacattgtattggccaaagcaagttgcatggccaagtccaaagtcataggaaacagttgcaagggctgagagggaatgaatgattcttgatagataactcaatctaggacaaaaaatgaaggttgctgtgagctgcagaatgtgcctttggtttgatttacatatccccaaatcctagggagagaatcatttttgccaaactttatctttactgaatcttttccaacctccaggatcacaagtatacttcatgcattaaaaaccttcccaaagttcattatcttttaccactatgtgctgtgaattctgaggtagcctatgataatttctgtaagaaattacttcaggatgtcaaaaatcagattaaatatagaattaagctgggattttgaaatttaatacccatttttttgagaaaatcaagtatttcaaaggtcctaatactgacatttttagtaagccgtatagacacttccggtcttctttgatagctacaaattttagctccatttcaagagaaagaactctggaacctaagcctaaatatatcct

SEQ ID NO: 62228 - DNA, 443 bp, Homo sapiens
tctttagggtgagaatgatttaatcttatctttgtcggcgagggaagggttagccctcagtgctcaagacacaaagaggactgaaggcgcattaattggtacttgctaatcaagccttagagaccagagcactccaggggaattttactttggagagaaatctcattggccctggagcagccctgtatccactttgtgaatgttttagagagggttaatggggtactagcacagtgtgattagttcagttcattggattatcattttgtaaaagaggcagcatctttactagtactctaataaattataaaattattatatccatttctgttccttgtaccttctttctttgaattaagaaaatggtgtggtaaggtacagtgaacttttgagccagaaattcctggcttggagacccctctctgccatctgttgactggctc

SEQ ID NO: 62229 - DNA, 689 bp, Homo sapiens
gggctggatcccccgcctaccgtttccccgcagccgccggcgcttctggcgcttgtgacccgagcaggaagcccagagagaaaccagaaagacaggaaggggattcctggacttcctttccacatccggcaggaacgcgaccctcctccagctaggagcgcttgtccgggcgcaccaagatgcctgcagcttcaagaagatgtatgggaacagacacagaaactttccctaccagataagcaggacaaagaaacacagactaagagttggcctgtgtggtcacggagtgggttaagagatgataaaaaaatctgctctgtacagatggcacacctggtcccaactaaaccctggggccctagaaagataagacatcccctcctcacaagcccctcctcaagagccccctcctcaagagcccatttataaaaactctgacattcttaactacaacttggcaatcttctcaggatccctctctaacagagacctgttctttccttttgcctattaaactcctgctccaaactcaaaaaaaacaaaaacaaaagaacaaaaaagaacacacaccagcaagagcgccagacggtacaaaaataaggacgagacggagaagaagagacgcagaagcgaccaggcgcaccaggagggcagggagaggagcgccggtccacagggagggctacggg

SEQ ID NO: 62230 - DNA, 175 bp, Homo sapiens
tgtgtaacaggcagtgacagggagcgaggaagtggactttttgtatggaaagctctatgttatttttaagcatgcaaataatacatgcatacattcttacaataacatttcagtaccaaacaaacctagaagtttccctgagtgctctctgcttcctccccagctcctcaatctc

SEQ ID NO: 62231 - DNA, 790 bp, Homo sapiens
tctaatatattcaactcgtatcaagtttgtcgggtcagcgcgaattgaacttttgagtgtctcatctgttcatgaaggagctgcagtttacagagtgtttaagcgctggcgagctgtgaatttgcactgggatgtgttaaattatgacaaagccacagacatcgaagaaagcagccggggagagtcttccacaagtaggactttgtggttgccattgacagctctgcggaacagaaacttggtccacccaactcagttaacctcaccaaggtttcagtgtggctatgtgttattgcacctgttcaatcggatgaggccccatgaagacttatcagaagataacagctcgggggaggttgtgatgagagtgacttcagtgtgacaaaagcataagatgatgcagtgtggaccaccctgcacattttgcaatgtaattgcagtgaatggcaaaaccatagcacttctaaaaacacatctatgaactttttaaaatttatgctttttatatgaacatttgaattgcaaatacatttttctgagaaaaagaatcctcttgttcttcgttgtctggtttgtcacatcttttataagttggtacttgaaatcattatacatataatttaactatacttggttaaaagaataatgaaagttatccttaaggccaaaactattttttcttgcttgttttaaatatatttttatgaaagctttcgctctgtgtgtaatttttcagacctgttacaaatggttaagagtttaggatgctgtgggcagattccaaagtgcc

SEQ ID NO: 62232 - DNA, 315 bp, Homo sapiens
gcacgagcttatttgatctaacagataacagtttgtttaaaataagaataataaaatattttattattcttatttgatctaacagataacagtttgtttaaaataagaataataaaatattttattattcttatttgatctaacagataacagtttgtttaaaataagaataataaaatattttattttaccttcatttctttcttgtctgactctcctgtttctttgtgttgatccaaattcctgacctctgtaattttcattttctctgaaataagttttaacatttcttgtgaggcaagtttactggcaaaa

SEQ ID NO: 62233 - DNA, 276 bp, Homo sapiens
gccactacactccagcctgggccacagagcaagactccctcccaaaaaaaaaaaaaaaaattattagaaagaggaagagagagatgacaaagccttttacagttgggtgttgggtgttagagacccagtaccccagcctgacatacctacagaagcagtgaatttacttatttactgttatgaaaaaaatagatgctgccagcccggtgcacagcagaaactactattgaatcatatggttttagcccttcacctttaaatatgtctaattatatg

SEQ ID NO: 62234 - DNA, 439 bp, Homo sapiens
actagcaagataaggatgggatgttttgccaggtgtggtggtaaatgcctgtgatccccaatactcaggaggctaaggtgggaggatcccttgagccgaggggttcaagacaagcccaggcaacatagtgagacccctcttcaaaaagataaaagggagccgggagcagtggctcatgcctgtaatcccagcactttgggaggctgaggtgggcagatcacctgaggtcaggagttcgagaccagcctggccaacgtggtgaaaccccgtctctactaaaaatacaaaaattagctgggtatggtagtgtgctcctgtaatcccagctacctgggaggctgaggcagaagaattgcatgaaccagggaggcagaggttgcagtgagccgagatcacaccactgcactccagcctggacaacagagtaagactctgtcta

SEQ ID NO: 62235 - DNA, 396 bp, Homo sapiens
ctgttttaaaataatattaaatatgctgcatttaatcagttgtgatcaagtcctgtatttatgttgaattggcaagtcaaacaatttgaacctacaaattgttccctctgctctttttccctgactctactgttcaatgtcaaactcatccattaatttcaagtacaccctcctctaagaatcctgttccatccctttcctcccctcaccctcccaaaataaggataattgttttgtctctgtgctcttcctagcacttcctttaatttacaaaatatttcttctaggctgggcatggttcatgcctataatctcagctctttgggaggtcaatgcaagagggtcaggaattcaagaccagcctgggcaacatagggagactacatctctttaaaa

SEQ ID NO: 62236 - DNA, 418 bp, Homo sapiens
actcaggaacgctggggcaagacatgagacaaagggctgccttcacccaccagtaggagcctgaccctgagcccaaagaaactgcccacctgtgtgctgaccccagggcctgaggacaggtccccaagtggacgtctcaaagagagtcccacattccagggcacatgggaactatggccttctggcagctggagggcagcaggaagggcacagctgtctgagacccgtgtggcttcccagaaagaggtgccacccctgaggaggcaccggtgctcacggactcctggttgccagtcttgccagggcaaaaaggcaagcgaaggaaaccctctcttcgtggggcactctgccttgcagtgtcaggtgagatcccggggggaaagctggcttgagctcctctggaatgtgcagggaggac

SEQ ID NO: 62237 - DNA, 261 bp, Homo sapiens
gtattttgatatatttatggtaatcaaaaggattattattttactgttaatactgagcaagagacaatctgtgagtcatccggacagactattttatattttccttcttttaagctataaaaccaaccaatatggggatttattgagcaattcgggttccatgcctgctgaatgaaatcttcagcacgcgctgttttgtttggcaggacattaccatcaaagtgacggtgagctgcccttgactgcatcctcttttctagg

SEQ ID NO: 62238 - DNA, 410 bp, Homo sapiens
caacaccttttttcataaataaatgtatcacttggtgacaatacaagatgttcttgcttgaattagatactaggtcctgaaagaaagtacggaaaaataggtgactcaggttatgtaagactattgaaaacaaaactttcttaaatctgttattgacaggaagatgaattctctaaatttcactgaaaagattcactatggttgagtgccagtaaagcttctgtttacggactcatgaaaacaaagaatggaggtcaggtaaagagctcagagaacctccttaaaaagttgtctgtaatgtaaaaacaaaaaaggatgaaacctcagtattttaacaatagcttcaatttgtattttataagagctaatatcaatgcaacttgcctatacagaaacttgtgattcctgga

SEQ ID NO: 62239 - DNA, 2692 bp, Homo sapiens
ccgcccctgcccgcccgcgtccggtcccacccaccgtccacgctcccgccccgcctgaagttgcctttctcgtttgagctgagggacgcgtcagccaggcaccccggggtgtggccagaggacttcggcgacgcttccccgagagtagcccccctcctcaacccagaaaagacaaccccgcggggctgcagcgagccaggcatgctcactggcgcaggcccggcccgcagcccgagcaggaagcgccggcgctaggcggccccctgcgctgccagctggagccgggcggagccagcgccccggcgcagggtggctctgccagtccccgcgcgcctgggcggccgcacacgtgtccaggcgtcacgtccgcgcgcgcccccggggcttgcgtcagcggctgttccagaagcgggtgggccagggctctgcgcaccgctggggttcggggcccgggacgccgccgggaggagggcaccgcgcggggtccgacgcggaggcgtgctcggaacgccgggggctgcggagtgcatcagcgcggtccagccctccgcctgccgggcgccgagcgtctccgccgcccggacctgggctgggcgccgtggcgttgcctcggagctcgctgcccgcggggcgcgcaccgccttgacccgggcggccccgcggcaggcaggcgcccgcagttccatggttggttcggagcgcgatgagccgcccgtcctccaccggccccagcgctaataaaccctgcagcaagcagccgccgccgcagccccagcacactccgtccccggctgcgcccccggccgccgccaccatctcggctgcgggccccggctcgtccgcggtgcccgccgcggcggcggtgatctcgggccccggcggcggcggcggggccggcccggtgtccccgcagcaccacgagctgacctcgctcttcgagtgtccggtctgctttgactatgtcctgcctcctattctgcagtgccaggccgggcacctggtgtgtaaccaatgccgccagaagttgagctgctgcccgacgtgcaggggcgccctgacgcccagcatcaggaacctggctatggagaaggtggcctcggcagtcctgtttccctgtaagtatgccaccacgggctgttccctgaccctgcaccatacggagaaaccagaacatgaagacatatgtgaataccgtccctactcctgcccatgtcctggtgcttcctgcaagtggcaggggtccctggaagctgtgatgtcccatctcatgcacgcccacaagagcattaccacccttcagggagaagacatcgtctttctagctacagacattaacttgccaggggctgtcgactgggtgatgatgcagtcatgttttggccatcacttcatgctggtgctggagaaacaagagaagtacgaaggccaccagcagttttttgccatcgtcctgctcattggcacccgcaagcaagccgagaactttgcctacagactggagttgaatgggaaccggcggagattgacctgggaggccacgccccgttcgattcatgacggtgtggctgcggccatcatgaacagcgactgccttgttttcgacacagccatagcacatctttttgcagataatgggaaccttggaatcaatgttactatttctacatgttgtccatgatgtgactttcgtaaaccttcaaaattatttgggcatagtgctctatgtttaataaaggtttttatagatgttttattccatatgtcttcacaagtcaggacccacaattacccgtgttttgtttgaacagcagtgtcccatctggcttcgacccaacaaagttcattaacctgggatgaatggggttggcctgttggtgatttggatgctgttctgtgatctaaaacaactcttattgaattgtatttactccctaaacaacacttgacaggctgttgcacagggcttctatagatcagtgtgttaggaatgggaggccccttcctgcctgccttcccatattggtcccttgacattgacaaaagcacagtgactgtcagcagattcctttacttttgtttgtgggaggtaggaattgttttaatgcattttaaacagtgtttctgaaattggatggctggctaatagacactgaatcacccggagtgcttatcttaaaattgcagatttagggagcctgccaatttaacagtctcatcaggtgattcttttcaacagtaatgtttgagaattactgggttaaattgtgggaaagggtccagattttaaaggtgctttaaggttgccctctgccgatactgtttgtctttctactgtttcatcccctaacttcccccaaccctcaaattaaaactagaactatagatccacatgaacgcacgcctgagatttggccactcacctatgttttgggtggattgcctaggaaagcaagtcatatggccattgatagttctcatgtaattagttttgctcaccactagtacagatgacccgtttacacgtggcttccctcggaagccctcctcaacagtagctggtgtgaaagactaaatcagtagagttggaaaagctttataaccggtgtgtcatatgcttgctatttaaagctgtgtgttggttttgtttttctgccacattcactagttttttaataaatattttccaaaaatg

SEQ ID NO: 62240 - DNA, 446 bp, Homo sapiens
agattcaacttgagataatgagtgcaacatagtgatgaatcagataaacgaaggagatcgacaaactccgagagtgaaataatagagataagaacggcgaacttcccccaaccctcaaattaaaactagaactatagatccacatgaacgcacgcctgagatttggccactcacctatgttttgggtggattgcctaggaaagcaagtcatatggccattgatagttctcatgtaattagttttgctcaccactagtacagatgacccgtttacacgtggcttccctcggaagccctcctcaacagtagctggtgtgaaagactaaatcagtagagttggaaaagctttataaccggtgtgtcatatgcttgctatttaaagctgtgtgttggttttgtttttctgccacattcactagttttttaataaatattttccaaaaatg

SEQ ID NO: 62241 - DNA, 2985 bp, Homo sapiens
ccgcccctgcccgcccgcgtccggtcccacccaccgtccacgctcccgccccgcctgaagttgcctttctcgtttgagctgagggacgcgtcagccaggcaccccggggtgtggccagaggacttcggcgacgcttccccgagagtagcccccctcctcaacccagaaaagacaaccccgcggggctgcagcgagccaggcatgctcactggcgcaggcccggcccgcagcccgagcaggaagcgccggcgctaggcggccccctgcgctgccagctggagccgggcggagccagcgccccggcgcagggtggctctgccagtccccgcgcgcctgggcggccgcacacgtgtccaggcgtcacgtccgcgcgcgcccccggggcttgcgtcagcggctgttccagaagcgggtgggccagggctctgcgcaccgctggggttcggggcccgggacgccgccgggaggagggcaccgcgcggggtccgacgcggaggcgtgctcggaacgccgggggctgcggagtgcatcagcgcggtccagccctccgcctgccgggcgccgagcgtctccgccgcccggacctgggctgggcgccgtggcgttgcctcggagctcgctgcccgcggggcgcgcaccgccttgacccgggcggccccgcggcaggcaggcgcccgcagttccatggttggttcggagcgcgatgagccgcccgtcctccaccggccccagcgctaataaaccctgcagcaagcagccgccgccgcagccccagcacactccgtccccggctgcgcccccggccgccgccaccatctcggctgcgggccccggctcgtccgcggtgcccgccgcggcggcggtgatctcgggccccggcggcggcggcggggccggcccggtgtccccgcagcaccacgagctgacctcgctcttcgagtgtccggtctgctttgactatgtcctgcctcctattctgcagtgccaggccgggcacctggtgtgtaaccaatgccgccagaagttgagctgctgcccgacgtgcaggggcgccctgacgcccagcatcaggaacctggctatggagaaggtggcctcggcagtcctgtttccctgtaagtatgccaccacgggctgttccctgaccctgcaccatacggagaaaccagaacatgaagacatatgtgaataccgtccctactcctgcccatgtcctggtgcttcctgcaagtggcaggggtccctggaagctgtgatgtcccatctcatgcacgcccacaagagcattaccacccttcagggagaagacatcgtctttctagctacagacattaacttgccaggggctgtcgactgggtgatgatgcagtcatgttttggccatcacttcatgctggtgctggagaaacaagagaagtacgaaggccaccagcagttttttgccatcgtcctgctcattggcacccgcaagcaagccgagaactttgcctacagactggagttgaatgggaaccggcggagattgacctgggaggccacgccccgttcgattcatgacggtgtggctgcggccatcatgaacagcgactgccttgttttcgacacagccatagcacatctttttgcagataatgggaaccttggaatcaatgttactatttctacatgttgtccatgatgtgactttcgtaaaccttcaaaattatttgggcatagtgctctatgtttaataaaggtttttatagatgttttattccatatgtcttcacaagtcaggacccacaattacccgtgttttgtttgaacagcagtgtcccatctggcttcgacccaacaaagttcattaacctgggatgaatggggttggcctgttggtgatttggatgctgttctgtgatctaaaacaactcttattgaattgtatttactccctaaacaacacttgacaggctgttgcacagggcttctatagatcagtgtgttaggaatgggaggccccttcctgcctgccttcccatattggtcccttgacattgacaaaagcacagtgactgtcagcagattcctttacttttgtttgtgggaggtaggaattgttttaatgcattttaaacagtgtttctgaaattggatggctggctaatagacactgaatcacccggagtgcttatcttaaaattgcagatttagggagcctgccaatttaacagtctcatcaggtgattcttttcaacagtaatgtttgagaattactgggttaaattgtgggaaagggtccagattttaaaggtgctttaaggttgccctctgccgatactgtttgtctttctactgtttcatcccctaacttcccccaaccctcaaattaaaactagaactatagatccacatgaacgcacgcctgagatttggccactcacctatgttttgggtggattgcctaggaaagcaagtcatatggccattgatagttctcatgtaattagttttgctcaccactagtacagatgacccgtttacacgtggcttccctcggaagccctcctcaacagtagctggtgtgaaagactaaatcagtagagttggaaaagctttataaccggtgtgtcatatgcttgctatttaaagctgtgtgttggttttgtttttctgccacattcactagttttttaataaatattttccaaaaatgaaaaaaaaaaaaaaaaaatagagaaaaaacaacaaacacagacaaaaaaaaacaacacaaaagggggcagaaaaacacagagagcaataaaacacaatttaaaagggccaagaagaaaataaaaagggcgcaaaaacggaagaaacaagggatatgaagaacctggggggaaaaaaaccaaacaaagagcgcgaaaaaaagtgtggaacacaatgggagtggttaacaacacgacaaagagagcatagaacaaagggggaaagtgagaatgacaaagatcaacgataaagacc

SEQ ID NO: 62242 - DNA, 2772 bp, Homo sapiens
ccgcccctgcccgcccgcgtccggtcccacccaccgtccacgctcccgccccgcctgaagttgcctttctcgtttgagctgagggacgcgtcagccaggcaccccggggtgtggccagaggacttcggcgacgcttccccgagagtagcccccctcctcaacccagaaaagacaaccccgcggggctgcagcgagccaggcatgctcactggcgcaggcccggcccgcagcccgagcaggaagcgccggcgctaggcggccccctgcgctgccagctggagccgggcggagccagcgccccggcgcagggtggctctgccagtccccgcgcgcctgggcggccgcacacgtgtccaggcgtcacgtccgcgcgcgcccccggggcttgcgtcagcggctgttccagaagcgggtgggccagggctctgcgcaccgctggggttcggggcccgggacgccgccgggaggagggcaccgcgcggggtccgacgcggaggcgtgctcggaacgccgggggctgcggagtgcatcagcgcggtccagccctccgcctgccgggcgccgagcgtctccgccgcccggacctgggctgggcgccgtggcgttgcctcggagctcgctgcccgcggggcgcgcaccgccttgacccgggcggccccgcggcaggcaggcgcccgcagttccatggttggttcggagcgcgatgagccgcccgtcctccaccggccccagcgctaataaaccctgcagcaagcagccgccgccgcagccccagcacactccgtccccggctgcgcccccggccgccgccaccatctcggctgcgggccccggctcgtccgcggtgcccgccgcggcggcggtgatctcgggccccggcggcggcggcggggccggcccggtgtccccgcagcaccacgagctgacctcgctcttcgagtgtccggtctgctttgactatgtcctgcctcctattctgcagtgccaggccgggcacctggtgtgtaaccaatgccgccagaagttgagctgctgcccgacgtgcaggggcgccctgacgcccagcatcaggaacctggctatggagaaggtggcctcggcagtcctgtttccctgtaagtatgccaccacgggctgttccctgaccctgcaccatacggagaaaccagaacatgaagacatatgtgaataccgtccctactcctgcccatgtcctggtgcttcctgcaagtggcaggggtccctggaagctgtgatgtcccatctcatgcacgcccacaagagcattaccacccttcagggagaagacatcgtctttctagctacagacattaacttgccaggggctgtcgactgggtgatgatgcagtcatgttttggccatcacttcatgctggtgctggagaaacaagagaagtacgaaggccaccagcagttttttgccatcgtcctgctcattggcacccgcaagcaagccgagaactttgcctacagactggagttgaatgggaaccggcggagattgacctgggaggccacgccccgttcgattcatgacggtgtggctgcggccatcatgaacagcgactgccttgttttcgacacagccatagcacatctttttgcagataatgggaaccttggaatcaatgttactatttctacatgttgtccatgatgtgactttcgtaaaccttcaaaattatttgggcatagtgctctatgtttaataaaggtttttatagatgttttattccatatgtcttcacaagtcaggacccacaattacccgtgttttgtttgaacagcagtgtcccatctggcttcgacccaacaaagttcattaacctgggatgaatggggttggcctgttggtgatttggatgctgttctgtgatctaaaacaactcttattgaattgtatttactccctaaacaacacttgacaggctgttgcacagggcttctatagatcagtgtgttaggaatgggaggccccttcctgcctgccttcccatattggtcccttgacattgacaaaagcacagtgactgtcagcagattcctttacttttgtttgtgggaggtaggaattgttttaatgcattttaaacagtgtttctgaaattggatggctggctaatagacactgaatcacccggagtgcttatcttaaaattgcagatttagggagcctgccaatttaacagtctcatcaggtgattcttttcaacagtaatgtttgagaattactgggttaaattgtgggaaagggtccagattttaaaggtgctttaaggttgccctctgccgatactgtttgtctttctactgtttcatcccctaacttcccccaaccctcaaattaaaactagaactatagatccacatgaacgcacgcctgagatttggccactcacctatgttttgggtggattgcctaggaaagcaagtcatatggccattgatagttctcatgtaattagttttgctcaccactagtacagatgacccgtttacacgtggcttccctcggaagccctcctcaacagtagctggtgtgaaagactaaatcagtagagttggaaaagctttataaccggtgtgtcatatgcttgctatttaaagctgtgtgttggttttgtttttctgccacattcactagttttttaataaatattttccaaaaatgatggcagaaaggacttggcagccttttagggaccctggggggggggccgggtccccaatcccccttatgtgagtgatatt

SEQ ID NO: 62243 - DNA, 919 bp, Homo sapiens
agttcattaacctgggatgaactttgttgggtcgaagccagatgggacactgctgttccaacaaagttcattaacctgggatgaatggggttggcctgttggtgatttggatgctgttctgtgatctaaaacaactcttattgaattgtatttactccctaaacaacacttgacaggctgttgcacagggcttctatagatcagtgtgttaggaatgggaggccccttcctgcctgccttcccatattggtcccttgacattgacaaaagcacagtgactgtcagcagattcctttacttttgtttgtgggaggtaggaattgttttaatgcattttaaacagtgtttctgaaattggatggctggctaatagacactgaatcacccggagtgcttatcttaaaattgcagatttagggagcctgccaatttaacagtctcatcaggtgattcttttcaacagtaatgtttgagaattactgggttaaattgtgggaaagggtccagattttaaaggtgctttaaggttgccctctgccgatactgtttgtctttctactgtttcatcccctaacttcccccaaccctcaaattaaaactagaactatagatccacatgaacgcacgcctgagatttggccactcacctatgttttgggtggattgcctaggaaagcaagtcatatggccattgatagttctcatgtaattagttttgctcaccactagtacagatgacccgtttacacgtggcttccctcggaagccctcctcaacagtagctggtgtgaaagactaaatcagtagagttggaaaagctttataaccggtgtgtcatatgcttgctatttaaagctgtgtgttggttttgtttttctgccacattcactagttttttaataaatattttccaaaaatg

SEQ ID NO: 62244 - DNA, 921 bp, Homo sapiens
catactagtttaactatgcagtacccatgtagtggcagtgtccatctggtcttcgactccatacacacttcattaatcctcgttttaattgctttcgcctgattaaatttttatccttaactgtgatctaaaacaactcttattgaattgtatttactccctaaacaacacttgacaggctgttgcacagggcttctatagatcagtgtgttaggaatgggaggccccttcctgcctgccttcccatattggtcccttgacattgacaaaagcacagtgactgtcagcagattcctttacttttgtttgtgggaggtaggaattgttttaatgcattttaaacagtgtttctgaaattggatggctggctaatagacactgaatcacccggagtgcttatcttaaaattgcagatttagggagcctgccaatttaacagtctcatcaggtgattcttttcaacagtaatgtttgagaattactgggttaaattgtgggaaagggtccagattttaaaggtgctttaaggttgccctctgccgatactgtttgtctttctactgtttcatcccctaacttcccccaaccctcaaattaaaactagaactatagatccacatgaacgcacgcctgagatttggccactcacctatgttttgggtggattgcctaggaaagcaagtcatatggccattgatagttctcatgtaattagttttgctcaccactagtacagatgacccgtttacacgtggcttccctcggaagccctcctcaacagtagctggtgtgaaagactaaatcagtagagttggaaaagctttataaccggtgtgtcatatgcttgctatttaaagctgtgtgttggttttgtttttctgccacattcactagttttttaataaatattttccaaaaatg

SEQ ID NO: 62245 - DNA, 1956 bp, Homo sapiens
  misc_feature (1629)..(1629): n is a, c, g, or t
  misc_feature (1674)..(1674): n is a, c, g, or t
  misc_feature (1680)..(1680): n is a, c, g, or t
  misc_feature (1694)..(1695): n is a, c, g, or t
  misc_feature (1708)..(1708): n is a, c, g, or t
ccgcccctgcccgcccgcgtccggtcccacccaccgtccacgctcccgccccgcctgaagttgcctttctcgtttgagctgagggacgcgtcagccaggcaccccggggtgtggccagaggacttcggcgacgcttccccgagagtagcccccctcctcaacccagaaaagacaaccccgcggggctgcagcgagccaggcatgctcactggcgcaggcccggcccgcagcccgagcaggaagcgccggcgctaggcggccccctgcgctgccagctggagccgggcggagccagcgccccggcgcagggtggctctgccagtccccgcgcgcctgggcggccgcacacgtgtccaggcgtcacgtccgcgcgcgcccccggggcttgcgtcagcggctgttccagaagcgggtgggccagggctctgcgcaccgctggggttcggggcccgggacgccgccgggaggagggcaccgcgcggggtccgacgcggaggcgtgctcggaacgccgggggctgcggagtgcatcagcgcggtccagccctccgcctgccgggcgccgagcgtctccgccgcccggacctgggctgggcgccgtggcgttgcctcggagctcgctgcccgcggggcgcgcaccgccttgacccgggcggccccgcggcaggcaggcgcccgcagttccatggttggttcggagcgcgatgagccgcccgtcctccaccggccccagcgctaataaaccctgcagcaagcagccgccgccgcagccccagcacactccgtccccggctgcgcccccggccgccgccaccatctcggctgcgggccccggctcgtccgcggtgcccgccgcggcggcggtgatctcgggccccggcggcggcggcggggccggcccggtgtccccgcagcaccacgagctgacctcgctcttcgagtgtccggtctgctttgactatgtcctgcctcctattctgcagtgccaggccgggcacctggtgtgtaaccaatgccgccagaagttgagctgctgcccgacgtgcaggggcgccctgacgcccagcatcaggaacctggctatggagaaggtggcctcggcagtcctgtttccctgtaagtatgccaccacgggctgttccctgaccctgcaccatacggagaaaccagaacatgaagacatatgtgaataccgtccctactcctgcccatgtcctggtgcttcctgcaagtggcaggggtccctggaagctgtgatgtcccatctcatgcacgcccacaagagcattaccacccttcagggagaagacatcgtctttctagctacagacattaacttgccaggggctgtcgactgggtgatgatgcagtcatgttttggccatcacttcatgctggtgctggagaaacaagagaagtacgaaggccaccagcagttttttgccatcgtcctgctcattggcacccgcaagcaagccgagaactttgcctacagactggagttgaatgggaaccggcggagattgacctgggaggccacgccccgttcgattcatgacggtgtggctgcggccatcatgaacagcgactgctgttcgaacagctagacatctttgcgatatggaacctngatcattactatctactgtgccatgaggactcgtacctcaatatnggctangctatgtataagtnnatgagtatcatgntacagagaccaataccgttgtgacagagcattgttacacaagatactgagagggtgcttgatgagcgtggcaaactttgtgtctctaaactaggtgcagttttaggtgagagctctccccttctcttataaagcaatcttttgggagagtaaacaggggggccacacaccgtaagaggacccaccttgtcacattgggagaaatgggctgtttccccaaaacacgcgctgggagagttctcccccccc

SEQ ID NO: 62246 - DNA, 3044 bp, Homo sapiens
ccgcccctgcccgcccgcgtccggtcccacccaccgtccacgctcccgccccgcctgaagttgcctttctcgtttgagctgagggacgcgtcagccaggcaccccggggtgtggccagaggacttcggcgacgcttccccgagagtagcccccctcctcaacccagaaaagacaaccccgcggggctgcagcgagccaggcatgctcactggcgcaggcccggcccgcagcccgagcaggaagcgccggcgctaggcggccccctgcgctgccagctggagccgggcggagccagcgccccggcgcagggtggctctgccagtccccgcgcgcctgggcggccgcacacgtgtccaggcgtcacgtccgcgcgcgcccccggggcttgcgtcagcggctgttccagaagcgggtgggccagggctctgcgcaccgctggggttcggggcccgggacgccgccgggaggagggcaccgcgcggggtccgacgcggaggcgtgctcggaacgccgggggctgcggagtgcatcagcgcggtccagccctccgcctgccgggcgccgagcgtctccgccgcccggacctgggctgggcgccgtggcgttgcctcggagctcgctgcccgcggggcgcgcaccgccttgacccgggcggccccgcggcaggcaggcgcccgcagttccatggttggttcggagcgcgatgagccgcccgtcctccaccggccccagcgctaataaaccctgcagcaagcagccgccgccgcagccccagcacactccgtccccggctgcgcccccggccgccgccaccatctcggctgcgggccccggctcgtccgcggtgcccgccgcggcggcggtgatctcgggccccggcggcggcggcggggccggcccggtgtccccgcagcaccacgagctgacctcgctcttcgagtgtccggtctgctttgactatgtcctgcctcctattctgcagtgccaggccgggcacctggtgtgtaaccaatgccgccagaagttgagctgctgcccgacgtgcaggggcgccctgacgcccagcatcaggaacctggctatggagaaggtggcctcggcagtcctgtttccctgtaagtatgccaccacgggctgttccctgaccctgcaccatacggagaaaccagaacatgaagacatatgtgaataccgtccctactcctgcccatgtcctggtgcttcctgcaagtggcaggggtccctggaagctgtgatgtcccatctcatgcacgcccacaagagcattaccacccttcagggagaagacatcgtctttctagctacagacattaacttgccaggggctgtcgactgggtgatgatgcagtcatgttttggccatcacttcatgctggtgctggagaaacaagagaagtacgaaggccaccagcagttttttgccatcgtcctgctcattggcacccgcaagcaagccgagaactttgcctacagactggagttgaatgggaaccggcggagattgacctgggaggccacgccccgttcgattcatgacggtgtggctgcggccatcatgaacagcgactgccttgttttcgacacagccatagcacatctttttgcagataatgggaaccttggaatcaatgttactatttctacatgttgtccatgatgtgactttcgtaaaccttcaaaattatttgggcatagtgctctatgtttaataaaggtttttatagatgttttattccatatgtcttcacaagtcaggacccacaattacccgtgttttgtttgaacagcagtgtcccatctggcttcgacccaacaaagttcattaacctgggatgaatggggttggcctgttggtgatttggatgctgttctgtgatctaaaacaactcttattgaattgtatttactccctaaacaacacttgacaggctgttgcacagggcttctatagatcagtgtgttaggaatgggaggccccttcctgcctgccttcccatattggtcccttgacattgacaaaagcacagtgactgtcagcagattcctttacttttgtttgtgggaggtaggaattgttttaatgcattttaaacagtgtttctgaaattggatggctggctaatagacactgaatcacccggagtgcttatcttaaaattgcagatttagggagcctgccaatttaacagtctcatcaggtgattcttttcaacagtaatgtttgagaattactgggttaaattgtgggaaagggtccagattttaaaggtgctttaaggttgccctctgccgatactgtttgtctttctactgtttcatcccctaacttcccccaaccctcaaattaaaactagaactatagatccacatgaacgcacgcctgagatttggccactcacctatgttttgggtggattgcctaggaaagcaagtcatatggccattgatagttctcatgtaattagttttgctcaccactagtacagatgacccgtttacacgtggcttccctcggaagccctcctcaacagtagctggtgtgaaagactaaatcagtagagttggaaaagctttataaccggtgtgtcatatgcttgctatttaaagctgtgtgttggttttgtttttctgccacattcactagttttttaataaatattttccaaaaatgaacacaaaaaaacacacaaacaaaaagggggggggcaaaaagaaccccggggggccacattacggccccctttgtgcaagggcccacaaggggcgaaaaagagggcgggcggaacacggggggaaacggcccgcgtgtccgggggggacccccccgggggtgcaagggaacccccagagaaggcccgggaaaaacatgctggggaaccttcccggcgtagtgtataacactacatcactacaacaacaccgcgacgacacaacagataagaaccacacacaaaaccccagcacaccgaccacacaccaaacacacacacaacagacaacaacagacacaacaacgacacaac

SEQ ID NO: 62247 - DNA, 2302 bp, Homo sapiens
ccgcccctgcccgcccgcgtccggtcccacccaccgtccacgctcccgccccgcctgaagttgcctttctcgtttgagctgagggacgcgtcagccaggcaccccggggtgtggccagaggacttcggcgacgcttccccgagagtagcccccctcctcaacccagaaaagacaaccccgcggggctgcagcgagccaggcatgctcactggcgcaggcccggcccgcagcccgagcaggaagcgccggcgctaggcggccccctgcgctgccagctggagccgggcggagccagcgccccggcgcagggtggctctgccagtccccgcgcgcctgggcggccgcacacgtgtccaggcgtcacgtccgcgcgcgcccccggggcttgcgtcagcggctgttccagaagcgggtgggccagggctctgcgcaccgctggggttcggggcccgggacgcccgccgcggcggcggtgatctcgggccccggcggcggcggcggggccggcccggtgtccccgcagcaccacgagctgacctcgctcttcgagtgtccggtctgctttgactatgtcctgcctcctattctgcagtgccaggccgggcacctggtgtgtaaccaatgccgccagaagttgagctgctgcccgacgtgcaggggcgccctgacgcccagcatcaggaacctggctatggagaaggtggcctcggcagtcctgtttccctgtaagtatgccaccacgggctgttccctgaccctgcaccatacggagaaaccagaacatgaagacatatgtgaataccgtccctactcctgcccatgtcctggtgcttcctgcaagtggcaggggtccctggaagctgtgatgtcccatctcatgcacgcccacaagagcattaccacccttcagggagaagacatcgtctttctagctacagacattaacttgccaggggctgtcgactgggtgatgatgcagtcatgttttggccatcacttcatgctggtgctggagaaacaagagaagtacgaaggccaccagcagttttttgccatcgtcctgctcattggcacccgcaagcaagccgagaactttgcctacagactggagttgaatgggaaccggcggagattgacctgggaggccacgccccgttcgattcatgacggtgtggctgcggccatcatgaacagcgactgccttgttttcgacacagccatagcacatctttttgcagataatgggaaccttggaatcaatgttactatttctacatgttgtccatgatgtgactttcgtaaaccttcaaaattatttgggcatagtgctctatgtttaataaaggtttttatagatgttttattccatatgtcttcacaagtcaggacccacaattacccgtgttttgtttgaacagcagtgtcccatctggcttcgacccaacaaagttcattaacctgggatgaatggggttggcctgttggtgatttggatgctgttctgtgatctaaaacaactcttattgaattgtatttactccctaaacaacacttgacaggctgttgcacagggcttctatagatcagtgtgttaggaatgggaggccccttcctgcctgccttcccatattggtcccttgacattgacaaaagcacagtgactgtcagcagattcctttacttttgtttgtgggaggtaggaattgttttaatgcattttaaacagtgtttctgaaattggatggctggctaatagacactgaatcacccggagtgcttatcttaaaattgcagatttagggagcctgccaatttaacagtctcatcaggtgattcttttcaacagtaatgtttgagaattactgggttaaattgtgggaaagggtccagattttaaaggtgctttaaggttgccctctgccgatactgtttgtctttctactgtttcatcccctaacttcccccaaccctcaaattaaaactagaactatagatccacatgaacgcacgcctgagatttggccactcacctatgttttgggtggattgcctaggaaagcaagtcatatggccattgatagttctcatgtaattagttttgctcaccactagtacagatgacccgtttacacgtggcttccctcggaagccctcctcaacagtagctggtgtgaaagactaaatcagtagagttggaaaagctttataaccggtgtgtcatatgcttgctatttaaagctgtgtgttggttttgtttttctgccacattcactagttttttaataaatattttccaaaaatg

SEQ ID NO: 62248 - DNA, 2076 bp, Homo sapiens
ccgcccctgcccgcccgcgtccggtcccacccaccgtccacgctcccgccccgcctgaagttgcctttctcgtttgagctgagggacgcgtcagccaggcaccccggggtgtggccagaggacttcggcgacgcttccccgagagtagcccccctcctcaacccagaaaagacaaccccgcggggctgcagcgagccaggcatgctcactggcgcaggcccggcccgcagcccgagcaggaagcgccggcgctaggcggccccctgcgctgccagctggagccgggcggagccagcgccccggcgcagggtggctctgccagtccccgcgcgcctgggcggccgcacacgtgtccaggcgtcacgtccgcgcgcgcccccggggcttgcgtcagcggctgttccagaagcgggtgggccagggctctgcgcaccgctggggttcggggcccgggacgccgccgggaggagggcaccgcgcggggtccgacgcggaggcgtgctcggaacgccgggggctgcggagtgcatcagcgcggtccagccctccgcctgccgggcgccgagcgtctccgccgcccggacctgggctgggcgccgtggcgttgcctcggagctcgctgcccgcggggcgcgcaccgccttgacccgggcggccccgcggcaggcaggcgcccgcagttccatggttggttcggagcgcgatgagccgcccgtcctccaccggccccagcgctaataaaccctgcagcaagcagccgccgccgcagccccagcacactccgtccccggctgcgcccccggccgccgccaccatctcggctgcgggccccggctcgtccgcggtgcccgccgcggcggcggtgatctcgggccccggcggcggcggcggggccggcccggtgtccccgcagcaccacgagctgacctcgctcttcgagtgtccggtctgctttgactatgtcctgcctcctattctgcagtgccaggccgggcacctggtgtgtaaccaatgccgccagaagttgagctgctgcccgacgtgcaggggcgccctgacgcccagcatcaggaacctggctatggagaaggtggcctcggcagtcctgtttccctgtaagtatgccaccacgggctgttccctgaccctgcaccatacggagaaaccagaacatgaagacatatgtgaataccgtccctactcctgcccatgtcctggtgcttcctgcaagtggcaggggtccctggaagctgtgatgtcccatctcatgcacgcccacaagagcattaccacccttcagggagaagacatcgtctttctagctacagacattaacttgccaggggctgtcgactgggtgatgatgcagtcatgttttggccatcacttcatgctggtgctggagaaacaagagaagtacgaaggccaccagcagttttttgccatcgtcctgctcattggcacccgcaagcaagccgagaactttgcctacagactggagttgaatgggaaccggcggagattgacctgggaggccacgccccgttcgattcatgacggtgtggctgcggccatcatgaacagcgactgccttgttttcgacacagccatagcacatctttttgcagataatgggaaccttggaatcaatgttactatttctacatgttgtccatgatgtgactttcgtaaaccttcaaaattatttgggcatagtgctctatgtttaataaaggtttttatagatgttttattccatatgtcttcacaagtcaggacccacaattacccgtgttttgtttgaacagcagtgtcccatctggcttcgacccaacaaagttcattaacctgggatgaatggggttggcctgttggtgatttggatgctgttctgtgatctaaaacaactcttattgaattgtatttactccctaaacaacacttgacaggctgttgcacagggcttctatagatcagtgtgttaggaatgggaggccccttcctgcctgccttccccctttgtgccctcgcccttccccccgctcagatgcttgtaacatgatccctttcctttcg

SEQ ID NO: 62249 - DNA, 325 bp, Homo sapiens
atggatccatgcgagccaggtgcacccggatcctggcatccatcctggcaaacacctggagggctgccttggacacaggccaggagcagacccttgggccgcccttccaaggcctgagcagccaggttaagggaggacggttcttcaggctgcgacactggctgtcccatgtcctgtaggtgctcagggccctcgccaggcctggaggtggctcaggggtggggaagagctgtccccagccaggtgagcagggccatgaccgcgctcctgctgctctgggaggctgggccctgtcaagcctgtgagtcttcttggtaggccaggt

SEQ ID NO: 62250 - DNA, 1837 bp, Homo sapiens
atccccggtgaaaactgcgggctccgagctgggtgcagcaaccggaggcggcggcgcgtctggaggaggctgcagcagcggaagaccccagtccagatccaggactgagatcccagaaccatgaacctggccatcagcatcgctctcctgctaacagtcttgcaggtctcccgagggcagaaggtgaccagcctaacggcctgcctagtggaccagagccttcgtctggactgccgccatgagaataccagcagttcacccatccagtacgagttcagcctgacccgtgagacaaagaagcacgtgctctttggcactgtgggggtgcctgagcacacataccgctcccgaaccaacttcaccagcaaatacaacatgaaggtcctctacttatccgccttcactagcaaggacgagggcacctacacgtgtgcactccaccactctggccattccccacccatctcctcccagaacgtcacagtgctcagagacaaactggtcaagtgtgagggcatcagcctgctggctcagaacacctcgtggctgctgctgctcctgctctccctctccctcctccaggccacggatttcatgtccctgtgactggtggggcccatggaggagacaggaagcctcaagttccagtgcagagatcctacttctctgagtcagctgaccccctccccgcaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccttttctttgagagttcgtgaagagggaagccaggattggggacctgatggagagtgagagcatgtgaggggtagtgggatggtggggtaccagccactggaggggtcatccttgcccatcgggaccagaaacctgggagagacttggatgaggagtggttgggctgtgcctgggcctagcacggacatggtctgtcctgacagcactcctcggcaggcatggctggtgcctgaagaccccagatgtgagggcaccaccaagaatttgtggcctaccttgtgagggagagaactgagcatctccagcattctcagccacaaccaaaaaaaaataaaaagggcagccctccttaccactgtggaagtccctcagaggccttggggcatgacccagtgaagatgcaggtttgaccaggaaagcagcgctagtggagggttggagaaggaggtaaaggatgagggttcatcatccctccctgcctaaggaagctaaaagcatggccctgctgcccctccctgcctccacccacagtggagagggctacaaaggaggacaagaccctctcaggctgtcccaagctcccaagagcttccagagctctgacccacagcctccaagtcaggtggggtggagtcccagagctgcacagggtttggcccaagtttctaagggaggcacttcctcccctcgcccatcagtgccagcccctgctggctggtgcctgagcccctcagacagccccctgccccgcaggcctgccttctcagggacttctgcggggcctgaggcaagccatggagtgagacccaggagccggacacttctcaggaaatggcttttcccaacccccagcccccacccggtggttcttcctgttctgtgactgtgtatagtgccaccacagcttatggcatctcattgaggacaaagaaaactgcacaataaaaccaagcctctggaatctg

SEQ ID NO: 62251 - DNA, 197 bp, Homo sapiens
tcaagcttctaacgatgtacggggccatggagtgagacccaggagccggacacttctcaggaaatggcttttcccaacccccagcccccacccggtggttcttcctgttctgtgactgtgtatagtgccaccacagcttatggcatctcattgaggacaaagaaaactgcacaataaaaccaagcctctggaatctg

SEQ ID NO: 62252 - DNA, 2427 bp, Homo sapiens
atccccggtgaaaactgcgggctccgagctgggtgcagcaaccggaggcggcggcgcgtctggaggaggctgcagcagcggaagaccccagtccagatccaggactgagatcccagaaccatgaacctggccatcagcatcgctctcctgctaacagtcttgcaggtctcccgagggcagaaggtgaccagcctaacggcctgcctagtggaccagagccttcgtctggactgccgccatgagaataccagcagttcacccatccagtacgagttcagcctgacccgtgagacaaagaagcacgtgctctttggcactgtgggggtgcctgagcacacataccgctcccgaaccaacttcaccagcaaatacaacatgaaggtcctctacttatccgccttcactagcaaggacgagggcacctacacgtgtgcactccaccactctggccattccccacccatctcctcccagaacgtcacagtgctcagagacaaactggtcaagtgtgagggcatcagcctgctggctcagaacacctcgtggctgctgctgctcctgctctccctctccctcctccaggccacggatttcatgtccctgtgactggtggggcccatggaggagacaggaagcctcaagttccagtgcagagatcctacttctctgagtcagctgaccccctccccgcaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccttttctttgagagttcgtgaagagggaagccaggattggggacctgatggagagtgagagcatgtgaggggtagtgggatggtggggtaccagccactggaggggtcatccttgcccatcgggaccagaaacctgggagagacttggatgaggagtggttgggctgtgcctgggcctagcacggacatggtctgtcctgacagcactcctcggcaggcatggctggtgcctgaagaccccagatgtgagggcaccaccaagaatttgtggcctaccttgtgagggagagaactgagcatctccagcattctcagccacaaccaaaaaaaaataaaaagggcagccctccttaccactgtggaagtccctcagaggccttggggcatgacccagtgaagatgcaggtttgaccaggaaagcagcgctagtggagggttggagaaggaggtaaaggatgagggttcatcatccctccctgcctaaggaagctaaaagcatggccctgctgcccctccctgcctccacccacagtggagagggctacaaaggaggacaagaccctctcaggctgtcccaagctcccaagagcttccagagctctgacccacagcctccaagtcaggtggggtggagtcccagagctgcacagggtttggcccaagtttctaagggaggcacttcctcccctcgcccatcagtgccagcccctgctggctggtgcctgagcccctcagacagccccctgccccgcaggcctgccttctcagggacttctgcggggcctgaggcaagccatggagtgagacccaggagccggacacttctcaggaaatggcttttcccaacccccagcccccacccggtggttcttcctgttctgtgactgtgtatagtgccaccacagcttatggcatctcattgaggacaaagaaaactgcacaataaaaccaagcctctggaatctgaaaaaaaaaaaaacaaaaaaaaaaaaaaaaaaaaaaaaaaaaaaaaaaaaaaaacaaaccaacagaaaaaaaaaaaaaaaaaaaaaaacacaaacaacaaacaacacaccaaaaaagcaggcgggggggaggcacatagcccacccacgccacacacagcccacaccgccactataaagcctggagacagcggggagaccatacggggaacgacagcacagcaaggaggagcgaggcgacaaaagatgaacaaaggaggcgggggtcaaaagagcgcgctacccgcgcgcgcctcctctggagccagaccgcagcacctgtccgagggaggagagagcaagcggccacagccacacccccagccccactcccctgatccaaggaaactctgacagcgtgctacgtactcagtcggcacctctactacaccgcacgcacatcgctagagcgacatcacctgatgcggccgccacagcgatacaccacacctacccagttcagagcgcgtcgacgagagaaagcgagcggaccgcaccacgcaagcagccagtagcgcagcgatacgaagcaaagcccaacttcccccagcg

SEQ ID NO: 62253 - DNA, 2190 bp, Homo sapiens
atccccggtgaaaactgcgggctccgagctgggtgcagcaaccggaggcggcggcgcgtctggaggaggctgcagcagcggaagaccccagtccagatccaggactgagatcccagaaccatgaacctggccatcagcatcgctctcctgctaacagtcttgcaggtctcccgagggcagaaggtgaccagcctaacggcctgcctagtggaccagagccttcgtctggactgccgccatgagaataccagcagttcacccatccagtacgagttcagcctgacccgtgagacaaagaagcacgtgctctttggcactgtgggggtgcctgagcacacataccgctcccgaaccaacttcaccagcaaatacaacatgaaggtcctctacttatccgccttcactagcaaggacgagggcacctacacgtgtgcactccaccactctggccattccccacccatctcctcccagaacgtcacagtgctcagagacaaactggtcaagtgtgagggcatcagcctgctggctcagaacacctcgtggctgctgctgctcctgctctccctctccctcctccaggccacggatttcatgtccctgtgactggtggggcccatggaggagacaggaagcctcaagttccagtgcagagatcctacttctctgagtcagctgaccccctccccgcaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccttttctttgagagttcgtgaagagggaagccaggattggggacctgatggagagtgagagcatgtgaggggtagtgggatggtggggtaccagccactggaggggtcatccttgcccatcgggaccagaaacctgggagagacttggatgaggagtggttgggctgtgcctgggcctagcacggacatggtctgtcctgacagcactcctcggcaggcatggctggtgcctgaagaccccagatgtgagggcaccaccaagaatttgtggcctaccttgtgagggagagaactgagcatctccagcattctcagccacaaccaaaaaaaaataaaaagggcagccctccttaccactgtggaagtccctcagaggccttggggcatgacccagtgaagatgcaggtttgaccaggaaagcagcgctagtggagggttggagaaggaggtaaaggatgagggttcatcatccctccctgcctaaggaagctaaaagcatggccctgctgcccctccctgcctccacccacagtggagagggctacaaaggaggacaagaccctctcaggctgtcccaagctcccaagagcttccagagctctgacccacagcctccaagtcaggtggggtggagtcccagagctgcacagggtttggcccaagtttctaagggaggcacttcctcccctcgcccatcagtgccagcccctgctggctggtgcctgagcccctcagacagccccctgccccgcaggcctgccttctcagggacttctgcggggcctgaggcaagccatggagtgagacccaggagccggacacttctcaggaaatggcttttcccaacccccagcccccacccggtggttcttcctgttctgtgactgtgtatagtgccaccacagcttatggcatctcattgaggacaaagaaaactgcacaataaaaccaagcctctggaatctgctcgtgtccacctggccttcgctcctccagcagtgcctgcctgcccccgcttcgctggggtctccacgggtgaggctggggaacgccacctcttcctcttccctgacttctccccaaccacttagtagcaacgctaccccaggggctaatgactgcacactgggcttcttttcagaatgaccctaacgagacacatttgcccaaataaacgaacatcccatgtctgctgactcacctggctggaacaacatgcttactgccaacatgtgggccgaaccacatggccctggctctggaatgcacaagtggctttgcgtgaatctgcgctaagctatgcagtctgctttttcttc

SEQ ID NO: 62254 - DNA, 2035 bp, Homo sapiens
atccccggtgaaaactgcgggctccgagctgggtgcagcaaccggaggcggcggcgcgtctggaggaggctgcagcagcggaagaccccagtccagatccaggactgagatcccagaaccatgaacctggccatcagcatcgctctcctgctaacagtcttgcaggtctcccgagggcagaaggtgaccagcctaacggcctgcctagtggaccagagccttcgtctggactgccgccatgagaataccagcagttcacccatccagtacgagttcagcctgacccgtgagacaaagaagcacgtgctctttggcactgtgggggtgcctgagcacacataccgctcccgaaccaacttcaccagcaaatacaacatgaaggtcctctacttatccgccttcactagcaaggacgagggcacctacacgtgtgcactccaccactctggccattccccacccatctcctcccagaacgtcacagtgctcagagacaaactggtcaagtgtgagggcatcagcctgctggctcagaacacctcgtggctgctgctgctcctgctctccctctccctcctccaggccacggatttcatgtccctgtgactggtggggcccatggaggagacaggaagcctcaagttccagtgcagagatcctacttctctgagtcagctgaccccctccccgcaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccttttctttgagagttcgtgaagagggaagccaggattggggacctgatggagagtgagagcatgtgaggggtagtgggatggtggggtaccagccactggaggggtcatccttgcccatcgggaccagaaacctgggagagacttggatgaggagtggttgggctgtgcctgggcctagcacggacatggtctgtcctgacagcactcctcggcaggcatggctggtgcctgaagaccccagatgtgagggcaccaccaagaatttgtggcctaccttgtgagggagagaactgagcatctccagcattctcagccacaaccaaaaaaaaataaaaagggcagccctccttaccactgtggaagtccctcagaggccttggggcatgacccagtgaagatgcaggtttgaccaggaaagcagcgctagtggagggttggagaaggaggtaaaggatgagggttcatcatccctccctgcctaaggaagctaaaagcatggccctgctgcccctccctgcctccacccacagtggagagggctacaaaggaggacaagaccctctcaggctgtcccaagctcccaagagcttccagagctctgacccacagcctccaagtcaggtggggtggagtcccagagctgcacagggtttggcccaagtttctaagggaggcacttcctcccctcgcccatcagtgccagcccctgctggctggtgcctgagcccctcagacagccccctgccccgcaggcctgccttctcagggacttctgcggggcctgaggcaagccatggagtgagacccaggagccggacacttctcaggaaatggcttttcccaacccccagcccccacccggtggttcttcctgttctgtgactgtgtatagtgccacctcttcctcttccctgacttctccccaaccacttagtagcaacgctaccccaggggctaatgactgcacactgggcttcttttcagaatgaccctaacgagacacatttgcccaaataaacgaacatcccatgtctgctgactcacctggctggaacaacatgcttactgccaacatgtgggccgaaccacatggccctggctctggaatgcacaagtggctttgcgtgaatctgcgctaagctatgcagtctgctttttcttc

SEQ ID NO: 62255 - DNA, 1660 bp, Homo sapiens
atccccggtgaaaactgcgggctccgagctgggtgcagcaaccggaggcggcggcgcgtctggaggaggctgcagcagcggaagaccccagtccagatccaggactgagatcccagaaccatgaacctggccatcagcatcgctctcctgctaacagtcttgcaggtctcccgagggcagaaggtgaccagcctaacggcctgcctagtggaccagagccttcgtctggactgccgccatgagaataccagcagttcacccatccagtacgagttcagcctgacccgtgagacaaagaagcacgtgctctttggcactgtgggggtgcctgagcacacataccgctcccgaaccaacttcaccagcaaatacaacatgaaggtcctctacttatccgccttcactagcaaggacgagggcacctacacgtgtgcactccaccactctggccattccccacccatctcctcccagaacgtcacagtgctcagagacaaactggtcaagtgtgagggcatcagcctgctggctcagaacacctcgtggctgctgctgctcctgctctccctctccctcctccaggccacggatttcatgtccctgtgactggtggggcccatggaggagacaggaagcctcaagttccagtgcagagatcctacttctctgagtcagctgaccccctccccgcaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccttttctttgagagttcgtgaagagggaagccaggattggggacctgatggagagtgagagcatgtgaggggtagtgggatggtggggtaccagccactggaggggtcatccttgcccatcgggaccagaaacctgggagagacttggatgaggagtggttgggctgtgcctgggcctagcacggacatggtctgtcctgacagcactcctcggcaggcatggctggtgcctgaagaccccagatgtgagggcaccaccaagaatttgtggcctaccttgtgagggagagaactgagcatctccagcattctcagccacaaccaaaaaaaaataaaaagggcagccctccttaccactgtggaagtccctcagaggccttggggcatgacccagtgaagatgcaggtttgaccaggaaagcagcgctagtggagggttggagaaggaggtaaaggatgagggttcatcatccctccctgcccccgcttcgctggggtctccacgggtgaggctggggaacgccacctcttcctcttccctgacttctccccaaccacttagtagcaacgctaccccaggggctaatgactgcacactgggcttcttttcagaatgaccctaacgagacacatttgcccaaataaacgaacatcccatgtctgctgactcacctggctggaacaacatgcttactgccaacatgtgggccgaaccacatggccctggctctggaatgcacaagtggctttgcgtgaatctgcgctaagctatgcagtctgctttttcttc

SEQ ID NO: 62256 - DNA, 1801 bp, Homo sapiens
tcccgctgcgcggcaagtttggaaagggtgggccatgcagcagcggaagacccagtccagatccaggactgagatcccagaaccatgaacctggccatcagcatcgctctcctgctaacagtcttgcaggtctcccgagggcagaaggtgaccagcctaacggcctgcctagtggaccagagccttcgtctggactgccgccatgagaataccagcagttcacccatccagtacgagttcagcctgacccgtgagacaaagaagcacgtgctctttggcactgtgggggtgcctgagcacacataccgctcccgaaccaacttcaccagcaaatacaacatgaaggtcctctacttatccgccttcactagcaaggacgagggcacctacacgtgtgcactccaccactctggccattccccacccatctcctcccagaacgtcacagtgctcagagacaaactggtcaagtgtgagggcatcagcctgctggctcagaacacctcgtggctgctgctgctcctgctctccctctccctcctccaggccacggatttcatgtccctgtgactggtggggcccatggaggagacaggaagcctcaagttccagtgcagagatcctacttctctgagtcagctgaccccctccccgcaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccttttctttgagagttcgtgaagagggaagccaggattggggacctgatggagagtgagagcatgtgaggggtagtgggatggtggggtaccagccactggaggggtcatccttgcccatcgggaccagaaacctgggagagacttggatgaggagtggttgggctgtgcctgggcctagcacggacatggtctgtcctgacagcactcctcggcaggcatggctggtgcctgaagaccccagatgtgagggcaccaccaagaatttgtggcctaccttgtgagggagagaactgagcatctccagcattctcagccacaaccaaaaaaaaataaaaagggcagccctccttaccactgtggaagtccctcagaggccttggggcatgacccagtgaagatgcaggtttgaccaggaaagcagcgctagtggagggttggagaaggaggtaaaggatgagggttcatcatccctccctgcctaaggaagctaaaagcatggccctgctgcccctccctgcctccacccacagtggagagggctacaaaggaggacaagaccctctcaggctgtcccaagctcccaagagcttccagagctctgacccacagcctccaagtcaggtggggtggagtcccagagctgcacagggtttggcccaagtttctaagggaggcacttcctcccctcgcccatcagtgccagcccctgctggctggtgcctgagcccctcagacagccccctgccccgcaggcctgccttctcagggacttctgcggggcctgaggcaagccatggagtgagacccaggagccggacacttctcaggaaatggcttttcccaacccccagcccccacccggtggttcttcctgttctgtgactgtgtatagtgccaccacagcttatggcatctcattgaggacaaagaaaactgcacaataaaaccaagcctctggaatctg

SEQ ID NO: 62257 - DNA, 1776 bp, Homo sapiens
  misc_feature (15)..(15): n is a, c, g, or t
tgctgtgttggtacnccggagtatgggatatgtgaccggccgcggcggcgcgtctggaggaggctgcagcagcggaagaccccagtccagatccaggactgagatcccagaaccatgaacctggccatcagcatcgctctcctgctaacagccagagccttcgtctggactgccgccatgagaataccagcagttcacccatccagtacgagttcagcctgacccgtgagacaaagaagcacgtgctctttggcactgtgggggtgcctgagcacacataccgctcccgaaccaacttcaccagcaaatacaacatgaaggtcctctacttatccgccttcactagcaaggacgagggcacctacacgtgtgcactccaccactctggccattccccacccatctcctcccagaacgtcacagtgctcagagacaaactggtcaagtgtgagggcatcagcctgctggctcagaacacctcgtggctgctgctgctcctgctctccctctccctcctccaggccacggatttcatgtccctgtgactggtggggcccatggaggagacaggaagcctcaagttccagtgcagagatcctacttctctgagtcagctgaccccctccccgcaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccttttctttgagagttcgtgaagagggaagccaggattggggacctgatggagagtgagagcatgtgaggggtagtgggatggtggggtaccagccactggaggggtcatccttgcccatcgggaccagaaacctgggagagacttggatgaggagtggttgggctgtgcctgggcctagcacggacatggtctgtcctgacagcactcctcggcaggcatggctggtgcctgaagaccccagatgtgagggcaccaccaagaatttgtggcctaccttgtgagggagagaactgagcatctccagcattctcagccacaaccaaaaaaaaataaaaagggcagccctccttaccactgtggaagtccctcagaggccttggggcatgacccagtgaagatgcaggtttgaccaggaaagcagcgctagtggagggttggagaaggaggtaaaggatgagggttcatcatccctccctgcctaaggaagctaaaagcatggccctgctgcccctccctgcctccacccacagtggagagggctacaaaggaggacaagaccctctcaggctgtcccaagctcccaagagcttccagagctctgacccacagcctccaagtcaggtggggtggagtcccagagctgcacagggtttggcccaagtttctaagggaggcacttcctcccctcgcccatcagtgccagcccctgctggctggtgcctgagcccctcagacagccccctgccccgcaggcctgccttctcagggacttctgcggggcctgaggcaagccatggagtgagacccaggagccggacacttctcaggaaatggcttttcccaacccccagcccccacccggtggttcttcctgttctgtgactgtgtatagtgccaccacagcttatggcatctcattgaggacaaagaaaactgcacaataaaaccaagcctctggaatctg

SEQ ID NO: 62258 - DNA, 1603 bp, Homo sapiens
  misc_feature (15)..(15): n is a, c, g, or t
tgctgtgttggtacnccggagtatgggatatgtgaccggccgcggcggcgcgtctggaggaggctgcagcagcggaagaccccagtccagatccaggactgagatcccagaaccatgaacctggccatcagcaaatacaacatgaaggtcctctacttatccgccttcactagcaaggacgagggcacctacacgtgtgcactccaccactctggccattccccacccatctcctcccagaacgtcacagtgctcagagacaaactggtcaagtgtgagggcatcagcctgctggctcagaacacctcgtggctgctgctgctcctgctctccctctccctcctccaggccacggatttcatgtccctgtgactggtggggcccatggaggagacaggaagcctcaagttccagtgcagagatcctacttctctgagtcagctgaccccctccccgcaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccttttctttgagagttcgtgaagagggaagccaggattggggacctgatggagagtgagagcatgtgaggggtagtgggatggtggggtaccagccactggaggggtcatccttgcccatcgggaccagaaacctgggagagacttggatgaggagtggttgggctgtgcctgggcctagcacggacatggtctgtcctgacagcactcctcggcaggcatggctggtgcctgaagaccccagatgtgagggcaccaccaagaatttgtggcctaccttgtgagggagagaactgagcatctccagcattctcagccacaaccaaaaaaaaataaaaagggcagccctccttaccactgtggaagtccctcagaggccttggggcatgacccagtgaagatgcaggtttgaccaggaaagcagcgctagtggagggttggagaaggaggtaaaggatgagggttcatcatccctccctgcctaaggaagctaaaagcatggccctgctgcccctccctgcctccacccacagtggagagggctacaaaggaggacaagaccctctcaggctgtcccaagctcccaagagcttccagagctctgacccacagcctccaagtcaggtggggtggagtcccagagctgcacagggtttggcccaagtttctaagggaggcacttcctcccctcgcccatcagtgccagcccctgctggctggtgcctgagcccctcagacagccccctgccccgcaggcctgccttctcagggacttctgcggggcctgaggcaagccatggagtgagacccaggagccggacacttctcaggaaatggcttttcccaacccccagcccccacccggtggttcttcctgttctgtgactgtgtatagtgccaccacagcttatggcatctcattgaggacaaagaaaactgcacaataaaaccaagcctctggaatctg

SEQ ID NO: 62259 - DNA, 1808 bp, Homo sapiens
  misc_feature (458)..(459): n is a, c, g, or t
  misc_feature (463)..(463): n is a, c, g, or t
  misc_feature (465)..(467): n is a, c, g, or t
  misc_feature (471)..(471): n is a, c, g, or t
  misc_feature (475)..(475): n is a, c, g, or t
  misc_feature (497)..(497): n is a, c, g, or t
tcccgctgcgcggcaagtttggaaagggtgggccatgcagcagcggaagacccagtccagatccaggactgagatcccagaaccatgaacctggccatcagcatcgctctcctgctaacagtcttgcaggtctcccgagggcagaaggtgaccagcctaacggcctgcctagtggaccagagccttcgtctggactgccgccatgagaataccagcagttcacccatccagtacgagttcagcctgacccgtgagacaaagaagcacgtgctctttggcactgtgggggtgcctgagcacacataccgctcccgaaccaacttcaccagcaaatacaacatgaaggtcctctacttatccgccttcactagcaaggacgagggcacctacacgtgtgcactccaccactctggccattccccacccatctcctcccagaacgtcacagtgctcagagnntttntnnntttnttantttttttttttttttttttttngtcttcataacacctcgtggctgctgctgctcctgctctccctctccctcctccaggccacggatttcatgtccctgtgactggtggggcccatggaggagacaggaagcctcaagttccagtgcagagatcctacttctctgagtcagctgaccccctccccgcaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccttttctttgagagttcgtgaagagggaagccaggattggggacctgatggagagtgagagcatgtgaggggtagtgggatggtggggtaccagccactggaggggtcatccttgcccatcgggaccagaaacctgggagagacttggatgaggagtggttgggctgtgcctgggcctagcacggacatggtctgtcctgacagcactcctcggcaggcatggctggtgcctgaagaccccagatgtgagggcaccaccaagaatttgtggcctaccttgtgagggagagaactgagcatctccagcattctcagccacaaccaaaaaaaaataaaaagggcagccctccttaccactgtggaagtccctcagaggccttggggcatgacccagtgaagatgcaggtttgaccaggaaagcagcgctagtggagggttggagaaggaggtaaaggatgagggttcatcatccctccctgcctaaggaagctaaaagcatggccctgctgcccctccctgcctccacccacagtggagagggctacaaaggaggacaagaccctctcaggctgtcccaagctcccaagagcttccagagctctgacccacagcctccaagtcaggtggggtggagtcccagagctgcacagggtttggcccaagtttctaagggaggcacttcctcccctcgcccatcagtgccagcccctgctggctggtgcctgagcccctcagacagccccctgccccgcaggcctgccttctcagggacttctgcggggcctgaggcaagccatggagtgagacccaggagccggacacttctcaggaaatggcttttcccaacccccagcccccacccggtggttcttcctgttctgtgactgtgtatagtgccaccacagcttatggcatctcattgaggacaaagaaaactgcacaataaaaccaagcctctggaatctg

SEQ ID NO: 62260 - DNA, 1244 bp, Homo sapiens
atccccggtgaaaactgcgggctccgagctgggtgcagcaaccggaggcggcggcgcgtctggaggaggctgcagcagcggaagaccccagtccagatccaggactgagatcccagaaccatgaacctggccatcagcatcgctctcctgctaacagtcttgcaggtctcccgagggcagaaggtgaccagcctaacggcctgcctagtggaccagagccttcgtctggactgccgccatgagaataccagcagttcacccatccagtacgagttcagcctgacccgtgagacaaagaagcacgtgctctttggcactgtgggggtgcctgagcacacataccgctcccgaaccaacttcaccagcaaatacaacatgaaggtcctctacttatccgccttcactagcaaggacgagggcacctacacgtgtgcactccaccactctggccattccccacccatctcctcccagaacgtcacagtgctcagagacaaactggtcaagtgtgagggcatcagcctgctggctcagaacacctcgtggctgctgctgctcctgctctccctctccctcctccaggccacggatttcatgtccctgtgactggtggggcccatggaggagacaggaagcctcaagttccagtgcagagatcctacttctctgagtcagctgaccccctccccgcaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccagagctctgacccacagcctccaagtcaggtggggtggagtcccagagctgcacagggtttggcccaagtttctaagggaggcacttcctcccctcgcccatcagtgccagcccctgctggctggtgcctgagcccctcagacagccccctgccccgcaggcctgccttctcagggacttctgcggggcctgaggcaagccatggagtgagacccaggagccggacacttctcaggaaatggcttttcccaacccccagcccccacccggtggttcttcctgttctgtgactgtgtatagtgccaccacagcttatggcatctcattgaggacaaagaaaactgcacaataaaaccaagcctctggaatctg

SEQ ID NO: 62261 - DNA, 704 bp, Homo sapiens
tggttgtggctgagaatgctggagatgctcagttctctccctcacaaggtaggccacaaccaaaaaaaaataaaaagggcagccctccttaccactgtggaagtccctcagaggccttggggcatgacccagtgaagatgcaggtttgaccaggaaagcagcgctagtggagggttggagaaggaggtaaaggatgagggttcatcatccctccctgcctaaggaagctaaaagcatggccctgctgcccctccctgcctccacccacagtggagagggctacaaaggaggacaagaccctctcaggctgtcccaagctcccaagagcttccagagctctgacccacagcctccaagtcaggtggggtggagtcccagagctgcacagggtttggcccaagtttctaagggaggcacttcctcccctcgcccatcagtgccagcccctgctggctggtgcctgagcccctcagacagccccctgccccgcaggcctgccttctcagggacttctgcggggcctgaggcaagccatggagtgagacccaggagccggacacttctcaggaaatggcttttcccaacccccagcccccacccggtggttcttcctgttctgtgactgtgtatagtgccaccacagcttatggcatctcattgaggacaaagaaaactgcacaataaaaccaagcctctggaatctg

SEQ ID NO: 62262 - DNA, 1160 bp, Homo sapiens
atccccggtgaaaactgcgggctccgagctgggtgcagcaaccggaggcggcggcgcgtctggaggaggctgcagcagcggaagaccccagtccagatccaggactgagatcccagaaccatgaacctggccatcagcatcgctctcctgctaacagtcttgcaggtctcccgagggcagaaggtgaccagcctaacggcctgcctagtggaccagagccttcgtctggactgccgccatgagaataccagcagttcacccatccagtacgagttcagcctgacccgtgagacaaagaagcacgtgctctttggcactgtgggggtgcctgagcacacataccgctcccgaaccaacttcaccagcaaatacaacatgaaggtcctctacttatccgccttcactagcaaggacgagggcacctacacgtgtgcactccaccactctggccattccccacccatctcctcccagaacgtcacagtgctcagagacaaactggtcaagtgtgagggcatcagcctgctggctcagaacacctcgtggctgctgctgctcctgctctccctctccctcctccaggccacggatttcatgtccctgtgactggtggggcccatggaggagacaggaagcctcaagttccagtgcagagatcctaacttctcaggaaatggcttttcccaacccccagcccccacccggtggttcttcctgttctgtgactgtgtatagtgccaccacagcttatggcatctcattgaggacaaagaaaactgcacaataaaaccaagcctctggaatctgctcgtgtccacctggccttcgctcctccagcagtgcctgcctgcccccgcttcgctggggtctccacgggtgaggctggggaacgccacctcttcctcttccctgacttctccccaaccacttagtagcaacgctaccccaggggctaatgactgcacactgggcttcttttcagaatgaccctaacgagacacatttgcccaaataaacgaacatcccatgtctgctgactcacctggctggaacaacatgcttactgccaacatgtgggccgaaccacatggccctggctctggaatgcacaagtggctttgcgtgaatctgcgctaagctatgcagtctgctttttcttc

SEQ ID NO: 62263 - DNA, 865 bp, Homo sapiens
gggtcgatctagacgattttccgctctcacccaccccaggcacctacacgtgtgcactccaccactctggccattccccacccatctcctcccagaacgtcacagtgctcagagacaaactggtcaagtgtgagggcatcagcctgctggctcagaacacctcgtggctgctgctgctcctgctctccctctccctcctccaggccacggatttcatgtccctgtgactggtggggcccatggaggagacaggaagcctcaagttccagtgcagagatcctacttctctgagtcagctgaccccctccccgcaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccagagctctgacccacagcctccaagtcaggtggggtggagtcccagagctgcacagggtttggcccaagtttctaagggaggcacttcctcccctcgcccatcagtgccagcccctgctggctggtgcctgagcccctcagacagccccctgccccgcaggcctgccttctcagggacttctgcggggcctgaggcaagccatggagtgagacccaggagccggacacttctcaggaaatggcttttcccaacccccagcccccacccggtggttcttcctgttctgtgactgtgtatagtgccaccacagcttatggcatctcattgaggacaaagaaaactgcacaataaaaccaagcctctggaatctg

SEQ ID NO: 62264 - DNA, 1831 bp, Homo sapiens
  misc_feature (15)..(15): n is a, c, g, or t
tgctgtgttggtacnccggagtatgggatatgtgaccggccgcggcggcgcgtctggaggaggctgcagcagcggaagaccccagtccagatccaggactgagatcccagaaccatgaacctggccatcagcatcgctctcctgctaacagtcttgcaggtctcccgagggcagaaggtgaccagcctaacggcctgcctagtggaccagagccttcgtctggactgccgccatgagaataccagcagttcacccatccagtacgagttcagcctgacccgtgagacaaagaagcacgtgctctttggcactgtgggggtgcctgagcacacataccgctcccgaaccaacttcaccagcaaatacaacatgaaggtcctctacttatccgccttcactagcaaggacgagggcacctacacgtgtgcactccaccactctggccattccccacccatctcctcccagaacgtcacagtgctcagagacaaactggtcaagtgtgagggcatcagcctgctggctcagaacacctcgtggctgctgctgctcctgctctccctctccctcctccaggccacggatttcatgtccctgtgactggtggggcccatggaggagacaggaagcctcaagttccagtgcagagatcctacttctctgagtcagctgaccccctccccgcaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccttttctttgagagttcgtgaagagggaagccaggattggggacctgatggagagtgagagcatgtgaggggtagtgggatggtggggtaccagccactggaggggtcatccttgcccatcgggaccagaaacctgggagagacttggatgaggagtggttgggctgtgcctgggcctagcacggacatggtctgtcctgacagcactcctcggcaggcatggctggtgcctgaagaccccagatgtgagggcaccaccaagaatttgtggcctaccttgtgagggagagaactgagcatctccagcattctcagccacaaccaaaaaaaaataaaaagggcagccctccttaccactgtggaagtccctcagaggccttggggcatgacccagtgaagatgcaggtttgaccaggaaagcagcgctagtggagggttggagaaggaggtaaaggatgagggttcatcatccctccctgcctaaggaagctaaaagcatggccctgctgcccctccctgcctccacccacagtggagagggctacaaaggaggacaagaccctctcaggctgtcccaagctcccaagagcttccagagctctgacccacagcctccaagtcaggtggggtggagtcccagagctgcacagggtttggcccaagtttctaagggaggcacttcctcccctcgcccatcagtgccagcccctgctggctggtgcctgagcccctcagacagccccctgccccgcaggcctgccttctcagggacttctgcggggcctgaggcaagccatggagtgagacccaggagccggacacttctcaggaaatggcttttcccaacccccagcccccacccggtggttcttcctgttctgtgactgtgtatagtgccaccacagcttatggcatctcattgaggacaaagaaaactgcacaataaaaccaagcctctggaatctg

SEQ ID NO: 62265 - DNA, 2235 bp, Homo sapiens
atccccggtgaaaactgcgggctccgagctgggtgcagcaaccggaggcggcggcgcgtctggaggaggctgcagcagcggaagaccccagtccagatccaggactgagatcccagaaccatgaacctggccatcagcatcgctctcctgctaacagtcttgcaggtctcccgagggcagaaggtgaccagcctaacggcctgcctagtggaccagagccttcgtctggactgccgccatgagaataccagcagttcacccatccagtacgagttcagcctgacccgtgagacaaagaagcacgtgctctttggcactgtgggggtgcctgagcacacataccgctcccgaaccaacttcaccagcaaatacaacatgaaggtcctctacttatccgccttcactagcaaggacgagggcacctacacgtgtgcactccaccactctggccattccccacccatctcctcccagaacgtcacagtgctcagagacaaactggtcaagtgtgagggcatcagcctgctggctcagaacacctcgtggctgctgctgctcctgctctccctctccctcctccaggccacggatttcatgtccctgtgactggtggggcccatggaggagacaggaagcctcaagttccagtgcagagatcctacttctctgagtcagctgaccccctccccgcaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccttttctttgagagttcgtgaagagggaagccaggattggggacctgatggagagtgagagcatgtgaggggtagtgggatggtggggtaccagccactggaggggtcatccttgcccatcgggaccagaaacctgggagagacttggatgaggagtggttgggctgtgcctgggcctagcacggacatggtctgtcctgacagcactcctcggcaggcatggctggtgcctgaagaccccagatgtgagggcaccaccaagaatttgtggcctaccttgtgagggagagaactgagcatctccagcattctcagccacaaccaaaaaaaaataaaaagggcagccctccttaccactgtggaagtccctcagaggccttggggcatgacccagtgaagatgcaggtttgaccaggaaagcagcgctagtggagggttggagaaggaggtaaaggatgagggttcatcatccctccctgcctaaggaagctaaaagcatggccctgctgcccctccctgcctccacccacagtggagagggctacaaaggaggacaagaccctctcaggctgtcccaagctcccaagagcttccagagctctgacccacagcctccaagtcaggtggggtggagtcccagagctgcacagggtttggcccaagtttctaagggaggcacttcctcccctcgcccatcagtgccagcccctgctggctggtgcctgagcccctcagacagccccctgccccgcaggcctgccttctcagggacttctgcggggcctgaggcaagccatggagtgagacccaggagccggacacttctcaggaaatggcttttcccaacccccagcccccacccggtggttcttcctgttctgtgactgtgtatagtgccaccacagcttatggcatctcattgaggacaaagaaaactgcacaataaaaccaagcctctggaatctggagaaacaaacaatacaaaagacaagaacaaaaaaacacaaaaaaaaagggggggcggccccctttttatgttttgttttacaaaaacaggggccccgcagatgcgggccaagaaaagggggccgtggtgcgcagcggtgcacaaagggggggaagagaggggcggaaccaagagtgaacgcgggcggggaaaacgattgcgcaaccccgccgcggcgaagagcgggcgggacacaacaagcgcaccgtgggctaccaaccattggcgacaagaaaagaacccccccccagcggggggaagaaagacccccaccgcgcaaaccatgagaggcccacccccccgaggagaacggagacacccagtgagaaaaagagccctgaccccggtgcacgcaccg

SEQ ID NO: 62266 - DNA, 1816 bp, Homo sapiens
  misc_feature (1432)..(1432): n is a, c, g, or t
  misc_feature (1435)..(1435): n is a, c, g, or t
  misc_feature (1437)..(1437): n is a, c, g, or t
atccccggtgaaaactgcgggctccgagctgggtgcagcaaccggaggcggcggcgcgtctggaggaggctgcagcagcggaagaccccagtccagatccaggactgagatcccagaaccatgaacctggccatcagcatcgctctcctgctaacagtcttgcaggtctcccgagggcagaaggtgaccagcctaacggcctgcctagtggaccagagccttcgtctggactgccgccatgagaataccagcagttcacccatccagtacgagttcagcctgacccgtgagacaaagaagcacgtgctctttggcactgtgggggtgcctgagcacacataccgctcccgaaccaacttcaccagcaaatacaacatgaaggtcctctacttatccgccttcactagcaaggacgagggcacctacacgtgtgcactccaccactctggccattccccacccatctcctcccagaacgtcacagtgctcagagacaaactggtcaagtgtgagggcatcagcctgctggctcagaacacctcgtggctgctgctgctcctgctctccctctccctcctccaggccacggatttcatgtccctgtgactggtggggcccatggaggagacaggaagcctcaagttccagtgcagagatcctacttctctgagtcagctgaccccctccccgcaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccttttctttgagagttcgtgaagagggaagccaggattggggacctgatggagagtgagagcatgtgaggggtagtgggatggtggggtaccagccactggaggggtcatccttgcccatcgggaccagaaacctgggagagacttggatgaggagtggttgggctgtgcctgggcctagcacggacatggtctgtcctgacagcactcctcggcaggcatggctggtgcctgaagaccccagatgtgagggcaccaccaagaatttgtggcctaccttgtgagggagagaactgagcatctccagcattctcagccacaaccaaaaaaaaataaaaagggcagccctccttaccactgtggaagtccctcagaggccttggggcatgacccagtgaagatgcaggtttgaccaggaaagcagcgccacccctcatcaggagttccagtgctgcatgcgattatctacccacgtccacgcggccacctcaccctctccgcacacctctggctgtctttttgtactttttgttccagagctgttctgtctggtttatttagnttntntccttccagagctctgacccacagcctccaagtcaggtggggtggagtcccagagctgcacagggtttggcccaagtttctaagggaggcacttcctcccctcgcccatcagtgccagcccctgctggctggtgcctgagcccctcagacagccccctgccccgcaggcctgccttctcagggacttctgcggggcctgaggcaagccatggagtgagacccaggagccggacacttctcaggaaatggcttttcccaacccccagcccccacccggtggttcttcctgttctgtgactgtgtatagtgccaccacagcttatggcatctcattgaggacaaagaaaactgcacaataaaaccaagcctctggaatctg

SEQ ID NO: 62267 - DNA, 1703 bp, Homo sapiens
ctccctggacgtcagaacaacgctcttgcaggtctcccgagggcagaaggtgaccagcctaacggcctgcctagtggaccagagccttcgtctggactgccgccatgagaataccagcagttcacccatccagtacgagttcagcctgacccgtgagacaaagaagcacgtgctctttggcactgtgggggtgcctgagcacacataccgctcccgaaccaacttcaccagcaaatacaacatgaaggtcctctacttatccgccttcactagcaaggacgagggcacctacacgtgtgcactccaccactctggccattccccacccatctcctcccagaacgtcacagtgctcagagacaaactggtcaagtgtgagggcatcagcctgctggctcagaacacctcgtggctgctgctgctcctgctctccctctccctcctccaggccacggatttcatgtccctgtgactggtggggcccatggaggagacaggaagcctcaagttccagtgcagagatcctacttctctgagtcagctgaccccctccccgcaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccttttctttgagagttcgtgaagagggaagccaggattggggacctgatggagagtgagagcatgtgaggggtagtgggatggtggggtaccagccactggaggggtcatccttgcccatcgggaccagaaacctgggagagacttggatgaggagtggttgggctgtgcctgggcctagcacggacatggtctgtcctgacagcactcctcggcaggcatggctggtgcctgaagaccccagatgtgagggcaccaccaagaatttgtggcctaccttgtgagggagagaactgagcatctccagcattctcagccacaaccaaaaaaaaataaaaagggcagccctccttaccactgtggaagtccctcagaggccttggggcatgacccagtgaagatgcaggtttgaccaggaaagcagcgctagtggagggttggagaaggaggtaaaggatgagggttcatcatccctccctgcctaaggaagctaaaagcatggccctgctgcccctccctgcctccacccacagtggagagggctacaaaggaggacaagaccctctcaggctgtcccaagctcccaagagcttccagagctctgacccacagcctccaagtcaggtggggtggagtcccagagctgcacagggtttggcccaagtttctaagggaggcacttcctcccctcgcccatcagtgccagcccctgctggctggtgcctgagcccctcagacagccccctgccccgcaggcctgccttctcagggacttctgcggggcctgaggcaagccatggagtgagacccaggagccggacacttctcaggaaatggcttttcccaacccccagcccccacccggtggttcttcctgttctgtgactgtgtatagtgccaccacagcttatggcatctcattgaggacaaagaaaactgcacaataaaaccaagcctctggaatctg

SEQ ID NO: 62268 - DNA, 1688 bp, Homo sapiens
ccgaaccaacttcaccagcaaatacaacatgaaggtgaccagcctaacggcctgcctagtggaccagagccttcgtctggactgccgccatgagaataccagcagttcacccatccagtacgagttcagcctgacccgtgagacaaagaagcacgtgctctttggcactgtgggggtgcctgagcacacataccgctcccgaaccaacttcaccagcaaatacaacatgaaggtcctctacttatccgccttcactagcaaggacgagggcacctacacgtgtgcactccaccactctggccattccccacccatctcctcccagaacgtcacagtgctcagagacaaactggtcaagtgtgagggcatcagcctgctggctcagaacacctcgtggctgctgctgctcctgctctccctctccctcctccaggccacggatttcatgtccctgtgactggtggggcccatggaggagacaggaagcctcaagttccagtgcagagatcctacttctctgagtcagctgaccccctccccgcaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccttttctttgagagttcgtgaagagggaagccaggattggggacctgatggagagtgagagcatgtgaggggtagtgggatggtggggtaccagccactggaggggtcatccttgcccatcgggaccagaaacctgggagagacttggatgaggagtggttgggctgtgcctgggcctagcacggacatggtctgtcctgacagcactcctcggcaggcatggctggtgcctgaagaccccagatgtgagggcaccaccaagaatttgtggcctaccttgtgagggagagaactgagcatctccagcattctcagccacaaccaaaaaaaaataaaaagggcagccctccttaccactgtggaagtccctcagaggccttggggcatgacccagtgaagatgcaggtttgaccaggaaagcagcgctagtggagggttggagaaggaggtaaaggatgagggttcatcatccctccctgcctaaggaagctaaaagcatggccctgctgcccctccctgcctccacccacagtggagagggctacaaaggaggacaagaccctctcaggctgtcccaagctcccaagagcttccagagctctgacccacagcctccaagtcaggtggggtggagtcccagagctgcacagggtttggcccaagtttctaagggaggcacttcctcccctcgcccatcagtgccagcccctgctggctggtgcctgagcccctcagacagccccctgccccgcaggcctgccttctcagggacttctgcggggcctgaggcaagccatggagtgagacccaggagccggacacttctcaggaaatggcttttcccaacccccagcccccacccggtggttcttcctgttctgtgactgtgtatagtgccaccacagcttatggcatctcattgaggacaaagaaaactgcacaataaaaccaagcctctggaatctg

SEQ ID NO: 62269 - DNA, 1790 bp, Homo sapiens
gccacagcggcccaggaccagaccctggctggaagccagaacgcagactgcaggggccgcgcctggctcaggcggtcccacccctcgggacgtggggtcacttccttcatgtaagacgttggccgaaatttctactacctgtgtctagtcctcccctccaagagcattaagctatttaaaaatcaacggaaaagaggaaaaaaaagaacagaggcccgcctcgtacccgagtcaggacccctccgtgttgcttctgctgaaattggagtggggtgatcctggagggagtaggcgctgcacgaagcgagctgcaaacagcaaatacaacatgaaggtcctctacttatccgccttcactagcaaggacgagggcacctacacgtgtgcactccaccactctggccattccccacccatctcctcccagaacgtcacagtgctcagagacaaactggtcaagtgtgagggcatcagcctgctggctcagaacacctcgtggctgctgctgctcctgctctccctctccctcctccaggccacggatttcatgtccctgtgactggtggggcccatggaggagacaggaagcctcaagttccagtgcagagatcctacttctctgagtcagctgaccccctccccgcaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccttttctttgagagttcgtgaagagggaagccaggattggggacctgatggagagtgagagcatgtgaggggtagtgggatggtggggtaccagccactggaggggtcatccttgcccatcgggaccagaaacctgggagagacttggatgaggagtggttgggctgtgcctgggcctagcacggacatggtctgtcctgacagcactcctcggcaggcatggctggtgcctgaagaccccagatgtgagggcaccaccaagaatttgtggcctaccttgtgagggagagaactgagcatctccagcattctcagccacaaccaaaaaaaaataaaaagggcagccctccttaccactgtggaagtccctcagaggccttggggcatgacccagtgaagatgcaggtttgaccaggaaagcagcgctagtggagggttggagaaggaggtaaaggatgagggttcatcatccctccctgcctaaggaagctaaaagcatggccctgctgcccctccctgcctccacccacagtggagagggctacaaaggaggacaagaccctctcaggctgtcccaagctcccaagagcttccagagctctgacccacagcctccaagtcaggtggggtggagtcccagagctgcacagggtttggcccaagtttctaagggaggcacttcctcccctcgcccatcagtgccagcccctgctggctggtgcctgagcccctcagacagccccctgccccgcaggcctgccttctcagggacttctgcggggcctgaggcaagccatggagtgagacccaggagccggacacttctcaggaaatggcttttcccaacccccagcccccacccggtggttcttcctgttctgtgactgtgtatagtgccaccacagcttatggcatctcattgaggacaaagaaaactgcacaataaaaccaagcctctggaatctg

SEQ ID NO: 62270 - DNA, 1232 bp, Homo sapiens
ccggaattcccgggcccgcgcgtcgcgaagcctcaagttccagtgcagagatcctacttctctgagtcagctgaccccctccccgcaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccttttctttgagagttcgtgaagagggaagccaggattggggacctgatggagagtgagagcatgtgaggggtagtgggatggtggggtaccagccactggaggggtcatccttgcccatcgggaccagaaacctgggagagacttggatgaggagtggttgggctgtgcctgggcctagcacggacatggtctgtcctgacagcactcctcggcaggcatggctggtgcctgaagaccccagatgtgagggcaccaccaagaatttgtggcctaccttgtgagggagagaactgagcatctccagcattctcagccacaaccaaaaaaaaataaaaagggcagccctccttaccactgtggaagtccctcagaggccttggggcatgacccagtgaagatgcaggtttgaccaggaaagcagcgctagtggagggttggagaaggaggtaaaggatgagggttcatcatccctccctgcctaaggaagctaaaagcatggccctgctgcccctccctgcctccacccacagtggagagggctacaaaggaggacaagaccctctcaggctgtcccaagctcccaagagcttccagagctctgacccacagcctccaagtcaggtggggtggagtcccagagctgcacagggtttggcccaagtttctaagggaggcacttcctcccctcgcccatcagtgccagcccctgctggctggtgcctgagcccctcagacagccccctgccccgcaggcctgccttctcagggacttctgcggggcctgaggcaagccatggagtgagacccaggagccggacacttctcaggaaatggcttttcccaacccccagcccccacccggtggttcttcctgttctgtgactgtgtatagtgccaccacagcttatggcatctcattgaggacaaagaaaactgcacaataaaaccaagcctctggaatctg

SEQ ID NO: 62271 - DNA, 1049 bp, Homo sapiens
atccccggtgaaaactgcgggctccgagctgggtgcagcaaccggaggcggcggcgcgtctggaggaggctgcagcagcggaagaccccagtccagatccaggactgagatcccagaaccatgaacctggccatcagcatcgctctcctgctaacagtcttgcaggtctcccgagggcagaaggtgaccagcctaacggcctgcctagtggaaaacctgggagagacttggatgaggagtggttgggctgtgcctgggcctagcacggacatggtctgtcctgacagcactcctcggcaggcatggctggtgcctgaagaccccagatgtgagggcaccaccaagaatttgtggcctaccttgtgagggagagaactgagcatctccagcattctcagccacaaccaaaaaaaaataaaaagggcagccctccttaccactgtggaagtccctcagaggccttggggcatgacccagtgaagatgcaggtttgaccaggaaagcagcgctagtggagggttggagaaggaggtaaaggatgagggttcatcatccctccctgcctaaggaagctaaaagcatggccctgctgcccctccctgcctccacccacagtggagagggctacaaaggaggacaagaccctctcaggctgtcccaagctcccaagagcttccagagctctgacccacagcctccaagtcaggtggggtggagtcccagagctgcacagggtttggcccaagtttctaagggaggcacttcctcccctcgcccatcagtgccagcccctgctggctggtgcctgagcccctcagacagccccctgccccgcaggcctgccttctcagggacttctgcggggcctgaggcaagccatggagtgagacccaggagccggacacttctcaggaaatggcttttcccaacccccagcccccacccggtggttcttcctgttctgtgactgtgtatagtgccaccacagcttatggcatctcattgaggacaaagaaaactgcacaataaaaccaagcctctggaatctg

SEQ ID NO: 62272 - DNA, 1129 bp, Homo sapiens
atccccggtgaaaactgcgggctccgagctgggtgcagcaaccggaggcggcggcgcgtctggaggaggctgcagcagcggaagaccccagtccagatccaggactgagatcccagaaccatgaacctggccatcagcatcgctctcctgctaacagtcttgcaggtctcccgagggcagaaggtgaccagcctaacggcctgcctagtggaccagagccttcgtctggactgccgccatgagaataccagcagttcacccatccagtacgagttcagcctgacccgtgagacaaagaagcacgtgctctttggcactgtgggggtgcctgagcacacataccgctcccgaaccaacttcaccagcaaatacaacatgaaggtcctctacttatccgccttcactagcaaggacgagggcacctacacgtgtgcactccaccactctggccattccccacccatctcctcccagaacgtcacagtgctcagagacaaactggtcaagtgtgagggcatcagcctgctggctcagaacacctcgtggctgctgctgctcctgctctccctctccctcctccaggccacggatttcatgtccctgtgactggtggggcccatggaggagacaggaagcctcaagttccagtgcagagatcctacttctctgagtcagctgaccccctccccgcaatccctcaaaccttgaggagaagtggggaccccacccctcatcaggagttccagtgctgcatgcgattatctacccacgtccacctcgtgtccacctggccttcgctcctccagcagtgcctgcctgcccccgcttcgctggggtctccacgggtgaggctggggaacgccacctcttcctcttccctgacttctccccaaccacttagtagcaacgctaccccaggggctaatgactgcacactgggcttcttttcagaatgaccctaacgagacacatttgcccaaataaacgaacatcccatgtctgctgactcacctggctggaacaacatgcttactgccaacatgtgggccgaaccacatggccctggctctggaatgcacaagtggctttgcgtgaatctgcgctaagctatgcagtctgctttttcttc

SEQ ID NO: 62273 - DNA, 807 bp, Homo sapiens
atccccggtgaaaactgcgggctccgagctgggtgcagcaaccggaggcggcggcgcgtctggaggaggctgcagcagcggaagaccccagtccagatccaggactgagatcccagaaccatgaacctggccatcagcatcgctctcctgctaacagtcttgcaggtctcccgagggcagaaggtgaccagcctaacggcctgcctagtggaccagagccttcgtctggactgccgccatgagaataccagcagttcacccatccagtacgagttcagcctgacccgtgagacaaagaagcacgtgctctttggcactgtgggggtgcctgagcacacataccgctcccgaaccaacttcaccagcaaatacaacatgaaggtcctctacttatccgccttcactagcaaggacgagggcacctacacgtgtgcactccaccactctggccattccccacccatctcctcccagaacgtcacagtgctcagagacaaactggtcaagtgtgagggcatcagcctgctggctcagaacacctcgtggctgctgctgctcctgctctccctctccctcctccaggccacggatttcatgtccctgtgactggtggggcccatggaggagacaggaagcctcaagttccagtgcagagatcctaacttctcaggaaatggcttttcccaacccccagcccccacccggtggttcttcctgttctgtgactgtgtatagtgccaccacagcttatggcatctcattgaggacaaagaaaactgcacaataaaaccaagcctctggaatctg

SEQ ID NO: 62274 - DNA, 871 bp, Homo sapiens
cgatttcggctcacttcaacctccccctcccgggttcaagggattctcgtgcctcactcagcctcctgagtagctgggattacaggcgcccgccatcatacctggctaatttttgtatttttagtagagacggggtttcaccatgttggccaggctggtcttgaactcctgatctcaagtgatacactttgcctcagcctcccaaagtgttgggattacaggcgtgagccaccacacctggtcatctttatctttttgacatgttcatcctcgtccccacactaaggtagagataaagcaattatcttctcaatgcttgaaacattttaagttgaattcattctatgattttctttagatttctccgcatatatcaatggaaaaaattaactatcttaatttctcatctatatagaaatgccagtgcaacaaaaccaaatgtagggttagaatatcagcaaggcaaagagagaagagaaaactctttcaacccattttctatacactccattattctttcttagaattcttacacaaatatttagtacaattttggaggaatagtagaaacattttatagtttttccttgtcctgtatcttcatctagccttcttttcagctttcctatgtcctttgttctccttttataaggagagatgagttgtacaataacatccattttcataagttatttaggtaaattattttgaagtatacatgttggatttccaaagcagctgtttttaattaaaatttaattaactaatttatgtcattatatatcttgtgttaagacaaccttaactttcttttagtaagattttacccaactgtttaccctaattatagacaattaaaatgttctctctt

SEQ ID NO: 62275 - DNA, 885 bp, Homo sapiens
caaacttatgtgctgagcacttgagtcacatgggcccagttggcttgacctggtggtatgcccaaccttgtatccaatcactgtggccagagaatggaatatggtgataggcttagccaaggtgagagggatggagtctgctggacccgaaacatggcatgaatgccaggaggtggactcatggcagccactcgtatgagtattatgagtctatctgccacagtaaggaacaggcccaacactaaggtagagataaagcaattatcttctcaatgcttgaaacattttaagttgaattcattctatgattttctttagatttctccgcatatatcaatggaaaaaattaactatcttaatttctcatctatatagaaatgccagtgcaacaaaaccaaatgtagggttagaatatcagcaaggcaaagagagaagagaaaattcccagattatgaaatggagaagaagaacagaaacatgatatttagctcacaactctttcaacccattttctatacactccattattctttcttagaattcttacacaaatatttagtacaattttggaggaatagtagaaacattttatagtttttccttgtcctgtatcttcatctagccttcttttcagctttcctatgtcctttgttctccttttataaggagagatgagttgtacaataacatccattttcataagttatttaggtaaattattttgaagtatacatgttggatttccaaagcagctgtttttaattaaaatttaattaactaatttatgtcattatatatcttgtgttaagacaaccttaactttcttttagtaagattttacccaactgtttaccctaattatagacaattaaaatgttctctctt

SEQ ID NO: 62276 - DNA, 187 bp, Homo sapiens
ggagagacttttgaccataagcctttttatggttttttttctctctttttaagccatgtgaatgtattacctctccaaaaatattaaagttttaaaaagttttggatgctgaaaaaaaaaatgaatgaagttcaactgaattcccctgctcccctcttaccccctctcccctctccatacgtctcag

SEQ ID NO: 62277 - DNA, 992 bp, Homo sapiens
ccacgagagattagcgaggcgatcccggtgtttaatttcagtaccagggctggcgtttacttctaattgcgaggcactctggcttgacagagttctctgaaagtcccggagggtcccctactgagggcggagggagcgcggctggcggaccggagcctccatggcgggaggatgagatctgcgttgtgggaatcttcggcaagacggctctacgcctgaattccgagaagttctctcttgtgaatacggtgtgcgaccgacaggtctttcctctctttcgccaccaagatcctggggatccaggacctggaatcagaactgaggctggcgccgtgggtgaggccggtggagccgaggaccctggggctgcagccgggggttcagttcggggaagtggagctgtcgcggaaggtaaccgaactgaggcaggctcccaggactacagccttctgcaggcctactacagtcaggaaagcaaagttctgtatcttctcctcacctccatctgtgacaattcacagcttctccgggcttgtcgggctcttcagagcggggaagctggaggtggactctctttacctcatgcagaagcacacgagttctggaagcatcaagagaagctgcagtgcctcagtctcctttacctattctctgtctgtcatatcttgcttctggtccatcccacttgttcctttgatatcacttatgatcgagtattcagagccctggatgggctgagacagaaggtcctgccgctccttaaaacagccattagatgtcagtggaagatggagtaaatgcgactggcactagatcttttctcttcatcaatgggctcaggtgaactctgggaccagacagtcttcagaaaggcaagaaattccaagggtgggtgcgtgggggcatttaaatcggaggggtggggaaaagggaagggtttgggggcactttggttcgggcggggccttttggctatttgggggttgggctgg

SEQ ID NO: 62278 - DNA, 3310 bp, Homo sapiens
gaccggaaggactctagagaacgctctgcactatggctggtcccgtgagcttgcgagaccttctaatgggagcgtcagcctggatgggctctgaaagtcccggagggtcccctactgagggcggagggagcgcggctggcggaccggagcctccatggcgggaggatgagatctgcgttgtgggaatcttcggcaagacggctctacgcctgaattccgagaagttctctcttgtgaatacggtgtgcgaccgacaggtctttcctctctttcgccaccaagatcctggggatccaggacctggaatcagaactgaggctggcgccgtgggtgaggccggtggagccgaggaccctggggctgcagccgggggttcagttcggggaagtggagctgtcgcggaaggtaaccgaactgaggcaggctcccaggactacagccttctgcaggcctactacagtcaggaaagcaaagttctgtatcttctcctcacctccatctgtgacaattcacagcttctccgggcttgtcgggctcttcagagcggggaagctggaggtggactctctttacctcatgcagaagcacacgagttctggaagcatcaagagaagctgcagtgcctcagtctcctttacctattctctgtctgtcatatcttgcttctggtccatcccacttgttcctttgatatcacttatgatcgagtattcagagccctggatgggctgagacagaaggtcctgccgctccttaaaacagccattaaggattgtccagttggcaaagactggaagctaaactgccgaccttgcccacctagactccttttcctctttcaactcaatggagccctcaaggtagaacctcctcggaaccaagacccagctcatccagacaagcccaagaaacattctcccaaaaggaggctgcagcatgccctggaggaccagatctatagaatcttccggaagagtcgtgtcttgactaatcagagcatcaactgcctctttactgtgcctgccaaccaagctttcgtgtacatagtaccgggaagccaggaggaggacccagtaggtatgttgctggaccaacttaggagtcattgtactgtgaaggacccggaatctttgctggtgcctgcacccctttctgggcctaggcgataccaggtgatgaggcagcacagccgacaacaactttcctttcacattgacagcagcagttccagttcttcaggccagctagtggatttcactcttcgggaattcctatggcagcatgtggagctagttctaagcaagaaaggtttcgatgacagtgtgggcaggaacccacagccttcccattttgaacttcctacttatcagaagtggatctcagcagcttcaaaactgtatgaggtggctattgatgggaaagaagaggacttggggtcacccactggagagctaacatctaagattttaagcagtattaaagtcttggaaggatttttggatattgacacaaaattctcagaaaaccgatgccaaaaagctttacccatggcccacagtgcctaccagtcaaatttgcctcataattacacaatgactgtccataagaatcagcttgcccaggctcttcgagtgtacagtcaacatgctagaggtccagcatttcacaaatacgccatgcagttacatgaggactgctacaaattttggagcaatggccatcagctctgtgaggagaggagtttaactgatcaacactgtgtgcacaaatttcactcattacctaaatcaggagaaaaaccagaggctgatagaaatccgcctgtgctatatcacaatagccgagctcgatctactggtgcttgcaactgtggaaggaaacaagcacctcgagatgatccctttgatatcaaagcagccaattatgacttctatcagcttctggaagaaaagtgttgtggaaaattggatcatatcaatttcccagtatttgaaccaagtactccagatcctgctcctgctaaaaatgaatcctctcctgctcctccagattcggatgctgataaacttaaagaaaaagaacctcaaacccaaggagagagcacgagcctgagtttagctttgagtttgggccaatccacagatagcttaggtacctatccagctgatccacaagcaggaggagataatccagaagttcatggtcaagtagaagtgaaaactgagaagaggccaaacttcgttgatcgacaggcatccacagttgagtatctcccaggcatgctacattcaaattgccctaaaggtctcctacccaaattctccagctggtctttggttaaactaggccctgctaagtcttataactttcatacaggtttggaccaacagggctttattccaggaacaaattatcttatgccttgggacattgtcatcaggactagagctgaagatgaaggagacttagacacaaactcttggcctgctccaaataaagctattcctggaaagagaagtgcggttgtaatgggaagaggaagacggcgagatgacatagctcgagcttttgtgggctttgaatatgaagactctcgaggtcggagattcatgtgctctgggcctgacaaagtaatgaaagtaatgggaagtgggccaaaggaatcagctttaaaagccctaaatagtgacatgcccttatatattctgtcatcctctcaaggtagagggctgaaacctcattatgctcaacttatgaggctttttgttgtggttcctgatgctcctttgcagataatactaatgcctcaggttcagccaggcccaccaccatgtccggtattctacccagaaaaacaagaaatcacccttccacctgatggcctttgggttttgagatttccttatgcatatgtgactgagagaggaccttgtttcccccctaaggaaaatgtgcagttaatgagctacaaggtgctccgtggggttcttaaggcagtaacacaataagtgttttccagccagttcaatcctatacttgagctggtttttgtttttggtatttgtggctgtgtttttggtatgtgtttactgtgttttcccaaatccaaaatgtgttttggttacaggagttcagtatttggaaactaatttgttctactttttcattatattgttgatatttattgtaaacgtgactacaactttctaataaagattggttgttctagaaaagaatataaaatacatggatgatacctgttttttctcgtttctgttttactctccataattaaacatgtttctattat

SEQ ID NO: 62279 - DNA, 2298 bp, Homo sapiens
gaccggaaggactctagagaacgctctgcactatggctggtcccgtgagcttgcgagaccttctaatgggagcgtcagcctggatgggctctgaaagtcccggagggtcccctactgagggcggagggagcgcggctggcggaccggagcctccatggcgggaggatgagatctgcgttgtgggaatcttcggcaagacggctctacgcctgaattccgagaagttctctcttgtgaatacggtgtgcgaccgacaggtctttcctctctttcgccaccaagatcctggggatccaggacctggaatcagaactgaggctggcgccgtgggtgaggccggtggagccgaggaccctggggctgcagccgggggttcagttcggggaagtggagctgtcgcggaaggtaaccgaactgaggcaggctcccaggactacagccttctgcaggcctactacagtcaggaaagcaaagttctgtatcttctcctcacctccatctgtgacaattcacagcttctccgggcttgtcgggctcttcagagcggggaagctggaggtggactctctttacctcatgcagaagcacacgagttctggaagcatcaagagaagctgcagtgcctcagtctcctttacctattctctgtctgtcatatcttgcttctggtccatcccacttgttcctttgatatcacttatgatcgagtattcagagccctggatgggctgagacagaaggtcctgccgctccttaaaacagccattaaggattgtccagttggcaaagactggaagctaaactgccgaccttgcccacctagactccttttcctctttcaactcaatggagccctcaaggtagaacctcctcggaaccaagacccagctcatccagacaagcccaagaaacattctcccaaaaggaggctgcagcatgccctggaggaccagatctatagaatcttccggaagagtcgtgtcttgactaatcagagcatcaactgcctctttactgtgcctgccaaccaagctttcgtgtacatagtaccgggaagccaggaggaggacccagtaggtatgttgctggaccaacttaggagtcattgtactgtgaaggacccggaatctttgctggtgcctgcacccctttctgggcctaggcgataccaggtgatgaggcagcacagccgacaacaactttcctttcacattgacagcagcagttccagttcttcaggccagctagtggatttcactcttcgggaattcctatggcagcatgtggagctagttctaagcaagaaaggtttcgatgacagtgtgggcaggaacccacagccttcccattttgaacttcctacttatcagaagtggatctcagcagcttcaaaactgtatgaggtggctattgatgggaaagaagaggacttggggtcacccactggagagctaacatctaagattttaagcagtattaaagtcttggaaggatttttggatattgacacaaaattctcagaaaaccgatgccaaaaagctttacccatggcccacagtgcctaccagtcaaatttgcctcataattacacaatgactgtccataagaatcagcttgcccaggctcttcgagtgtacagtcaacatgctagaggtccagcatttcacaaatacgccatgcagttacatgaggactgctacaaattttggagcaatggccatcagctctgtgaggagaggagtttaactgatcaacactgtgtgcacaaatttcactcattacctaaatcaggagaaaaaccagaggctgatagaaatccgcctgtgctatatcacaatagccgagctcgatctactggtgcttgcaactgtggaaggaaacaagcacctcgagatgatccctttgatatcaaagcagccaattatgacttctatcagcttctggaagaaaagtgttgtggaaaattggatcatatcaatttcccagtatttgaaccaagtactccagatcctgctcctgctaaaaatgaatcctctcctgctcctccagattcggatgctgataaaaaaaaacaaaaaaaaaaaaaacaaacaaaaaacaaacaaaaaaaaaaacaaaaaaaaaaaaaacacacggggaggccatctcatagcggggggagcaaaaacaagagcgaaaagagcggaagggggagacaaaggtcgcaccaaagcaacagtctggagaacaagggggaaaacgggcgggccccccaaaagggggcgaaaatctacaaaacgcgggaaccggtaatagagg

SEQ ID NO: 62280 - DNA, 389 bp, Homo sapiens
gctaacatctaagattttaagcagtattaaagtcttggaaggatttttggatattgacacaaaattctcagaaaaccgatgccaaaaagctttacccatggcccacagtgcctaccagtcaaatttgcctcataattacacaatgactgtccataagaatcagcttgcccaggctcttcgagtgtacagtcaacatgctagaggtccagcatttcacaaatacgccatgcagttacatgaggactgctacaaattttggagcaatggccatcagctctgtgaggagaggagtttaactgatcaacactgtgtgcacaaatttcactcattacctaaatcaggtagctaaaatttgttcagcattttgaaataaaaactttgagctgtgt

SEQ ID NO: 62281 - DNA, 3255 bp, Homo sapiens
gaccggaaggactctagagaacgctctgcactatggctggtcccgtgagcttgcgagaccttctaatgggagcgtcagcctggatgggctctgaaagtcccggagggtcccctactgagggcggagggagcgcggctggcggaccggagcctccatggcgggaggatgagatctgcgttgtgggaatcttcggcaagacggctctacgcctgaattccgagaagttctctcttgtgaatacggtgtgcgaccgacaggtctttcctctctttcgccaccaagatcctggggatccaggacctggaatcagaactgaggctggcgccgtgggtgaggccggtggagccgaggaccctggggctgcagccgggggttcagttcggggaagtggagctgtcgcggaaggtaaccgaactgaggcaggctcccaggactacagccttctgcaggcctactacagtcaggaaagcaaagttctgtatcttctcctcacctccatctgtgacaattcacagcttctccgggcttgtcgggctcttcagagcggggaagctggaggtggactctctttacctcatgcagaagcacacgagttctggaagcatcaagagaagctgcagtgcctcagtctcctttacctattctctgtctgtcatatcttgcttctggtccatcccacttgttcctttgatatcacttatgatcgagtattcagagccctggatgggctgagacagaaggtcctgccgctccttaaaacagccattaaggattgtccagttggcaaagactggaagctaaactgccgaccttgcccacctagactccttttcctctttcaactcaatggagccctcaaggtagaacctcctcggaaccaagacccagctcatccagacaagcccaagaaacattctcccaaaaggaggctgcagcatgccctggaggaccagatctatagaatcttccggaagagtcgtgtcttgactaatcagagcatcaactgcctctttactgtgcctgccaaccaagctttcgtgtacatagtaccgggaagccaggaggaggacccagtaggtatgttgctggaccaacttaggagtcattgtactgtgaaggacccggaatctttgctggtgcctgcacccctttctgggcctaggcgataccaggtgatgaggcagcacagccgacaacaactttcctttcacattgacagcagcagttccagttcttcaggccagctagtggatttcactcttcgggaattcctatggcagcatgtggagctagttctaagcaagaaaggtttcgatgacagtgtgggcaggaacccacagccttcccattttgaacttcctacttatcagaagtggatctcagcagcttcaaaactgtatgaggtggctattgatgggaaagaagaggacttggggtcacccactggagagctaacatctaagattttaagcagtattaaagtcttggaaggatttttggatattgacacaaaattctcagaaaaccgatgccaaaaagctttacccatggcccacagtgcctaccagtcaaatttgcctcataattacacaatgactgtccataagaatcagcttgcccaggctcttcgagtgtacagtcaacatgctagaggtccagcatttcacaaatacgccatgcagttacatgaggactgctacaaattttggagcaatggccatcagctctgtgaggagaggagtttaactgatcaacactgtgtgcacaaatttcactcattacctaaatcaggagaaaaaccagaggctgatagaaatccgcctgtgctatatcacaatagccgagctcgatctactggtgcttgcaactgtggaaggaaacaagcacctcgagatgatccctttgatatcaaagcagccaattatgacttctatcagcttctggaagaaaagtgttgtggaaaattggatcatatcaatttcccagtatttgaaccaagtactccagatcctgctcctgctaaaaatgaatcctctcctgctcctccagattcggatgctgataaacttaaagaaaaagaacctcaaacccaaggagagagcacgagcctgagtttagctttgagtttgggccaatccacagatagcttaggtacctatccagctgatccacaagcaggaggagataatccagaagttcatggtcaagtagaagtgaaaactgagaagaggccaaacttcgttgatcgacaggcatccacagttgagtatctcccaggcatgctacattcaaattgccctaaaggtctcctacccaaattctccagctggtctttggttaaactaggccctgctaagtcttataactttcatacaggtttggaccaacagggctttattccaggaacaaattatcttatgccttgggacattgtcatcaggactagagctgaagatgaaggagacttagacacaaactcttggcctgctccaaataaagctattcctggaaagagaagtgcggttgtaatgggaagaggaagacggcgagatgacatagctcgagcttttgtgggctttgaatatgaagactctcgaggtcggagattcatgtgctctgggcctgacaaagtaatgaaagtaatgggaagtgggccaaaggaatcagctttaaaagccctaaatagtgacatgcccttatatattctgtcatcctctcaaggtagagggctgaaacctcattatgctcaacttatgaggctttttgttgtggttcctgatgctcctttgcagataatactaatgcctcaggttcagccaggcccaccaccatgtccggtattctacccagaaaaacaagaaatcacccttccacctgatggcctttgggttttgagatttccttatgcatatgtgactgagagaggaccttgtttcccccctaaggaaaatgtgcagttaatgagctacaaggtgctccgtggggttcttaaggcagtaacacaataagtgttttccagccagttcaatcctatacttgagctggtttttgtttttggtatttgtggctgtgtttttggtatgtgtttactgtgttttcccaaatccaaaatgtgttttggttacaggagttcagtatttggaaactaatttgttctactttttcattatattgttgatatttattgtaaacgtgactacaactttctaataaagattggttgttctagaaaagaatataaaatacatggatgat

SEQ ID NO: 62282 - DNA, 3261 bp, Homo sapiens
ccacgagagattagcgaggcgatcccggtgtttaatttcagtaccagggctggcgtttacttctaattgcgaggcactctggcttgacagagttctctgaaagtcccggagggtcccctactgagggcggagggagcgcggctggcggaccggagcctccatggcgggaggatgagatctgcgttgtgggaatcttcggcaagacggctctacgcctgaattccgagaagttctctcttgtgaatacggtgtgcgaccgacaggtctttcctctctttcgccaccaagatcctggggatccaggacctggaatcagaactgaggctggcgccgtgggtgaggccggtggagccgaggaccctggggctgcagccgggggttcagttcggggaagtggagctgtcgcggaaggtaaccgaactgaggcaggctcccaggactacagccttctgcaggcctactacagtcaggaaagcaaagttctgtatcttctcctcacctccatctgtgacaattcacagcttctccgggcttgtcgggctcttcagagcggggaagctggaggtggactctctttacctcatgcagaagcacacgagttctggaagcatcaagagaagctgcagtgcctcagtctcctttacctattctctgtctgtcatatcttgcttctggtccatcccacttgttcctttgatatcacttatgatcgagtattcagagccctggatgggctgagacagaaggtcctgccgctccttaaaacagccattaaggattgtccagttggcaaagactggaagctaaactgccgaccttgcccacctagactccttttcctctttcaactcaatggagccctcaaggtagaacctcctcggaaccaagacccagctcatccagacaagcccaagaaacattctcccaaaaggaggctgcagcatgccctggaggaccagatctatagaatcttccggaagagtcgtgtcttgactaatcagagcatcaactgcctctttactgtgcctgccaaccaagctttcgtgtacatagtaccgggaagccaggaggaggacccagtaggtatgttgctggaccaacttaggagtcattgtactgtgaaggacccggaatctttgctggtgcctgcacccctttctgggcctaggcgataccaggtgatgaggcagcacagccgacaacaactttcctttcacattgacagcagcagttccagttcttcaggccagctagtggatttcactcttcgggaattcctatggcagcatgtggagctagttctaagcaagaaaggtttcgatgacagtgtgggcaggaacccacagccttcccattttgaacttcctacttatcagaagtggatctcagcagcttcaaaactgtatgaggtggctattgatgggaaagaagaggacttggggtcacccactggagagctaacatctaagattttaagcagtattaaagtcttggaaggatttttggatattgacacaaaattctcagaaaaccgatgccaaaaagctttacccatggcccacagtgcctaccagtcaaatttgcctcataattacacaatgactgtccataagaatcagcttgcccaggctcttcgagtgtacagtcaacatgctagaggtccagcatttcacaaatacgccatgcagttacatgaggactgctacaaattttggagcaatggccatcagctctgtgaggagaggagtttaactgatcaacactgtgtgcacaaatttcactcattacctaaatcaggagaaaaaccagaggctgatagaaatccgcctgtgctatatcacaatagccgagctcgatctactggtgcttgcaactgtggaaggaaacaagcacctcgagatgatccctttgatatcaaagcagccaattatgacttctatcagcttctggaagaaaagtgttgtggaaaattggatcatatcaatttcccagtatttgaaccaagtactccagatcctgctcctgctaaaaatgaatcctctcctgctcctccagattcggatgctgataaacttaaagaaaaagaacctcaaacccaaggagagagcacgagcctgagtttagctttgagtttgggccaatccacagatagcttaggtacctatccagctgatccacaagcaggaggagataatccagaagttcatggtcaagtagaagtgaaaactgagaagaggccaaacttcgttgatcgacaggcatccacagttgagtatctcccaggcatgctacattcaaattgccctaaaggtctcctacccaaattctccagctggtctttggttaaactaggccctgctaagtcttataactttcatacaggtttggaccaacagggctttattccaggaacaaattatcttatgccttgggacattgtcatcaggactagagctgaagatgaaggagacttagacacaaactcttggcctgctccaaataaagctattcctggaaagagaagtgcggttgtaatgggaagaggaagacggcgagatgacatagctcgagcttttgtgggctttgaatatgaagactctcgaggtcggagattcatgtgctctgggcctgacaaagtaatgaaagtaatgggaagtgggccaaaggaatcagctttaaaagccctaaatagtgacatgcccttatatattctgtcatcctctcaaggtagagggctgaaacctcattatgctcaacttatgaggctttttgttgtggttcctgatgctcctttgcagataatactaatgcctcaggttcagccaggcccaccaccatgtccggtattctacccagaaaaacaagaaatcacccttccacctgatggcctttgggttttgagatttccttatgcatatgtgactgagagaggaccttgtttcccccctaaggaaaatgtgcagttaatgagctacaaggtgctccgtggggttcttaaggcagtaacacaataagtgttttccagccagttcaatcctatacttgagctggtttttgtttttggtatttgtggctgtgtttttggtatgtgtttactgtgttttcccaaatccaaaatgtgttttggttacaggagttcagtatttggaaactaatttgttctactttttcattatattgttgatatttattgtaaacgtgactacaactttctaataaagattggttgttctagaaaagaatataaaatacatggatgat

SEQ ID NO: 62283 - DNA, 744 bp, Homo sapiens
ggatcctgcgctaaatccgtaccagaggaagacggcgagatgacatagctcgagcttttgtgggctttgaatatgaagactctcgaggtcggagattcatgtgctctgggcctgacaaagtaatgaaagtaatgggaagtgggccaaaggaatcagctttaaaagccctaaatagtgacatgcccttatatattctgtcatcctctcaaggtagagggctgaaacctcattatgctcaacttatgaggctttttgttgtggttcctgatgctcctttgcagataatactaatgcctcaggttcagccaggcccaccaccatgtccggtattctacccagaaaaacaagaaatcacccttccacctgatggcctttgggttttgagatttccttatgcatatgtgactgagagaggaccttgtttcccccctaaggaaaatgtgcagttaatgagctacaaggtgctccgtggggttcttaaggcagtaacacaataagtgttttccagccagttcaatcctatacttgagctggtttttgtttttggtatttgtggctgtgtttttggtatgtgtttactgtgttttcccaaatccaaaatgtgttttggttacaggagttcagtatttggaaactaatttgttctactttttcattatattgttgatatttattgtaaacgtgactacaactttctaataaagattggttgttctagaaaagaatataaaatacatggatgat

SEQ ID NO: 62284 - DNA, 397 bp, Homo sapiens
gctaacattatcagggcaaaggtatcctaatataatttggccattggcaaacactggaatctggatttcagtaaaatgaatttacaattgccttgagagaacatcccaagtaatgtgtgtgtttgtgcactaaaatgtgttgagattttttagtaataagaaatctgtctctatttctgaaggttgtggggcatttgcagagcatcactggtattgccttggcaagcattgctgagttctcttatgcaatcctgactcacggagtgggagccaacactccggggagacagcagtctattcctccccacctggcagccagagctctgaagactgttgcttcctctaacacatgagggaggctgaatccaccaaatataaacagccatccgtcactgca

SEQ ID NO: 62285 - DNA, 1245 bp, Homo sapiens
cggggcagagccgcggttcccgggcacaggggatggacgcgggaggtgagaagcggacgtgctttctgattggctgaggagtccgtggccgttggggcgggaaaaagctgtggagggttcgaggctgtggtggtaattgggttttcctcagacttgaggcgacgacacactcattggaaggggacgaggaatccagggtgtggcagaagactggagaggagctaagggggtcggtatgtggatccagtgaacccgtccaggtgccccaagaggctcgtgaatatggacggacccatgaggccacgatcggcctccctcgttgactttcagtttggagttgtcgccacagagacgattgaagacgccctgcttcacttggcccagcagaatgagcaagcagtgagggaggcttcggggcggctgggccgcttcagggagccccagatcgtggaggtttatggtaaaacaggcagagaacatctgcaggcaagccacaatccagccaagagataataagagagagtctcagaattggagggctctgaaacagcagcttgtcaacaagtttactctccgtcttgtgtcatgtgttcagctggccagcaaactttccttccgaaacaaaataatcagcaacattacagtcttgaatttcctccaggctctaggctatctacacactaaagaagaactgctggaatcagagcttgatgttttgaagtccttgaacttccgaattaatctgcccactcccctggcatatgtggagacgctcctagaggttttaggatacaatggctgtttggttccagccatgaggctgcatgcaacctgcctgacactgctcgacctggtctatcttctgcatgaacccatatatgagagcctgttgagggcttcaattgagaactccactcccagtcagctgcaaggggaaaagtttacttcagtgaaggaagacttcatgctgttggcagtaggaatcattgcagcaagtgctttcatccaaaaccatgagtgttggagccaggttgtggggcatttgcagagcatcactggtattgccttggcaagcattgctgagttctcttatgcaatcctgactcacggagtgggagccaacactccggggagacagcagtctattcctccccacctggcagccagagctctgaagactgttgcttcctctaacacatgagggaggctgaatccaccaaatataaacagccatccgtcactgca

SEQ ID NO: 62286 - DNA, 1273 bp, Homo sapiens
cggggcagagccgcggttcccgggcacaggggatggacgcgggaggtgagaagcggacgtgctttctgattggctgaggagtccgtggccgttggggcgggaaaaagctgtggagggttcgaggctgtggtggtaattgggttttcctcagacttgaggcgacgacacactcattggaaggggacgaggaatccagggtgtggcagaagactggagaggagctaagggggtcggtatgtggatccagtgaacccgtccaggtgccccaagaggctcgtgaatatggacggacccatgaggccacgatcggcctccctcgttgactttcagtttggagttgtcgccacagagacgattgaagacgccctgcttcacttggcccagcagaatgagcaagcagtgagggaggcttcggggcggctgggccgcttcagggagccccagatcgtggaggtttatggtaaaacaggcagagaacatctgcaggcaagccacaatccagccaagagataataagagagagtctcagaattggagggctctgaaacagcagcttgtcaacaagtttactctccgtcttgtgtcatgtgttcagctggccagcaaactttccttccgaaacaaaataatcagcaacattacagtcttgaatttcctccaggctctaggctatctacacactaaagaagaactgctggaatcagagcttgatgttttgaagtccttgaacttccgaattaatctgcccactcccctggcatatgtggagacgctcctagaggttttaggatacaatggctgtttggttccagccatgaggctgcatgcaacctgcctgacactgctcgacctggtctatcttctgcatgaacccatatatgagagcctgttgagggcttcaattgagaactccactcccagtcagctgcaaggggaaaagtttacttcagtgaaggaagacttcatgctgttggcagtaggaatcattgcagcaagtgctttcatccaaaaccatgagtgttggagccaggtatgcaccactgagcaggaccagcatggttgtggggcatttgcagagcatcactggtattgccttggcaagcattgctgagttctcttatgcaatcctgactcacggagtgggagccaacactccggggagacagcagtctattcctccccacctggcagccagagctctgaagactgttgcttcctctaacacatgagggaggctgaatccaccaaatataaacagccatccgtcactgca

SEQ ID NO: 62287 - DNA, 477 bp, Homo sapiens
gggtgggagatgggaggatcctaagagaagagggagaggaattagggaggaaaggaagggagatccaggtatagaaaacagcctgtgtagtggcttggagagggacagcatggtgggtttgggaactgtaagcaatttggaatgacaagcagagtgtgagggggaattaccaagagacaagactgaagatgaaggaataggctggattatgaagggctttgtgcactctgtcaagacgtatgaactttatcctaacattcttctttccctctcttttctttgctcagataatcagcaacattacagtcttgaatttcctccaggctctaggctatctacacactaaagaagaactgctggaatcagagcttgatgttttgaagtccttgaacttccgaattaatctgcccactcccctggcatatgtggagacgctcctagaggttttaggtatcttactgtgttagggaatatggg

SEQ ID NO: 62288 - DNA, 1320 bp, Homo sapiens
cggggcagagccgcggttcccgggcacaggggatggacgcgggaggtgagaagcggacgtgctttctgattggctgaggagtccgtggccgttggggcgggaaaaagctgtggagggttcgaggctgtggtggtaattgggttttcctcagacttgaggcgacgacacactcattggaaggggacgaggaatccagggtgtggcagaagactggagaggagctaagggggtcggtatgtggatccagtgaacccgtccaggtgccccaagaggctcgtgaatatggacggacccatgaggccacgatcggcctccctcgttgactttcagtttggagttgtcgccacagagacgattgaagacgccctgcttcacttggcccagcagaatgagcaagcagtgagggaggcttcggggcggctgggccgcttcagggagccccagatcgtggagtttgtttttctcctgtctgaacaatggtgtctggagaaatctgtgagctaccaggctgtagaaatcctagaaaaggtttatggtaaaacaggcagagaacatctgcaggcaagccacaatccagccaagagataataagagagagtctcagaattggagggctctgaaacagcagcttgtcaacaagtttactctccgtcttgtgtcatgtgttcagctggccagcaaactttccttccgaaacaaaataatcagcaacattacagtcttgaatttcctccaggctctaggctatctacacactaaagaagaactgctggaatcagagcttgatgttttgaagtccttgaacttccgaattaatctgcccactcccctggcatatgtggagacgctcctagaggttttaggatacaatggctgtttggttccagccatgaggctgcatgcaacctgcctgacactgctcgacctggtctatcttctgcatgaacccatatatgagagcctgttgagggcttcaattgagaactccactcccagtcagctgcaaggggaaaagtttacttcagtgaaggaagacttcatgctgttggcagtaggaatcattgcagcaagtgctttcatccaaaaccatgagtgttggagccaggttgtggggcatttgcagagcatcactggtattgccttggcaagcattgctgagttctcttatgcaatcctgactcacggagtgggagccaacactccggggagacagcagtctattcctccccacctggcagccagagctctgaagactgttgcttcctctaacacatgagggaggctgaatccaccaaatataaacagccatccgtcactgca

SEQ ID NO: 62289 - DNA, 452 bp, Homo sapiens
tgatatgagactgaaaccctggggttgtggagggaaattggctcagagatggacaacctggcaactgtgagtccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgga

SEQ ID NO: 62290 - DNA, 310 bp, Homo sapiens
acggtgttctggcagcagggacacctggactggggtacaggagttgttgcatattccatgaggctggtgtcgggaagcagggactgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgga

SEQ ID NO: 62291 - DNA, 1949 bp, Homo sapiens
gccctgtaggcttggctcagggaggcagctctgggaggcaaatggggcacctctgcttcccctcctccccggcccccgccccttggctccttggctgctagccggctgctgggcggggccatcctgtgtctttaagagggtggaacggggcttcgcgtctgtgcttcctgtggctgacgtcatctggaggagatttgctttctttttctccaaaaggggaggaaattgaaactgagtggcccacgatgggaagaggggaaagcccaggggtacaggaggcctctgggtgaaggcagaggctaacatggggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgga

SEQ ID NO: 62292 - DNA, 1915 bp, Homo sapiens
gccctgtaggcttggctcagggaggcagctctgggaggcaaatggggcacctctgcttcccctcctccccggcccccgccccttggctccttggctgctagccggctgctgggcggggccatcctgtgtctttaagagggtggaacggggcttcgcgtctgtgcttcctgtggctgacgtcatctggaggagatttgctttctttttctccaaaaggggaggaaattgaaactgagtggcccacgatgggaagaggggaaagcccaggggtacaggaggcctctgggtgaaggcagaggctaacatggggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgtgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgga

SEQ ID NO: 62293 - DNA, 1790 bp, Homo sapiens
  misc_feature (12)..(12): n is a, c, g, or t
  misc_feature (15)..(15): n is a, c, g, or t
tcatcgctgtcnccncgcgtatgggattcgtcgaccacgcctcgttttctccaaaaggggaggaaattgaaactgagtggcccacgatgggaagaggggaaagcccaggggtacaggaggcctctgggtgaaggcagaggctaacatggggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgga

SEQ ID NO: 62294 - DNA, 1880 bp, Homo sapiens
  misc_feature (12)..(12): n is a, c, g, or t
  misc_feature (15)..(15): n is a, c, g, or t
  misc_feature (1849)..(1849): n is a, c, g, or t
tcatcgctgtcnccncgcgtatgggattcgtcgaccacgcctcgttttctccaaaaggggaggaaattgaaactgagtggcccacgatgggaagaggggaaagcccaggggtacaggaggcctctgggtgaaggcagaggctaacatggggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttggaaaaaaaaaaatgggtacccaactgttggaaaatcaataaaggttaattcacacattttnttatcggcccccgtggcctcagagggggagc

SEQ ID NO: 62295 - DNA, 1633 bp, Homo sapiens
  misc_feature (12)..(12): n is a, c, g, or t
  misc_feature (15)..(15): n is a, c, g, or t
  misc_feature (1623)..(1623): n is a, c, g, or t
tcatcgctgtcnccncgcgtatgggattcgtcgaccacgcctcgttttctccaaaaggggaggaaattgaaactgagtggcccacgatgggaagaggggaaagcccaggggtacaggaggcctctgggtgaaggcagaggctaacatggggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacttgagtgaatgggatcctctagancactgcgcac

SEQ ID NO: 62296 - DNA, 1755 bp, Homo sapiens
  misc_feature (12)..(12): n is a, c, g, or t
  misc_feature (15)..(15): n is a, c, g, or t
tcatcgctgtcnccncgcgtatgggattcgtcgaccacgcctcgttttctccaaaaggggaggaaattgaaactgagtggcccacgatgggaagaggggaaagcccaggggtacaggaggcctctgggtgaaggcagaggctaacatggggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactccacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgga

SEQ ID NO: 62297 - DNA, 1697 bp, Homo sapiens
  misc_feature (12)..(12): n is a, c, g, or t
  misc_feature (15)..(15): n is a, c, g, or t
tcatcgctgtcnccncgcgtatgggattcgtcgaccacgcctcgttttctccaaaaggggaggaaattgaaactgagtggcccacgatgggaagaggggaaagcccaggggtacaggaggcctctgggtgaaggcagaggctaacatggggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgga

SEQ ID NO: 62298 - DNA, 2114 bp, Homo sapiens
agcggctcctcctcctcctgctcccccggacagaggttccgggaaccagccgggccggggcggggcggggcgagggagaggggcggccgcgcggatcactgaggctgtggcggcactgcgcccggcgctcgcgtccgtccgcccgtccgcccgcccagccatgactgcgccggtccccgcgccgcggatcctgttgccgttgctgttgctgctgctgctaacgccgcctccgggtgcacgtggtgaggtgtgtatggcttcccgtggactcagcctcttccccgagtcctgtccagatttctgctgtggtacctgtgatgaccaatactgctgctctgacgtgctgaagaaatttgtgtggagcgaggaaaggtgtgctgtgcctgaggccagcgtgcctgccagtgtagagccggtggagcagctgggctcggcgctgaggtttcgccctggctacaacgaccccatgtcagggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgga

SEQ ID NO: 62299 - DNA, 1964 bp, Homo sapiens
  misc_feature (12)..(12): n is a, c, g, or t
  misc_feature (15)..(15): n is a, c, g, or t
tcatcgctgtcnccncgcgtatgggattcgtcgaccacgcctcgttttctccaaaaggggaggaaattgaaactgagtggcccacgatgggaagaggggaaagcccaggggtacaggaggcctctgggtgaaggcagaggctaacatggggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggtgagtgcccctgccaactctagccctgcccgacttcccgagtctctgccagcatccctcgggcacccatcccaaactacatcactcaacaggcctctgcccctttctgcttgcctgccactcacacggcagcccaccatgctcacagccaaccagggtcctctctgctttcaggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgga

SEQ ID NO: 62300 - DNA, 1756 bp, Homo sapiens
  misc_feature (12)..(12): n is a, c, g, or t
  misc_feature (15)..(15): n is a, c, g, or t
tcatcgctgtcnccncgcgtatgggattcgtcgaccacgcctcgttttctccaaaaggggaggaaattgaaactgagtggcccacgatgggaagaggggaaagcccaggggtacaggaggcctctgggtgaaggcagaggctaacatggggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgtgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgga

SEQ ID NO: 62301 - DNA, 1743 bp, Homo sapiens
  misc_feature (12)..(12): n is a, c, g, or t
  misc_feature (15)..(15): n is a, c, g, or t
tcatcgctgtcnccncgcgtatgggattcgtcgaccacgcctcgttttctccaaaaggggaggaaattgaaactgagtggcccacgatgggaagaggggaaagcccaggggtacaggaggcctctgggtgaaggcagaggctaacatggggttcggagcgaccttggccgttggcctgaccatctttgtgctgtctgtcgtcactatcatcatctgcttcacctgctcctgctgctgcctttacaagacgtgccgccgaccacgtccctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgga

SEQ ID NO: 62302 - DNA, 1585 bp, Homo sapiens
cgctccgaaccctgacatggggtcgttgtagccagggcgaaacctcagcgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgga

SEQ ID NO: 62303 - DNA, 2023 bp, Homo sapiens
agcggctcctcctcctcctgctcccccggacagaggttccgggaaccagccgggccggggcggggcggggcgagggagaggggcggccgcgcggatcactgaggctgtggcggcactgcgcccggcgctcgcgtccgtccgcccgtccgcccgcccagccatgactgcgccggtccccgcgccgcggatcctgttgccgttgctgttgctgctgctgctaacgccgcctccgggtgcacgtggtgaggtgtgtatggcttcccgtggactcagcctcttccccgagtcctgtccagatttctgctgtggtacctgtgatgaccaatactgctgctctgacgtgctgaagaaatttgtgtggagcgaggaaaggtgtgctgtgcctgaggccagcgtgcctgccagtgtagagccggtggagcagctgggctcggcgctgaggtttcgccctggctacaacgaccccatgtcagggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccacttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgga

SEQ ID NO: 62304 - DNA, 1699 bp, Homo sapiens
  misc_feature (12)..(12): n is a, c, g, or t
  misc_feature (15)..(15): n is a, c, g, or t
tcatcgctgtcnccncgcgtatgggattcgtcgaccacgcctcgttttctccaaaaggggaggaaattgaaactgagtggcccacgatgggaagaggggaaagcccaggggtacaggaggcctctgggtgaaggcagaggctaacatggggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccacttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgga

SEQ ID NO: 62305 - DNA, 2118 bp, Homo sapiens
  misc_feature (12)..(12): n is a, c, g, or t
  misc_feature (15)..(15): n is a, c, g, or t
tcatcgctgtcnccncgcgtatgggattcgtcgaccacgcctcgttttctccaaaaggggaggaaattgaaactgagtggcccacgatgggaagaggggaaagcccaggggtacaggaggcctctgggtgaaggcagaggctaacatggggttcggagcgaccttggccgttggcctgaccatctttgtgctgtctgtcgtcactatcatcatctgcttcacctgctcctgctgctgcctttacaagacgtgccgccgaccacgtcgtaagcgtgcccaccctgccccactgtgaccccctggggtggtaagggaagctgaccaggccctgctttggctaagctggagggatgggtggcaagcctggctctcaagacctggggagatggaggagggtcctgactggaattctctttgcagcggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggtgagtgcccctgccaactctagccctgcccgacttcccgagtctctgccagcatccctcgggcacccatcccaaactacatcactcaacaggcctctgcccctttctgcttgcctgccactcacacggcagcccaccatgctcacagccaaccagggtcctctctgctttcaggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgga

SEQ ID NO: 62306 - DNA, 1465 bp, Homo sapiens
  misc_feature (12)..(12): n is a, c, g, or t
  misc_feature (15)..(15): n is a, c, g, or t
tcatcgctgtcnccncgcgtatgggattcgtcgaccacgcctcgttttctccaaaaggggaggaaattgaaactgagtggcccacgatgggaagaggggaaagcccaggggtacaggaggcctctgggtgaaggcagaggctaacatggggttcggagcgaccttggccgttggcctgaccatctttgtgctgtctgtcgtcactatcatcatctgcttcacctgctcctgctgctgcctttacaagacgtgccgccgaccacgtctatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgga

SEQ ID NO: 62307 - DNA, 1356 bp, Homo sapiens
  misc_feature (12)..(12): n is a, c, g, or t
  misc_feature (15)..(15): n is a, c, g, or t
tcatcgctgtcnccncgcgtatgggattcgtcgaccacgcctcgttttctccaaaaggggaggaaattgaaactgagtggcccacgatgggaagaggggaaagcccaggggtacaggaggcctctgggtgaaggcagaggctaacatggggttcggagcgaccttggccgttggcctgaccatctttgtgctgtctgtcgtcactatcatcatcctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgga

SEQ ID NO: 62308 - DNA, 1925 bp, Homo sapiens
  misc_feature (12)..(12): n is a, c, g, or t
  misc_feature (15)..(15): n is a, c, g, or t
tcatcgctgtcnccncgcgtatgggattcgtcgaccacgcctcgttttctccaaaaggggaggaaattgaaactgagtggcccacgatgggaagaggggaaagcccaggggtacaggaggcctctgggtgaaggcagaggctaacatggggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggtgagtgcccctgccaactctagccctgcccgacttcccgagtctctgccagcatccctcgggcacccatcccaaactacatcactcaacaggcctctgcccctttctgcttgcctgccactcacacggcagcccaccatgctcacagccaaccagggtcctctctgctttcaggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctctgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgga

SEQ ID NO: 62309 - DNA, 1152 bp, Homo sapiens
  misc_feature (12)..(12): n is a, c, g, or t
  misc_feature (15)..(15): n is a, c, g, or t
tcatcgctgtcnccncgcgtatgggattcgtcgaccacgcctcgttttctccaaaaggggaggaaattgaaactgagtggcccacgatgggaagaggggaaagcccaggggtacaggaggcctctgggtgaaggcagaggctaacatggggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagacaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgga

SEQ ID NO: 62310 - DNA, 1476 bp, Homo sapiens
agcggctcctcctcctcctgctcccccggacagaggttccgggaaccagccgggccggggcggggcggggcgagggagaggggcggccgcgcggatcactgaggctgtggcggcactgcgcccggcgctcgcgtccgtccgcccgtccgcccgcccagccatgactgcgccggtccccgcgccgcggatcctgttgccgttgctgttgctgctgctgctaacgccgcctccgggtgcacgtggtgaggtgtgtatggcttcccgtggactcagcctcttccccgagtcctgtccagatttctgctgtggtacctgtgatgaccaatactgctgctctgacgtgctgaagaaatttgtgtggagcgaggaaaggtgtgctgtgcctgaggccagcgtgcctgccagtgtagagccggtggagcagctgggctcggcgctgaggtttcgccctggctacaacgaccccatgtcagggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagacaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgga

SEQ ID NO: 62311 - DNA, 817 bp, Homo sapiens
  misc_feature (12)..(12): n is a, c, g, or t
  misc_feature (15)..(15): n is a, c, g, or t
tcatcgctgtcnccncgcgtatgggattcgtcgaccacgcctcgttttctccaaaaggggaggaaattgaaactgagtggcccacgatgggaagaggggaaagcccaggggtacaggaggcctctgggtgaaggcagaggctaacatggggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctgtatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgga

SEQ ID NO: 62312 - DNA, 907 bp, Homo sapiens
  misc_feature (12)..(12): n is a, c, g, or t
  misc_feature (15)..(15): n is a, c, g, or t
  misc_feature (876)..(876): n is a, c, g, or t
tcatcgctgtcnccncgcgtatgggattcgtcgaccacgcctcgttttctccaaaaggggaggaaattgaaactgagtggcccacgatgggaagaggggaaagcccaggggtacaggaggcctctgggtgaaggcagaggctaacatggggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctgtatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttggaaaaaaaaaaatgggtacccaactgttggaaaatcaataaaggttaattcacacattttnttatcggcccccgtggcctcagagggggagc

SEQ ID NO: 62313 - DNA, 428 bp, Homo sapiens
  misc_feature (12)..(12): n is a, c, g, or t
  misc_feature (15)..(15): n is a, c, g, or t
tcatcgctgtcnccncgcgtatgggattcgtcgaccacgcctcgttttctccaaaaggggaggaaattgaaactgagtggcccacgatgggaagaggggaaagcccaggggtacaggaggcctctgggtgaaggcagaggctaacatggggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcaccagcaatacaggggataatctagagtg

SEQ ID NO: 62314 - DNA, 491 bp, Homo sapiens
  misc_feature (12)..(12): n is a, c, g, or t
  misc_feature (15)..(15): n is a, c, g, or t
tcatcgctgtcnccncgcgtatgggattcgtcgaccacgcctcgttttctccaaaaggggaggaaattgaaactgagtggcccacgatgggaagaggggaaagcccaggggtacaggaggcctctgggtgaaggcagaggctaacatggggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctacccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgga

SEQ ID NO: 62315 - DNA, 1527 bp, Homo sapiens
gccctgtaggcttggctcagggaggcagctctgggaggcaaatggggcacctctgcttcccctcctccccggcccccgccccttggctccttggctgctagccggctgctgggcggggccatcctgtgtctttaagagggtggaacggggcttcgcgtctgtgcttcctgtggctgacgtcatctggaggagatttgctttctttttctccaaaaggggaggaaattgaaactgagtggcccacgatgggaagaggggaaagcccaggggtacaggaggcctctgggtgaaggcagaggctaacatggggttcggagcgaccttggccgttggcctgaccatctttctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgaaatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgga

SEQ ID NO: 62316 - DNA, 721 bp, Homo sapiens
tcccctgtccccgcagacaggtacagctgagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgga

SEQ ID NO: 62317 - DNA, 2133 bp, Homo sapiens
  misc_feature (12)..(12): n is a, c, g, or t
  misc_feature (15)..(15): n is a, c, g, or t
  misc_feature (1805)..(1805): n is a, c, g, or t
  misc_feature (1807)..(1807): n is a, c, g, or t
  misc_feature (1810)..(1810): n is a, c, g, or t
  misc_feature (1813)..(1813): n is a, c, g, or t
tcatcgctgtcnccncgcgtatgggattcgtcgaccacgcctcgttttctccaaaaggggaggaaattgaaactgagtggcccacgatgggaagaggggaaagcccaggggtacaggaggcctctgggtgaaggcagaggctaacatggggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttggaaaaaaaaaaaaaaananacnaanaacaaaaaaacacaccaacaacccacacaaacaacaacaaaaccaggcgggggcgccgctcacaaacaaacacacaccccccaagaggagcccaaaccgacgcacggaaacgagcaccgcaacaagacagctgacgaaaaaacaggaggcccacaacagaaagacagaggaagaagaaaacaagagaaccagaacgagagagcaggaagcaaaaaaacaccgaggagagcaaggagcaccaccgacgccgaaggcacaatcccggagaaaaacgaacaacaacacatgtcgggaagacaaatgagggaacaactacacag

SEQ ID NO: 62318 - DNA, 1848 bp, Homo sapiens
  misc_feature (12)..(12): n is a, c, g, or t
  misc_feature (15)..(15): n is a, c, g, or t
tcatcgctgtcnccncgcgtatgggattcgtcgaccacgcctcgttttctccaaaaggggaggaaattgaaactgagtggcccacgatgggaagaggggaaagcccaggggtacaggaggcctctgggtgaaggcagaggctaacatggggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttggaaaaaaaacaagtccaatctccctatcaactagcccctcagtaaccaccaccaagaggg

SEQ ID NO: 62319 - DNA, 1145 bp, Homo sapiens
  misc_feature (12)..(12): n is a, c, g, or t
  misc_feature (15)..(15): n is a, c, g, or t
tcatcgctgtcnccncgcgtatgggattcgtcgaccacgcctcgttttctccaaaaggggaggaaattgaaactgagtggcccacgatgggaagaggggaaagcccaggggtacaggaggcctctgggtgaaggcagaggctaacatggggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccacttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgga

SEQ ID NO: 62320 - DNA, 661 bp, Homo sapiens
  misc_feature (12)..(12): n is a, c, g, or t
  misc_feature (15)..(15): n is a, c, g, or t
tcatcgctgtcnccncgcgtatgggattcgtcgaccacgcctcgttttctccaaaaggggaggaaattgaaactgagtggcccacgatgggaagaggggaaagcccaggggtacaggaggcctctgggtgaaggcagaggctaacatggggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaggaagatggcggacattcagactgagcgtgcctaccaaaagcagccgaccatctttcaaaacaagaagagggtcctgctgggagaaactggcaaggagaagctcccgcggtactacaagaacatcggtctggggcttcaagacacccaaggaggctattgagggcacctacattgacaagaaatgccccttcactggtaatgtgtccattcgagggcggatcctctctggcgtggtg

SEQ ID NO: 62321 - DNA, 454 bp, Homo sapiens
ttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttggaagctgctgccccctttcttcctggcctcggctgctggaattggaa

SEQ ID NO: 62322 - DNA, 403 bp, Homo sapiens
tattagcaatgtttattaaaagtcacaaaatactagtctctgaaacaaaaatctcatgactgagattggcttttagtaaatagttgccatgaagaaaaacagttctttgggcaaagctttaatgagtgcattatttataataacaaactttagaaacaacctaaatataaaaaaaaagtgtaacaaataaactgtggcacaaccattcaatggaacgttaaacacaattttcaattattttataaagaaactgtaataacataaaaaatgaaaagcaatgagtaattttaaaaatcttcactcaactgggaatgttatttttatagtgtaaaagattagtaaatttttttttttttgagacagattcttgctctgttgcccaggctggagtgagtggcatgat

SEQ ID NO: 62323 - DNA, 892 bp, Homo sapiens
  misc_feature (639)..(639): n is a, c, g, or t
  misc_feature (718)..(719): n is a, c, g, or t
  misc_feature (736)..(736): n is a, c, g, or t
  misc_feature (738)..(739): n is a, c, g, or t
  misc_feature (791)..(791): n is a, c, g, or t
  misc_feature (813)..(813): n is a, c, g, or t
ggtcttctccaagctgaagggccgtggcggtcttctggggaggcagcgttcagggagattactatggagatctggctgctcgcctgggctatttccccagtagcattgtccgagaggaccagaccctgaaacctggcaaagtcgatgtgaagacagacacttcctcttcaaattcctggtgattggcagtgcaggaactggcaaatcatgtctccttcatcagttcattgagaataagttcaaacaggactccaaccacacaatcggcgtggagtttggatcccgggtggtcaacgtgggtgggaagactgtgaagctacagatttgggacacggctggccaggagcggtttcggtcagtgacgcggagttattaccgaggggcggctggagccctgctggtgtacgacatcaccagccgggagacatacaactcactggctgcctggctgacggatgcccgcaccctggccagccccaacatcgtggtcatcctctgtggcaacaagaaggacctggaccctgagcgggaggtcactttcctggaggcctcccgctttgcccaggagaatgagctgatgttcctggagaccagcgctctcacaggcgagaacgtggaggaggcgttcctcaagtgtgnccgcactatcctcaacaagattgactcaggcgagctagacccggagaggatgggctctggcattcagtacggggatgcnntcctccgcagcttcggnannctcggagtgcccaggccgtggccctcagcgtgtggtgctgagctctgtgganccagtcacctgttctccaggancaagcctgctggggccaggccaaggtctgagagccgtgtctaacttgcctggccggaaaaactaattggccactgtccc

SEQ ID NO: 62324 - DNA, 378 bp, Homo sapiens
agacttacttgggtgttcagaaagggcctctgaacaggtggcatttaagctgagattcatatgacaaggatggagcagttatgtggagatcagggagaagggagaatgcaaaggccttcagcaggcacaagcttgccatcttcccagaccctagcttttaactcctcttccccaggttcagggagattactatggagatctggctgctcgcctgggctatttccccagtagcattgtccgagaggaccagaccctgaaacctggcaaagtcgatgtgaagacagacaaatgggatttctactgccagtgagctcagcctaccgctggccctgccgtttcccctccttgggtttatgcaaatacaatcagcccagtgca

SEQ ID NO: 62325 - DNA, 899 bp, Homo sapiens
  misc_feature (646)..(646): n is a, c, g, or t
  misc_feature (725)..(726): n is a, c, g, or t
  misc_feature (743)..(743): n is a, c, g, or t
  misc_feature (745)..(746): n is a, c, g, or t
  misc_feature (798)..(798): n is a, c, g, or t
  misc_feature (820)..(820): n is a, c, g, or t
cgccggaggggggcggaggcggaagtggcggtgccgggcccggggagtaggaaggagccggggctgtagccggagtggagcggctgccagccgaggagcaggcgcggccgcggcgccatattgcggccctcagcggccgcgaccgagtcatggctgagacctacgacttcctcttcaaattcctggtgattggcagtgcaggaactggcaaatcatgtctccttcatcagttcattgagaataagttcaaacaggactccaaccacacaatcggcgtggagtttggatcccgggtggtcaacgtgggtgggaagactgtgaagctacagatttgggacacggctggccaggagcggtttcggtcagtgacgcggagttattaccgaggggcggctggagccctgctggtgtacgacatcaccagccgggagacatacaactcactggctgcctggctgacggatgcccgcaccctggccagccccaacatcgtggtcatcctctgtggcaacaagaaggacctggaccctgagcgggaggtcactttcctggaggcctcccgctttgcccaggagaatgagctgatgttcctggagaccagcgctctcacaggcgagaacgtggaggaggcgttcctcaagtgtgnccgcactatcctcaacaagattgactcaggcgagctagacccggagaggatgggctctggcattcagtacggggatgcnntcctccgcagcttcggnannctcggagtgcccaggccgtggccctcagcgtgtggtgctgagctctgtgganccagtcacctgttctccaggancaagcctgctggggccaggccaaggtctgagagccgtgtctaacttgcctggccggaaaaactaattggccactgtccc

SEQ ID NO: 62326 - DNA, 536 bp, Homo sapiens
cagaccactaccttccatacaccaccctggagcctccctgtgacggggcttcctgaccggcctgtctgagcatgaaagggctgagccctccataggcgggcgtgctgacaggatgcacgtggtggaggacatctgctgcatttggctgtgtgacatctccccctcgccttctgaacaggtctctgcagaggccatgaaaaatgtgccattcagcttttctgctaattgttgaaggcccagctgccaccgctctggatctacaccccatttgcaatgaagccacacatctcgtgagccactcccagcccgtgactgggcacagcaggggccctaacgcaggatagctctgaggaggtgtgggacccttgacagtggaggacattggcccgagaactcttcatcgacctgatcaaacctctcttggaactgcaaagcagtctgagactcttctcccagtttattatctccctattaactatctatagtgtagctcattggaaaagagtcattaattttgattatcaaattcactcctt

SEQ ID NO: 62327 - DNA, 337 bp, Homo sapiens
ggtggacccagccttctgtctgtgttgtgcacaggggacacgaggactccccctgccctgccgcagcccccagagcacatggtgcgggttccaatccgcgcctgccctgccacagcctccagagcacatggcgcgctttccaaaccactcctgggagcctagaggccagaggagggaggagagcaggaccagcagctggcccagaccccgcctcttcctacaccacttccgcttttctccctcctcactgagtcatcttgaaagggctcagcagcagtaactgtgggacaggggctcttccatttgaaaaattaaaagaggcttggttaaggcacca

SEQ ID NO: 62328 - DNA, 222 bp, Homo sapiens
gtgccattacaacttttctgtaaccctgaaattgtgtcaaagtgaaaattttttaaatgagattataagagcataatcaaattggaattttcttaggataccagagaatcattttcttctcaggtaaaggaatttttcttttgtagtccagagctatacatgattaagaaaatgttcagaccaggaagatgacatctctgctaacctaatcgattatcatgg

SEQ ID NO: 62329 - DNA, 5764 bp, Homo sapiens
atctctatccttcttctggtccttcctagaaaatcaggtggagatgatagtggcttgcatgatggtggtagagctggaggtgcagggcaaaggtcagattctgaatatattttgaaagtaaaggcaacaagatttcctgacagattgattatggtgtgtcaaagaaagagaggaatgcaggatgattccagtgtttttgttgacaactataagtctggagctgccaactggatgcagaagttcactggagggcccagcctggggaaaggatcaggagcaggttaggcatgttaagcttgagatgtctgttaaacatccagataggaatgtcaaagatgcacttgtgtttaagagtcaggaatgcaagagggaattttaggctagaaacaaaaagttagaaattattcgatacagatggtatttaaagctgtgtgactgactgacatgacagaagtggcgagaatagactgagaagtccaaggaatgagccttggaccactccagtgttaggtaagtagttgaaaaaaagagagagagagaaggcatcaaaggagactgaggaagagtgatcaggaaagcataggaaaatccgagaaacatatggtgtcctggaatctatatgaaaaagatatattcagaaagacagagtgataaatctgtcaaattattgaatttgtcaggtaaaataagaacagagaattgatctttggacttagcaaagcagagattatcagtgacttttataaaaatagtttcggtagtgtggaaagatcaaacttctgtttagagtgggtttcagagagaacaacaggaattgaagaagtaataaactttgccaaccagtttagctccaaaggaaaagagggaaatatgatggtagctggcaggggaagtgtggtcaagagaggttttttgtttgtttttcaagatggaagaaataacagtatgtatgtaagctcacaggagggatccagcaggcatggggaaattgatgatataggacagaaagggaagaatggctccttgtgaaagtgaaaggggatgggatctacaggatgaacatgcaaacaaagactggctgcaaagagaggcatgaatagttcatttacagaaacagcaaaggcagagtgttggtacagatgctggtaagtggaaaaatatcatggtaggaggttatggagttccattctaaacacttcaacttcatcagtgaaataagcacggtaatttagcagaatgtgaagatgtaaaagaacagaatttgagaaaacagacgatatgaaataattattagaaaagcagagactgaagaaactgtcatctccttatgtgctaatgagtttaataatgtcctccagtcaccacaagccttctttcaaactacacaattccaactgcttccgtctcagagtatcttgaaataatgatctgaccgcctgttagaccagtgaagggaaggaatttgggttgatttaagaagagaatcctcatggtcatggtagactgatatggagagaaaacattttgaggaaaaatactcaactaaattcatttctactccagcatgcagtttcaagtcaagttccaccttagctccaggtggcaggcagagcaggatgcagaggcacagcacaagtaagggatccaatgactgagtcaagaattacataacctggccagacagctggtacatgggaaagtgctaagagggcaccaacagcgttcctcctccccaaggagcataatgtgatggttcctgccggccctggctgactctcgccgtccttggagataattgggttcagtgccacctggaccagaactggggatgcggaagcaacctgccagacacgcgcgaggttcgaggctgagatggatcttgaggcggcaaagaacggaacagcctggcgccccacgagcgcggagggcgactttgaactgggcatcagcagcaaacaaaaaaggaaaaaaacgaagacagtgaaaatgattggagtattaacattgtttcgatactccgattggcaggataaattgtttatgtcgctgggtaccatcatggccatagctcacggatcaggtctccccctcatgatgatagtatttggagagatgactgacaaatttgttgatactgcaggaaacttctcctttccagtgaacttttccttgtcgctgctaaatccaggcaaaattctggaagaagaaatgactagatatgcatattactactcaggattgggtgctggagttcttgttgctgcctatatacaagtttcattttggactttggcagctggtcgacagatcaggaaaattaggcagaagttttttcatgctattctacgacaggaaataggatggtttgacatcaatgacaccactgaactcaatacgcggctaacagatgacatctccaaaatcagtgaaggaattggtgacaaggttggaatgttctttcaagcagtagccacgttttttgcaggattcatagtgggattcatcagaggatggaagctcacccttgtgataatggccatcagccctattctaggactctctgcagccgtttgggcaaagatactctcggcatttagtgacaaagaactagctgcttatgcaaaagcaggcgccgtggcagaagaggctctgggggccatcaggactgtgatagctttcgggggccagaacaaagagctggaaaggtatcagaaacatttagaaaatgccaaagagattggaattaaaaaagctatttcagcaaacatttccatgggtattgccttcctgttaatatatgcatcatatgcactggccttctggtatggatccactctagtcatatcaaaagaatatactattggaaatgcaatgacagtttttttttcaatcctaattggagctttcagtgttggccaggctgccccatgtattgatgcttttgccaatgcaagaggagcagcatatgtgatctttgatattattgataataatcctaaaattgacagtttttcagagagaggacacaaaccagacagcatcaaagggaatttggagttcaatgatgttcacttttcttacccttctcgagctaacgtcaagatcttgaagggcctcaacctgaaggtgcagagtgggcagacggtggccctggttggaagtagtggctgtgggaagagcacaacggtccagctgatacagaggctctatgaccctgatgagggcacaattaacattgatgggcaggatattaggaactttaatgtaaactatctgagggaaatcattggtgtggtgagtcaggagccggtgctgttttccaccacaattgctgaaaatatttgttatggccgtggaaatgtaaccatggatgagataaagaaagctgtcaaagaggccaacgcctatgagtttatcatgaaattaccacagaaatttgacaccctggttggagagagaggggcccagctgagtggtgggcagaagcagaggatcgccattgcacgtgccctggttcgcaaccccaagatccttctgctggatgaggccacgtcagcattggacacagaaagtgaagctgaggtacaggcagctctggataaggccagagaaggccggaccaccattgtgatagcacaccgactgtctacggtccgaaatgcagatgtcatcgctgggtttgaggatggagtaattgtggagcaaggaagccacagcgaactgatgaagaaggaaggggtgtacttcaaacttgtcaacatgcagacatcaggaagccagatccagtcagaagaatttgaactaaatgatgaaaaggctgccactagaatggccccaaatggctggaaatctcgcctatttaggcattctactcagaaaaaccttaaaaattcacaaatgtgtcagaagagccttgatgtggaaaccgatggacttgaagcaaatgtgccaccagtgtcctttctgaaggtcctgaaactgaataaaacagaatggccctactttgtcgtgggaacagtatgtgccattgccaatggggggcttcagccggcattttcagtcatattctcagagatcatagcgatttttggaccaggcgatgatgcagtgaagcagcagaagtgcaacatattctctttgattttcttatttctgggaattatttctttttttactttcttccttcagggtttcacgtttgggaaagctggcgagatcctcaccagaagactgcggtcaatggcttttaaagcaatgctaagacaggacatgagctggtttgatgaccataaaaacagtactggtgcactttctacaagacttgccacagatgctgcccaagtccaaggagccacaggaaccaggttggctttaattgcacagaatatagctaaccttggaactggtattatcatatcatttatctacggttggcagttaaccctattgctattagcagttgttccaattattgctgtgtcaggaattgttgaaatgaaattgttggctggaaatgccaaaagagataaaaaagaactggaagctgctggaaagattgcaacagaggcaatagaaaatattaggacagttgtgtctttgacccaggaaagaaaatttgaatcaatgtatgttgaaaaattgtatggaccttacaggaattctgtgcagaaggcacacatctatggaattacttttagtatctcacaagcatttatgtatttttcctatgccggttgttttcgatttggtgcatatctcattgtgaatggacatatgcgcttcagagatgttattctggtgttttctgcaattgtatttggtgcagtggctctaggacatgccagttcatttgctccagactatgctaaagctaagctgtctgcagcccacttattcatgctgtttgaaagacaacctctgattgacagctacagtgaagaggggctgaagcctgataaatttgaaggaaatataacatttaatgaagtcgtgttcaactatcccacccgagcaaacgtgccagtgcttcaggggctgagcctggaggtgaagaaaggccagacactagccctggtgggcagcagtggctgtgggaagagcacggtggtccagctcctggagcggttctacgaccccttggcggggacagtgcttctcgatggtcaagaagcaaagaaactcaatgtccagtggctcagagctcaactcggaatcgtgtctcaggagcctatcctatttgactgcagcattgccgagaatattgcctatggagacaacagccgggttgtatcacaggatgaaattgtgagtgcagccaaagctgccaacatacatcctttcatcgagacgttaccccacaaatatgaaacaagagtgggagataaggggactcagctctcaggaggtcaaaaacagaggattgctattgcccgagccctcatcagacaacctcaaatcctcctgttggatgaagctacatcagctctggatactgaaagtgaaaaggttgtccaagaagccctggacaaagccagagaaggccgcacctgcattgtgattgctcaccgcctgtccaccatccagaatgcagacttaatagtggtgtttcagaatgggagagtcaaggagcatggcacgcatcagcagctgctggcacagaaaggcatctatttttcaatggtcagtgtccaggctgggacacagaacttatgaacttttgctacagtatattttaaaaataaattcaaattattctacccatttt

SEQ ID NO: 62330 - DNA, 5785 bp, Homo sapiens
atctctatccttcttctggtccttcctagaaaatcaggtggagatgatagtggcttgcatgatggtggtagagctggaggtgcagggcaaaggtcagattctgaatatattttgaaagtaaaggcaacaagatttcctgacagattgattatggtgtgtcaaagaaagagaggaatgcaggatgattccagtgtttttgttgacaactataagtctggagctgccaactggatgcagaagttcactggagggcccagcctggggaaaggatcaggagcaggttaggcatgttaagcttgagatgtctgttaaacatccagataggaatgtcaaagatgcacttgtgtttaagagtcaggaatgcaagagggaattttaggctagaaacaaaaagttagaaattattcgatacagatggtatttaaagctgtgtgactgactgacatgacagaagtggcgagaatagactgagaagtccaaggaatgagccttggaccactccagtgttaggtaagtagttgaaaaaaagagagagagagaaggcatcaaaggagactgaggaagagtgatcaggaaagcataggaaaatccgagaaacatatggtgtcctggaatctatatgaaaaagatatattcagaaagacagagtgataaatctgtcaaattattgaatttgtcaggtaaaataagaacagagaattgatctttggacttagcaaagcagagattatcagtgacttttataaaaatagtttcggtagtgtggaaagatcaaacttctgtttagagtgggtttcagagagaacaacaggaattgaagaagtaataaactttgccaaccagtttagctccaaaggaaaagagggaaatatgatggtagctggcaggggaagtgtggtcaagagaggttttttgtttgtttttcaagatggaagaaataacagtatgtatgtaagctcacaggagggatccagcaggcatggggaaattgatgatataggacagaaagggaagaatggctccttgtgaaagtgaaaggggatgggatctacaggatgaacatgcaaacaaagactggctgcaaagagaggcatgaatagttcatttacagaaacagcaaaggcagagtgttggtacagatgctggtaagtggaaaaatatcatggtaggaggttatggagttccattctaaacacttcaacttcatcagtgaaataagcacggtaatttagcagaatgtgaagatgtaaaagaacagaatttgagaaaacagacgatatgaaataattattagaaaagcagagactgaagaaactgtcatctccttatgtgctaatgagtttaataatgtcctccagtcaccacaagccttctttcaaactacacaattccaactgcttccgtctcagagtatcttgaaataatgatctgaccgcctgttagaccagtgaagggaaggaatttgggttgatttaagaagagaatcctcatggtcatggtagactgatatggagagaaaacattttgaggaaaaatactcaactaaattcatttctactccagcatgcagtttcaagtcaagttccaccttagctccaggtggcaggcagagcaggatgcagaggcacagcacaagtaagggatccaatgactgagtcaagaattacataacctggccagacagctggtacatgggaaagtgctaagagggcaccaacagcgttcctcctccccaaggagcataatgtgatggttcctgccggccctggctgactctcgccgtccttggagataattgggttcagtgccacctggaccagaactggggatgcggaagcaacctgccagacacgcgcgaggttcgaggctgagatggatcttgaggcggcaaagaacggaacagcctggcgccccacgagcgcggagggcgactttgaactgggcatcagcagcaaacaaaaaaggaaaaaaacgaagacagtgaaaatgattggagtattaacattgtttcgatactccgattggcaggataaattgtttatgtcgctgggtaccatcatggccatagctcacggatcaggtctccccctcatgatgatagtatttggagagatgactgacaaatttgttgatactgcaggaaacttctcctttccagtgaacttttccttgtcgctgctaaatccaggcaaaattctggaagaagaaatgactagatatgcatattactactcaggattgggtgctggagttcttgttgctgcctatatacaagtttcattttggactttggcagctggtcgacagatcaggaaaattaggcagaagttttttcatgctattctacgacaggaaataggatggtttgacatcaatgacaccactgaactcaatacgcggctaacagatgacatctccaaaatcagtgaaggaattggtgacaaggttggaatgttctttcaagcagtagccacgttttttgcaggattcatagtgggattcatcagaggatggaagctcacccttgtgataatggccatcagccctattctaggactctctgcagccgtttgggcaaagatactctcggcatttagtgacaaagaactagctgcttatgcaaaagcaggcgccgtggcagaagaggctctgggggccatcaggactgtgatagctttcgggggccagaacaaagagctggaaaggtatcagaaacatttagaaaatgccaaagagattggaattaaaaaagctatttcagcaaacatttccatgggtattgccttcctgttaatatatgcatcatatgcactggccttctggtatggatccactctagtcatatcaaaagaatatactattggaaatgcaatgacagtttttttttcaatcctaattggagctttcagtgttggccaggctgccccatgtattgatgcttttgccaatgcaagaggagcagcatatgtgatctttgatattattgataataatcctaaaattgacagtttttcagagagaggacacaaaccagacagcatcaaagggaatttggagttcaatgatgttcacttttcttacccttctcgagctaacgtcaagatcttgaagggcctcaacctgaaggtgcagagtgggcagacggtggccctggttggaagtagtggctgtgggaagagcacaacggtccagctgatacagaggctctatgaccctgatgagggcacaattaacattgatgggcaggatattaggaactttaatgtaaactatctgagggaaatcattggtgtggtgagtcaggagccggtgctgttttccaccacaattgctgaaaatatttgttatggccgtggaaatgtaaccatggatgagataaagaaagctgtcaaagaggccaacgcctatgagtttatcatgaaattaccacagaaatttgacaccctggttggagagagaggggcccagctgagtggtgggcagaagcagaggatcgccattgcacgtgccctggttcgcaaccccaagatccttctgctggatgaggccacgtcagcattggacacagaaagtgaagctgaggtacaggcagctctggataaggccagagaaggccggaccaccattgtgatagcacaccgactgtctacggtccgaaatgcagatgtcatcgctgggtttgaggatggagtaattgtggagcaaggaagccacagcgaactgatgaagaaggaaggggtgtacttcaaacttgtcaacatgcagacatcaggaagccagatccagtcagaagaatttgaactaaatgatgaaaaggctgccactagaatggccccaaatggctggaaatctcgcctatttaggcattctactcagaaaaaccttaaaaattcacaaatgtgtcagaagagccttgatgtggaaaccgatggacttgaagcaaatgtgccaccagtgtcctttctgaaggtcctgaaactgaataaaacagaatggccctactttgtcgtgggaacagtatgtgccattgccaatggggggcttcagccggcattttcagtcatattctcagagatcatagcgatttttggaccaggcgatgatgcagtgaagcagcagaagtgcaacatattctctttgattttcttatttctgggaattatttctttttttactttcttccttcagggtttcacgtttgggaaagctggcgagatcctcaccagaagactgcggtcaatggcttttaaagcaatgctaagacaggacatgagctggtttgatgaccataaaaacagtactggtgcactttctacaagacttgccacagatgctgcccaagtccaaggagccacaggaaccaggttggctttaattgcacagaatatagctaaccttggaactggtattatcatatcatttatctacggttggcagttaaccctattgctattagcagttgttccaattattgctgtgtcaggaattgttgaaatgaaattgttggctggaaatgccaaaagagataaaaaagaactggaagctgctggaaagattgcaacagaggcaatagaaaatattaggacagttgtgtctttgacccaggaaagaaaatttgaatcaatgtatgttgaaaaattgtatggaccttacaggaattctgtgcagaaggcacacatctatggaattacttttagtatctcacaagcatttatgtatttttcctatgccggttgttttcgatttggtgcatatctcattgtgaatggacatatgcgcttcagagatgttattctggtgttttctgcaattgtatttggtgcagtggctctaggacatgccagttcatttgctccagactatgctaaagctaagctgtctgcagcccacttattcatgctgtttgaaagacaacctctgattgacagctacagtgaagaggggctgaagcctgataaatttgaaggaaatataacatttaatgaagtcgtgttcaactatcccacccgagcaaacgtgccagtgcttcaggggctgagcctggaggtgaagaaaggccagacactagccctggtgggcagcagtggctgtgggaagagcacggtggtccagctcctggagcggttctacgaccccttggcggggacagtgtttgtggactttggttttcagcttctcgatggtcaagaagcaaagaaactcaatgtccagtggctcagagctcaactcggaatcgtgtctcaggagcctatcctatttgactgcagcattgccgagaatattgcctatggagacaacagccgggttgtatcacaggatgaaattgtgagtgcagccaaagctgccaacatacatcctttcatcgagacgttaccccacaaatatgaaacaagagtgggagataaggggactcagctctcaggaggtcaaaaacagaggattgctattgcccgagccctcatcagacaacctcaaatcctcctgttggatgaagctacatcagctctggatactgaaagtgaaaaggttgtccaagaagccctggacaaagccagagaaggccgcacctgcattgtgattgctcaccgcctgtccaccatccagaatgcagacttaatagtggtgtttcagaatgggagagtcaaggagcatggcacgcatcagcagctgctggcacagaaaggcatctatttttcaatggtcagtgtccaggctgggacacagaacttatgaacttttgctacagtatattttaaaaataaattcaaattattctacccatttt

SEQ ID NO: 62331 - DNA, 5623 bp, Homo sapiens
atctctatccttcttctggtccttcctagaaaatcaggtggagatgatagtggcttgcatgatggtggtagagctggaggtgcagggcaaaggtcagattctgaatatattttgaaagtaaaggcaacaagatttcctgacagattgattatggtgtgtcaaagaaagagaggaatgcaggatgattccagtgtttttgttgacaactataagtctggagctgccaactggatgcagaagttcactggagggcccagcctggggaaaggatcaggagcaggttaggcatgttaagcttgagatgtctgttaaacatccagataggaatgtcaaagatgcacttgtgtttaagagtcaggaatgcaagagggaattttaggctagaaacaaaaagttagaaattattcgatacagatggtatttaaagctgtgtgactgactgacatgacagaagtggcgagaatagactgagaagtccaaggaatgagccttggaccactccagtgttaggtaagtagttgaaaaaaagagagagagagaaggcatcaaaggagactgaggaagagtgatcaggaaagcataggaaaatccgagaaacatatggtgtcctggaatctatatgaaaaagatatattcagaaagacagagtgataaatctgtcaaattattgaatttgtcaggtaaaataagaacagagaattgatctttggacttagcaaagcagagattatcagtgacttttataaaaatagtttcggtagtgtggaaagatcaaacttctgtttagagtgggtttcagagagaacaacaggaattgaagaagtaataaactttgccaaccagtttagctccaaaggaaaagagggaaatatgatggtagctggcaggggaagtgtggtcaagagaggttttttgtttgtttttcaagatggaagaaataacagtatgtatgtaagctcacaggagggatccagcaggcatggggaaattgatgatataggacagaaagggaagaatggctccttgtgaaagtgaaaggggatgggatctacaggatgaacatgcaaacaaagactggctgcaaagagaggcatgaatagttcatttacagaaacagcaaaggcagagtgttggtacagatgctggtaagtggaaaaatatcatggtaggaggttatggagttccattctaaacacttcaacttcatcagtgaaataagcacggtaatttagcagaatgtgaagatgtaaaagaacagaatttgagaaaacagacgatatgaaataattattagaaaagcagagactgaagaaactgtcatctccttatgtgctaatgagtttaataatgtcctccagtcaccacaagccttctttcaaactacacaattccaactgcttccgtctcagagtatcttgaaataatgatctgaccgcctgttagaccagtgaagggaaggaatttgggttgatttaagaagagaatcctcatggtcatggtagactgatatggagagaaaacattttgaggaaaaatactcaactaaattcatttctactccagcatgcagtttcaagtcaagttccaccttagctccaggtggcaggcagagcaggatgcagaggcacagcacaagtaagggatccaatgactgagtcaagaattacataacctggccagacagctggtacatgggaaagtgctaagagggcaccaacagcgttcctcctccccaaggagcataatgtgatggttcctgccggccctggctgactctcgccgtccttggagataattgggttcagtgccacctggaccagaactggggatgcggaagcaacctgccagacacgcgcgaggttcgaggctgagatggatcttgaggcggcaaagaacggaacagcctggcgccccacgagcgcggagggcgactttgaactgggcatcagcagcaaacaaaaaaggaaaaaaacgaagacagtgaaaatgattggagtattaacattgtttcgatactccgattggcaggataaattgtttatgtcgctgggtaccatcatggccatagctcacggatcaggtctccccctcatgatgatagtatttggagagatgactgacaaatttgttgatactgcaggaaacttctcctttccagtgaacttttccttgtcgctgctaaatccaggcaaaattctggaagaagaaatgactagatatgcatattactactcaggattgggtgctggagttcttgttgctgcctatatacaagtttcattttggactttggcagctggtcgacagatcaggaaaattaggcagaagttttttcatgctattctacgacaggaaataggatggtttgacatcaatgacaccactgaactcaatacgcggctaacagatgacatctccaaaatcagtgaaggaattggtgacaaggttggaatgttctttcaagcagtagccacgttttttgcaggattcatagtgggattcatcagaggatggaagctcacccttgtgataatggccatcagccctattctaggactctctgcagccgtttgggcaaagatactctcggcatttagtgacaaagaactagctgcttatgcaaaagcaggcgccgtggcagaagaggctctgggggccatcaggactgtgatagctttcgggggccagaacaaagagctggaaaggtatcagaaacatttagaaaatgccaaagagattggaattaaaaaagctatttcagcaaacatttccatgggtattgccttcctgttaatatatgcatcatatgcactggccttctggtatggatccactctagtcatatcaaaagaatatactattggaaatgcaatgacagtttttttttcaatcctaattggagctttcagtgttggccaggctgccccatgtattgatgcttttgccaatgcaagaggagcagcatatgtgatctttgatattattgataataatcctaaaattgacagtttttcagagagaggacacaaaccagacagcatcaaagggaatttggagttcaatgatgttcacttttcttacccttctcgagctaacgtcaagatcttgaagggcctcaacctgaaggtgcagagtgggcagacggtggccctggttggaagtagtggctgtgggaagagcacaacggtccagctgatacagaggctctatgaccctgatgagggcacaattaacattgatgggcaggatattaggaactttaatgtaaactatctgagggaaatcattggtgtggtgagtcaggagccggtgctgttttccaccacaattgctgaaaatatttgttatggccgtggaaatgtaaccatggatgagataaagaaagctgtcaaagaggccaacgcctatgagtttatcatgaaattaccacagaaatttgacaccctggttggagagagaggggcccagctgagtggtgggcagaagcagaggatcgccattgcacgtgccctggttcgcaaccccaagatccttctgctggatgaggccacgtcagcattggacacagaaagtgaagctgaggtacaggcagctctggataaggccagagaaggccggaccaccattgtgatagcacaccgactgtctacggtccgaaatgcagatgtcatcgctgggtttgaggatggagtaattgtggagcaaggaagccacagcgaactgatgaagaaggaaggggtgtacttcaaacttgtcaacatgcagacatcaggaagccagatccagtcagaagaatttgaactaaatgatgaaaaggctgccactagaatggccccaaatggctggaaatctcgcctatttaggcattctactcagaaaaaccttaaaaattcacaaatgtgtcagaagagccttgatgtggaaaccgatggacttgaagcaaatgtgccaccagtgtcctttctgaaggtcctgaaactgaataaaacagaatggccctactttgtcgtgggaacagtatgtgccattgccaatggggggcttcagccggcattttcagtcatattctcagagatcatagcgatttttggaccaggcgatgatgcagtgaagcagcagaagtgcaacatattctctttgattttcttatttctgggaattatttctttttttactttcttccttcagggtttcacgtttgggaaagctggcgagatcctcaccagaagactgcggtcaatggcttttaaagcaatgctaagacaggacatgagctggtttgatgaccataaaaacagtactggtgcactttctacaagacttgccacagatgctgcccaagtccaaggagccacaggaaccaggttggctttaattgcacagaatatagctaaccttggaactggtattatcatatcatttatctacggttggcagttaaccctattgctattagcagttgttccaattattgctgtgtcaggaattgttgaaatgaaattgttggctggaaatgccaaaagagataaaaaagaactggaagctgctggaaagattgcaacagaggcaatagaaaatattaggacagttgtgtctttgacccaggaaagaaaatttgaatcaatgtatgttgaaaaattgtatggaccttacagggtgttttctgcaattgtatttggtgcagtggctctaggacatgccagttcatttgctccagactatgctaaagctaagctgtctgcagcccacttattcatgctgtttgaaagacaacctctgattgacagctacagtgaagaggggctgaagcctgataaatttgaaggaaatataacatttaatgaagtcgtgttcaactatcccacccgagcaaacgtgccagtgcttcaggggctgagcctggaggtgaagaaaggccagacactagccctggtgggcagcagtggctgtgggaagagcacggtggtccagctcctggagcggttctacgaccccttggcggggacagtgcttctcgatggtcaagaagcaaagaaactcaatgtccagtggctcagagctcaactcggaatcgtgtctcaggagcctatcctatttgactgcagcattgccgagaatattgcctatggagacaacagccgggttgtatcacaggatgaaattgtgagtgcagccaaagctgccaacatacatcctttcatcgagacgttaccccacaaatatgaaacaagagtgggagataaggggactcagctctcaggaggtcaaaaacagaggattgctattgcccgagccctcatcagacaacctcaaatcctcctgttggatgaagctacatcagctctggatactgaaagtgaaaaggttgtccaagaagccctggacaaagccagagaaggccgcacctgcattgtgattgctcaccgcctgtccaccatccagaatgcagacttaatagtggtgtttcagaatgggagagtcaaggagcatggcacgcatcagcagctgctggcacagaaaggcatctatttttcaatggtcagtgtccaggctgggacacagaacttatgaacttttgctacagtatattttaaaaataaattcaaattattctacccatttt

SEQ ID NO: 62332 - DNA, 462 bp, Homo sapiens
tatcttatcatactttatgatacattaaaatagttaagacaaagctccatgttgtctttatgtagttctatagaattcctagcctttttaaatttaagttacttcaagagctgatccatgttttctgtgttagaaatttgacaccctggttggagagagaggggcccagctgagtggtgggcagaagcagaggatcgccattgcacgtgccctggttcgcaaccccaagatccttctgctggatgaggccacgtcagcattggacacagaaagtgaagctgaggtacaggcagctctggataaggtcagtagactctaaaaagctgaaggaccaccacattgaaacctattgaagattcttgccagtgcttccggagtctgggctgagaaacagaaacatagcaaatggagctacctcatggagctgtattgatttctcctttctgtcaggttacattgtct

SEQ ID NO: 62333 - DNA, 774 bp, Homo sapiens
tcagaaagaagaaagtcatactcaaataggtggtaggagcagagacaattcaatacagacagaagtcttagatgagagcagtgagccagggcactggactgggactcaggaggcttcccctagactctggttccaccgatgcagcctcaggcaggacttcacctctctgggcatccgtttcttcatatgttaaacatacggggttttaattagatgatcgctgaagacccctctagccctaaaactctgtgtctcttaagtgctaagagggcaccaacagcgttcctcctccccaaggagcataatgtgatggttcctgccggccctggctgactctcgccgtccttggagataattgggttcagtgccacctggaccagaactggggatgcggaagcaagaggcgagtctattgctctctctcggtcctgggccgccctgtgattgttgggcgtccggaaactgtctcccctatgggtttaaaaacaaaactgagcgcccatggggtgtgacagtcatctgcaggggcttgggtggcccatcaggcgaggctttctcggcacccgaggctccagcctgatctcggtcttatcctgcgaccgggctggttctggcgggtcgccagggtgggcggcggccccagccgggcgccccggcggcaagagcggcaggctgcgcccctggcccgcgcctagcctggggagagagctgggcgggcggcgggagctgctctcgcgggccgcggccctcgccctggctgcaacggtaggcgtt

SEQ ID NO: 62334 - DNA, 436 bp, Homo sapiens
gacaacatagtgagatctcatctctacaaaataataaaaataaaaatcttaaaaaatagcatatgtcatggcatgaacctgtagtcccagctacttgggaggctgaggcaggagggtcttaggagtctgaggctgcagtgagttatgatcacaccactgcactccagcctgggtggcagagcaagaccctgtctcaaaaacaacgacaacaaaaaactgtctgcagacagcaataaattgtccttgctgcacctgtgctgtataagtttggcttattatagtcaatgacccacattcttaagatggatgattttttaaaaagtagagacaggctggcgatcacaccggacagagctaactggtgtgcaaggaaagtgaaaatgggaattgtgttagtagcacaatgcaaactcaacaatttcaagaaaatgcattt

SEQ ID NO: 62335 - DNA, 4010 bp, Homo sapiens
cgtggggggcgggggcgggggcgggggcgaggccgcggcgagcaaagtccaggcccctctgctgcagcgcccgcgcgtccagaggccctgccagacacgcgcgaggttcgaggctgagatggatcttgaggcggcaaagaacggaacagcctggcgccccacgagcgcggagggcgactttgaactgggcatcagcagcaaacaaaaaaggaaaaaaacgaagacagtgaaaatgattggagtattaacattgtttcgatactccgattggcaggataaattgtttatgtcgctgggtaccatcatggccatagctcacggatcaggtctccccctcatgatgatagtatttggagagatgactgacaaatttgttgatactgcaggaaacttctcctttccagtgaacttttccttgtcgctgctaaatccaggcaaaattctggaagaagaaatgactagatatgcatattactactcaggattgggtgctggagttcttgttgctgcctatatacaagtttcattttggactttggcagctggtcgacagatcaggaaaattaggcagaagttttttcatgctattctacgacaggaaataggatggtttgacatcaatgacaccactgaactcaatacgcggctaacagatgacatctccaaaatcagtgaaggaattggtgacaaggttggaatgttctttcaagcagtagccacgttttttgcaggattcatagtgggattcatcagaggatggaagctcacccttgtgataatggccatcagccctattctaggactctctgcagccgtttgggcaaagatactctcggcatttagtgacaaagaactagctgcttatgcaaaagcaggcgccgtggcagaagaggctctgggggccatcaggactgtgatagctttcgggggccagaacaaagagctggaaaggtatcagaaacatttagaaaatgccaaagagattggaattaaaaaagctatttcagcaaacatttccatgggtattgccttcctgttaatatatgcatcatatgcactggccttctggtatggatccactctagtcatatcaaaagaatatactattggaaatgcaatgacagtttttttttcaatcctaattggagctttcagtgttggccaggctgccccatgtattgatgcttttgccaatgcaagaggagcagcatatgtgatctttgatattattgataataatcctaaaattgacagtttttcagagagaggacacaaaccagacagcatcaaagggaatttggagttcaatgatgttcacttttcttacccttctcgagctaacgtcaagatcttgaagggcctcaacctgaaggtgcagagtgggcagacggtggccctggttggaagtagtggctgtgggaagagcacaacggtccagctgatacagaggctctatgaccctgatgagggcacaattaacattgatgggcaggatattaggaactttaatgtaaactatctgagggaaatcattggtgtggtgagtcaggagccggtgctgttttccaccacaattgctgaaaatatttgttatggccgtggaaatgtaaccatggatgagataaagaaagctgtcaaagaggccaacgcctatgagtttatcatgaaattaccacagaaatttgacaccctggttggagagagaggggcccagctgagtggtgggcagaagcagaggatcgccattgcacgtgccctggttcgcaaccccaagatccttctgctggatgaggccacgtcagcattggacacagaaagtgaagctgaggtacaggcagctctggataaggccagagaaggccggaccaccattgtgatagcacaccgactgtctacggtccgaaatgcagatgtcatcgctgggtttgaggatggagtaattgtggagcaaggaagccacagcgaactgatgaagaaggaaggggtgtacttcaaacttgtcaacatgcagacatcaggaagccagatccagtcagaagaatttgaactaaatgatgaaaaggctgccactagaatggccccaaatggctggaaatctcgcctatttaggcattctactcagaaaaaccttaaaaattcacaaatgtgtcagaagagccttgatgtggaaaccgatggacttgaagcaaatgtgccaccagtgtcctttctgaaggtcctgaaactgaataaaacagaatggccctactttgtcgtgggaacagtatgtgccattgccaatggggggcttcagccggcattttcagtcatattctcagagatcatagcgatttttggaccaggcgatgatgcagtgaagcagcagaagtgcaacatattctctttgattttcttatttctgggaattatttctttttttactttcttccttcagggtttcacgtttgggaaagctggcgagatcctcaccagaagactgcggtcaatggcttttaaagcaatgctaagacaggacatgagctggtttgatgaccataaaaacagtactggtgcactttctacaagacttgccacagatgctgcccaagtccaaggagccacaggaaccaggttggctttaattgcacagaatatagctaaccttggaactggtattatcatatcatttatctacggttggcagttaaccctattgctattagcagttgttccaattattgctgtgtcaggaattgttgaaatgaaattgttggctggaaatgccaaaagagataaaaaagaactggaagctgctggaaagattgcaacagaggcaatagaaaatattaggacagttgtgtctttgacccaggaaagaaaatttgaatcaatgtatgttgaaaaattgtatggaccttacaggaattctgtgcagaaggcacacatctatggaattacttttagtatctcacaagcatttatgtatttttcctatgccggttgttttcgatttggtgcatatctcattgtgaatggacatatgcgcttcagagatgttattctggtgttttctgcaattgtatttggtgcagtggctctaggacatgccagttcatttgctccagactatgctaaagctaagctgtctgcagcccacttattcatgctgtttgaaagacaacctctgattgacagctacagtgaagaggggctgaagcctgataaatttgaaggaaatataacatttaatgaagtcgtgttcaactatcccacccgagcaaacgtgccagtgcttcaggggctgagcctggaggtgaagaaaggccagacactagccctggtgggcagcagtggctgtgggaagagcacggtggtccagctcctggagcggttctacgaccccttggcggggacagtgcttctcgatggtcaagaagcaaagaaactcaatgtccagtggctcagagctcaactcggaatcgtgtctcaggagcctatcctatttgactgcagcattgccgagaatattgcctatggagacaacagccgggttgtatcacaggatgaaattgtgagtgcagccaaagctgccaacatacatcctttcatcgagacgttaccccacaaatatgaaacaagagtgggagataaggggactcagctctcaggaggtcaaaaacagaggattgctattgcccgagccctcatcagacaacctcaaatcctcctgttggatgaagctacatcagctctggatactgaaagtgaaaaggttgtccaagaagccctggacaaagccagagaaggccgcacctgcattgtgattgctcaccgcctgtccaccatccagaatgcagacttaatagtggtgtttcagaatgggagagtcaaggagcatggcacgcatcagcagctgctggcacagaaaggcatctatttttcaatggtcagtgtccaggctgggacacagaacttatgaacttttgctacagtatattttaaaaataaattcaaattattctacccatttt

SEQ ID NO: 62336 - DNA, 5759 bp, Homo sapiens
atctctatccttcttctggtccttcctagaaaatcaggtggagatgatagtggcttgcatgatggtggtagagctggaggtgcagggcaaaggtcagattctgaatatattttgaaagtaaaggcaacaagatttcctgacagattgattatggtgtgtcaaagaaagagaggaatgcaggatgattccagtgtttttgttgacaactataagtctggagctgccaactggatgcagaagttcactggagggcccagcctggggaaaggatcaggagcaggttaggcatgttaagcttgagatgtctgttaaacatccagataggaatgtcaaagatgcacttgtgtttaagagtcaggaatgcaagagggaattttaggctagaaacaaaaagttagaaattattcgatacagatggtatttaaagctgtgtgactgactgacatgacagaagtggcgagaatagactgagaagtccaaggaatgagccttggaccactccagtgttaggtaagtagttgaaaaaaagagagagagagaaggcatcaaaggagactgaggaagagtgatcaggaaagcataggaaaatccgagaaacatatggtgtcctggaatctatatgaaaaagatatattcagaaagacagagtgataaatctgtcaaattattgaatttgtcaggtaaaataagaacagagaattgatctttggacttagcaaagcagagattatcagtgacttttataaaaatagtttcggtagtgtggaaagatcaaacttctgtttagagtgggtttcagagagaacaacaggaattgaagaagtaataaactttgccaaccagtttagctccaaaggaaaagagggaaatatgatggtagctggcaggggaagtgtggtcaagagaggttttttgtttgtttttcaagatggaagaaataacagtatgtatgtaagctcacaggagggatccagcaggcatggggaaattgatgatataggacagaaagggaagaatggctccttgtgaaagtgaaaggggatgggatctacaggatgaacatgcaaacaaagactggctgcaaagagaggcatgaatagttcatttacagaaacagcaaaggcagagtgttggtacagatgctggtaagtggaaaaatatcatggtaggaggttatggagttccattctaaacacttcaacttcatcagtgaaataagcacggtaatttagcagaatgtgaagatgtaaaagaacagaatttgagaaaacagacgatatgaaataattattagaaaagcagagactgaagaaactgtcatctccttatgtgctaatgagtttaataatgtcctccagtcaccacaagccttctttcaaactacacaattccaactgcttccgtctcagagtatcttgaaataatgatctgaccgcctgttagaccagtgaagggaaggaatttgggttgatttaagaagagaatcctcatggtcatggtagactgatatggagagaaaacattttgaggaaaaatactcaactaaattcatttctactccagcatgcagtttcaagtcaagttccaccttagctccaggtggcaggcagagcaggatgcagaggcacagcacaagtaagggatccaatgactgagtcaagaattacataacctggccagacagctggtacatgggaaagtgctaagagggcaccaacagcgttcctcctccccaaggagcataatgtgatggttcctgccggccctggctgactctcgccgtccttggagataattgggttcagtgccacctggaccagaactggggatgcggaagcaagctgagatggatcttgaggcggcaaagaacggaacagcctggcgccccacgagcgcggagggcgactttgaactgggcatcagcagcaaacaaaaaaggaaaaaaacgaagacagtgaaaatgattggagtattaacattgtttcgatactccgattggcaggataaattgtttatgtcgctgggtaccatcatggccatagctcacggatcaggtctccccctcatgatgatagtatttggagagatgactgacaaatttgttgatactgcaggaaacttctcctttccagtgaacttttccttgtcgctgctaaatccaggcaaaattctggaagaagaaatgactagatatgcatattactactcaggattgggtgctggagttcttgttgctgcctatatacaagtttcattttggactttggcagctggtcgacagatcaggaaaattaggcagaagttttttcatgctattctacgacaggaaataggatggtttgacatcaatgacaccactgaactcaatacgcggctaacagatgacatctccaaaatcagtgaaggaattggtgacaaggttggaatgttctttcaagcagtagccacgttttttgcaggattcatagtgggattcatcagaggatggaagctcacccttgtgataatggccatcagccctattctaggactctctgcagccgtttgggcaaagatactctcggcatttagtgacaaagaactagctgcttatgcaaaagcaggcgccgtggcagaagaggctctgggggccatcaggactgtgatagctttcgggggccagaacaaagagctggaaaggtatcagaaacatttagaaaatgccaaagagattggaattaaaaaagctatttcagcaaacatttccatgggtattgccttcctgttaatatatgcatcatatgcactggccttctggtatggatccactctagtcatatcaaaagaatatactattggaaatgcaatgacagtttttttttcaatcctaattggagctttcagtgttggccaggctgccccatgtattgatgcttttgccaatgcaagaggagcagcatatgtgatctttgatattattgataataatcctaaaattgacagtttttcagagagaggacacaaaccagacagcatcaaagggaatttggagttcaatgatgttcacttttcttacccttctcgagctaacgtcaagatcttgaagggcctcaacctgaaggtgcagagtgggcagacggtggccctggttggaagtagtggctgtgggaagagcacaacggtccagctgatacagaggctctatgaccctgatgagggcacaattaacattgatgggcaggatattaggaactttaatgtaaactatctgagggaaatcattggtgtggtgagtcaggagccggtgctgttttccaccacaattgctgaaaatatttgttatggccgtggaaatgtaaccatggatgagataaagaaagctgtcaaagaggccaacgcctatgagtttatcatgaaattaccacagaaatttgacaccctggttggagagagaggggcccagctgagtggtgggcagaagcagaggatcgccattgcacgtgccctggttcgcaaccccaagatccttctgctggatgaggccacgtcagcattggacacagaaagtgaagctgaggtacaggcagctctggataaggccagagaaggccggaccaccattgtgatagcacaccgactgtctacggtccgaaatgcagatgtcatcgctgggtttgaggatggagtaattgtggagcaaggaagccacagcgaactgatgaagaaggaaggggtgtacttcaaacttgtcaacatgcagacatcaggaagccagatccagtcagaagaatttgaactaaatgatgaaaaggctgccactagaatggccccaaatggctggaaatctcgcctatttaggcattctactcagaaaaaccttaaaaattcacaaatgtgtcagaagagccttgatgtggaaaccgatggacttgaagcaaatgtgccaccagtgtcctttctgaaggtcctgaaactgaataaaacagaatggccctactttgtcgtgggaacagtatgtgccattgccaatggggggcttcagccggcattttcagtcatattctcagagatcatagcgatttttggaccaggcgatgatgcagtgaagcagcagaagtgcaacatattctctttgattttcttatttctgggaattatttctttttttactttcttccttcagggtttcacgtttgggaaagctggcgagatcctcaccagaagactgcggtcaatggcttttaaagcaatgctaagacaggacatgagctggtttgatgaccataaaaacagtactggtgcactttctacaagacttgccacagatgctgcccaagtccaaggagccacaggaaccaggttggctttaattgcacagaatatagctaaccttggaactggtattatcatatcatttatctacggttggcagttaaccctattgctattagcagttgttccaattattgctgtgtcaggaattgttgaaatgaaattgttggctggaaatgccaaaagagataaaaaagaactggaagctgctggaaagattgcaacagaggcaatagaaaatattaggacagttgtgtctttgacccaggaaagaaaatttgaatcaatgtatgttgaaaaattgtatggaccttacaggaattctgtgcagaaggcacacatctatggaattacttttagtatctcacaagcatttatgtatttttcctatgccggttgttttcgatttggtgcatatctcattgtgaatggacatatgcgcttcagagatgttattctggtgttttctgcaattgtatttggtgcagtggctctaggacatgccagttcatttgctccagactatgctaaagctaagctgtctgcagcccacttattcatgctgtttgaaagacaacctctgattgacagctacagtgaagaggggctgaagcctgataaatttgaaggaaatataacatttaatgaagtcgtgttcaactatcccacccgagcaaacgtgccagtgcttcaggggctgagcctggaggtgaagaaaggccagacactagccctggtgggcagcagtggctgtgggaagagcacggtggtccagctcctggagcggttctacgaccccttggcggggacagtgtttgtggactttggttttcagcttctcgatggtcaagaagcaaagaaactcaatgtccagtggctcagagctcaactcggaatcgtgtctcaggagcctatcctatttgactgcagcattgccgagaatattgcctatggagacaacagccgggttgtatcacaggatgaaattgtgagtgcagccaaagctgccaacatacatcctttcatcgagacgttaccccacaaatatgaaacaagagtgggagataaggggactcagctctcaggaggtcaaaaacagaggattgctattgcccgagccctcatcagacaacctcaaatcctcctgttggatgaagctacatcagctctggatactgaaagtgaaaaggttgtccaagaagccctggacaaagccagagaaggccgcacctgcattgtgattgctcaccgcctgtccaccatccagaatgcagacttaatagtggtgtttcagaatgggagagtcaaggagcatggcacgcatcagcagctgctggcacagaaaggcatctatttttcaatggtcagtgtccaggctgggacacagaacttatgaacttttgctacagtatattttaaaaataaattcaaattattctacccatttt

SEQ ID NO: 62337 - DNA, 5935 bp, Homo sapiens
atctctatccttcttctggtccttcctagaaaatcaggtggagatgatagtggcttgcatgatggtggtagagctggaggtgcagggcaaaggtcagattctgaatatattttgaaagtaaaggcaacaagatttcctgacagattgattatggtgtgtcaaagaaagagaggaatgcaggatgattccagtgtttttgttgacaactataagtctggagctgccaactggatgcagaagttcactggagggcccagcctggggaaaggatcaggagcaggttaggcatgttaagcttgagatgtctgttaaacatccagataggaatgtcaaagatgcacttgtgtttaagagtcaggaatgcaagagggaattttaggctagaaacaaaaagttagaaattattcgatacagatggtatttaaagctgtgtgactgactgacatgacagaagtggcgagaatagactgagaagtccaaggaatgagccttggaccactccagtgttaggtaagtagttgaaaaaaagagagagagagaaggcatcaaaggagactgaggaagagtgatcaggaaagcataggaaaatccgagaaacatatggtgtcctggaatctatatgaaaaagatatattcagaaagacagagtgataaatctgtcaaattattgaatttgtcaggtaaaataagaacagagaattgatctttggacttagcaaagcagagattatcagtgacttttataaaaatagtttcggtagtgtggaaagatcaaacttctgtttagagtgggtttcagagagaacaacaggaattgaagaagtaataaactttgccaaccagtttagctccaaaggaaaagagggaaatatgatggtagctggcaggggaagtgtggtcaagagaggttttttgtttgtttttcaagatggaagaaataacagtatgtatgtaagctcacaggagggatccagcaggcatggggaaattgatgatataggacagaaagggaagaatggctccttgtgaaagtgaaaggggatgggatctacaggatgaacatgcaaacaaagactggctgcaaagagaggcatgaatagttcatttacagaaacagcaaaggcagagtgttggtacagatgctggtaagtggaaaaatatcatggtaggaggttatggagttccattctaaacacttcaacttcatcagtgaaataagcacggtaatttagcagaatgtgaagatgtaaaagaacagaatttgagaaaacagacgatatgaaataattattagaaaagcagagactgaagaaactgtcatctccttatgtgctaatgagtttaataatgtcctccagtcaccacaagccttctttcaaactacacaattccaactgcttccgtctcagagtatcttgaaataatgatctgaccgcctgttagaccagtgaagggaaggaatttgggttgatttaagaagagaatcctcatggtcatggtagactgatatggagagaaaacattttgaggaaaaatactcaactaaattcatttctactccagcatgcagtttcaagtcaagttccaccttagctccaggtggcaggcagagcaggatgcagaggcacagcacaagtaagggatccaatgactgagtcaagaattacataacctggccagacagctggtacatgggaaagtgctaagagggcaccaacagcgttcctcctccccaaggagcataatgtgatggttcctgccggccctggctgactctcgccgtccttggagataattgggttcagtgccacctggaccagaactggggatgcggaagcaagctgagatggatcttgaggcggcaaagaacggaacagcctggcgccccacgagcgcggagggcgactttgaactgggcatcagcagcaaacaaaaaaggaaaaaaacgaagacagtgaaaatgattggagtattaacattgtttcgatactccgattggcaggataaattgtttatgtcgctgggtaccatcatggccatagctcacggatcaggtctccccctcatgatgatagtatttggagagatgactgacaaatttgttgatactgcaggaaacttctcctttccagtgaacttttccttgtcgctgctaaatccaggcaaaattctggaagaagaaatgactagatatgcatattactactcaggattgggtgctggagttcttgttgctgcctatatacaagtttcattttggactttggcagctggtcgacagatcaggaaaattaggcagaagttttttcatgctattctacgacaggaaataggatggtttgacatcaatgacaccactgaactcaatacgcggctaacagatgacatctccaaaatcagtgaaggaattggtgacaaggttggaatgttctttcaagcagtagccacgttttttgcaggattcatagtgggattcatcagaggatggaagctcacccttgtgataatggccatcagccctattctaggactctctgcagccgtttgggcaaagatactctcggcatttagtgacaaagaactagctgcttatgcaaaagcaggcgccgtggcagaagaggctctgggggccatcaggactgtgatagctttcgggggccagaacaaagagctggaaaggtatcagaaacatttagaaaatgccaaagagattggaattaaaaaagctatttcagcaaacatttccatgggtattgccttcctgttaatatatgcatcatatgcactggccttctggtatggatccactctagtcatatcaaaagaatatactattggaaatgcaatgacagtttttttttcaatcctaattggagctttcagtgttggccaggctgccccatgtattgatgcttttgccaatgcaagaggagcagcatatgtgatctttgatattattgataataatcctaaaattgacagtttttcagagagaggacacaaaccagacagcatcaaagggaatttggagttcaatgatgttcacttttcttacccttctcgagctaacgtcaagatcttgaagggcctcaacctgaaggtgcagagtgggcagacggtggccctggttggaagtagtggctgtgggaagagcacaacggtccagctgatacagaggctctatgaccctgatgagggcacaattaacattgatgggcaggatattaggaactttaatgtaaactatctgagggaaatcattggtgtggtgagtcaggagccggtgctgttttccaccacaattgctgaaaatatttgttatggccgtggaaatgtaaccatggatgagataaagaaagctgtcaaagaggccaacgcctatgagtttatcatgaaattaccacagaaatttgacaccctggttggagagagaggggcccagctgagtggtgggcagaagcagaggatcgccattgcacgtgccctggttcgcaaccccaagatccttctgctggatgaggccacgtcagcattggacacagaaagtgaagctgaggtacaggcagctctggataaggccagagaaggccggaccaccattgtgatagcacaccgactgtctacggtccgaaatgcagatgtcatcgctgggtttgaggatggagtaattgtggagcaaggaagccacagcgaactgatgaagaaggaaggggtgtacttcaaacttgtcaacatgcagacatcaggaagccagatccagtcagaagaatttgaactaaatgatgaaaaggctgccactagaatggccccaaatggctggaaatctcgcctatttaggcattctactcagaaaaaccttaaaaattcacaaatgtgtcagaagagccttgatgtggaaaccgatggacttgaagcaaatgtgccaccagtgtcctttctgaaggtcctgaaactgaataaaacagaatggccctactttgtcgtgggaacagtatgtgccattgccaatggggggcttcagccggcattttcagtcatattctcagagatcatagcgatttttggaccaggcgatgatgcagtgaagcagcagaagtgcaacatattctctttgattttcttatttctgggaattatttctttttttactttcttccttcagggtttcacgtttgggaaagctggcgagatcctcaccagaagactgcggtcaatggcttttaaagcaatgctaagacaggacatgagctggtttgatgaccataaaaacagtactggtgcactttctacaagacttgccacagatgctgcccaagtccaaggagccacaggaaccaggttggctttaattgcacagaatatagctaaccttggaactggtattatcatatcatttatctacggttggcagttaaccctattgctattagcagttgttccaattattgctgtgtcaggaattgttgaaatgaaattgttggctggaaatgccaaaagagataaaaaagaactggaagctgctggaaagattgcaacagaggcaatagaaaatattaggacagttgtgtctttgacccaggaaagaaaatttgaatcaatgtatgttgaaaaattgtatggaccttacaggaattctgtgcagaaggcacacatctatggaattacttttagtatctcacaagcatttatgtatttttcctatgccggttgttttcgatttggtgcatatctcattgtgaatggacatatgcgcttcagagatgttattctggtgttttctgcaattgtatttggtgcagtggctctaggacatgccagttcatttgctccagactatgctaaagctaagctgtctgcagcccacttattcatgctgtttgaaagacaacctctgattgacagctacagtgaagaggggctgaagcctgataaatttgaaggaaatataacatttaatgaagtcgtgttcaactatcccacccgagcaaacgtgccagtgcttcaggggctgagcctggaggtgaagaaaggccagacactagccctggtgggcagcagtggctgtgggaagagcacggtggtccagctcctggagcggttctacgaccccttggcggggacagtgcttctcgatggtcaagaagcaaagaaactcaatgtccagtggctcagagctcaactcggaatcgtgtctcaggagcctatcctatttgactgcagcattgccgagaatattgcctatggagacaacagccgggttgtatcacaggatgaaattgtgagtgcagccaaagctgccaacatacatcctttcatcgagacgttaccccacaaatatgaaacaagagtgggagataaggggactcagctctcaggaggtcaaaaacagaggattgctattgcccgagccctcatcagacaacctcaaatcctcctgttggatgaagctacatcagctctggatactgaaagtgaaaaggttgtccaagaagccctggacaaagccagagaaggccgcacctgcattgtgattgctcaccgcctgtccaccatccagaatgcagacttaatagtggtgtttcagaatgggagagtcaaggagcatggcacgcatcagcagctgctggcacagaaaggcatctatttttcaatgatcaatttagaagacccaatttggggtttattacggcatttgaaatttgagagttagaagtgacacctgtcttgatgaagtattgaaacaacaggctagctctccctaagttattagaaacatccagaaaaagaacaaaattcaaggtaagtacaggtgtagaaatatagaagccacagacatagggaaatggtcttatggtcctgaatgggttgggtagacaggaaagtttgggaataattttcccaagtacaaaagaaaaataaattgttcaatagcctc

SEQ ID NO: 62338 - DNA, 2613 bp, Homo sapiens
atctctatccttcttctggtccttcctagaaaatcaggtggagatgatagtggcttgcatgatggtggtagagctggaggtgcagggcaaaggtcagattctgaatatattttgaaagtaaaggcaacaagatttcctgacagattgattatggtgtgtcaaagaaagagaggaatgcaggatgattccagtgtttttgttgacaactataagtctggagctgccaactggatgcagaagttcactggagggcccagcctggggaaaggatcaggagcaggttaggcatgttaagcttgagatgtctgttaaacatccagataggaatgtcaaagatgcacttgtgtttaagagtcaggaatgcaagagggaattttaggctagaaacaaaaagttagaaattattcgatacagatggtatttaaagctgtgtgactgactgacatgacagaagtggcgagaatagactgagaagtccaaggaatgagccttggaccactccagtgttaggtaagtagttgaaaaaaagagagagagagaaggcatcaaaggagactgaggaagagtgatcaggaaagcataggaaaatccgagaaacatatggtgtcctggaatctatatgaaaaagatatattcagaaagacagagtgataaatctgtcaaattattgaatttgtcaggtaaaataagaacagagaattgatctttggacttagcaaagcagagattatcagtgacttttataaaaatagtttcggtagtgtggaaagatcaaacttctgtttagagtgggtttcagagagaacaacaggaattgaagaagtaataaactttgccaaccagtttagctccaaaggaaaagagggaaatatgatggtagctggcaggggaagtgtggtcaagagaggttttttgtttgtttttcaagatggaagaaataacagtatgtatgtaagctcacaggagggatccagcaggcatggggaaattgatgatataggacagaaagggaagaatggctccttgtgaaagtgaaaggggatgggatctacaggatgaacatgcaaacaaagactggctgcaaagagaggcatgaatagttcatttacagaaacagcaaaggcagagtgttggtacagatgctggtaagtggaaaaatatcatggtaggaggttatggagttccattctaaacacttcaacttcatcagtgaaataagcacggtaatttagcagaatgtgaagatgtaaaagaacagaatttgagaaaacagacgatatgaaataattattagaaaagcagagactgaagaaactgtcatctccttatgtgctaatgagtttaataatgtcctccagtcaccacaagccttctttcaaactacacaattccaactgcttccgtctcagagtatcttgaaataatgatctgaccgcctgttagaccagtgaagggaaggaatttgggttgatttaagaagagaatcctcatggtcatggtagactgatatggagagaaaacattttgaggaaaaatactcaactaaattcatttctactccagcatgcagtttcaagtcaagttccaccttagctccaggtggcaggcagagcaggatgcagaggcacagcacaagtaagggatccaatgactgagtcaagaattacataacctggccagacagctggtacatgggaaagtgctaagagggcaccaacagcgttcctcctccccaaggagcataatgtgatggttcctgccggccctggctgactctcgccgtccttggagataattgggttcagtgccacctggaccagaactggggatgcggaagcaagctgagatggatcttgaggcggcaaagaacggaacagcctggcgccccacgagcgcggagggcgactttgaactgggcatcagcagcaaacaaaaaaggaaaaaaacgaagacagtgaaaatgattggagtattaacattgtttcgatactccgattggcaggataaattgtttatgtcgctgggtaccatcatggccatagctcacggatcaggtctccccctcatgatgatagtatttggagagatgactgacaaatttgttgatactgcaggaaacttctcctttccagtgaacttttccttgtcgctgctaaatccaggcaaaattctggaagaagaaatgactagatatgcatattactactcaggattgggtgctggagttcttgttgctgcctatatacaagtttcattttggactttggcagctggtcgacagatcaggaaaattaggcagaagttttttcatgctattctacgacaggaaataggatggtttgacatcaatgacaccactgaactcaatacgcggctaacagagtaggtacattgttaatgtcacactttcatatagaaattaattactgtgtgaaaatatgtcaaggaaagattttaaatgaaaaatgttactagattgagcatctgatctatattagaaatcgatcatctggcagccatgtctagcagcatctatagcctatgccattgcatgttggctttcccccaaggtgcatagtaggtttatttgaggactgaattcacatcttatac

SEQ ID NO: 62339 - DNA, 4984 bp, Homo sapiens
atctctatccttcttctggtccttcctagaaaatcaggtggagatgatagtggcttgcatgatggtggtagagctggaggtgcagggcaaaggtcagattctgaatatattttgaaagtaaaggcaacaagatttcctgacagattgattatggtgtgtcaaagaaagagaggaatgcaggatgattccagtgtttttgttgacaactataagtctggagctgccaactggatgcagaagttcactggagggcccagcctggggaaaggatcaggagcaggttaggcatgttaagcttgagatgtctgttaaacatccagataggaatgtcaaagatgcacttgtgtttaagagtcaggaatgcaagagggaattttaggctagaaacaaaaagttagaaattattcgatacagatggtatttaaagctgtgtgactgactgacatgacagaagtggcgagaatagactgagaagtccaaggaatgagccttggaccactccagtgttaggtaagtagttgaaaaaaagagagagagagaaggcatcaaaggagactgaggaagagtgatcaggaaagcataggaaaatccgagaaacatatggtgtcctggaatctatatgaaaaagatatattcagaaagacagagtgataaatctgtcaaattattgaatttgtcaggtaaaataagaacagagaattgatctttggacttagcaaagcagagattatcagtgacttttataaaaatagtttcggtagtgtggaaagatcaaacttctgtttagagtgggtttcagagagaacaacaggaattgaagaagtaataaactttgccaaccagtttagctccaaaggaaaagagggaaatatgatggtagctggcaggggaagtgtggtcaagagaggttttttgtttgtttttcaagatggaagaaataacagtatgtatgtaagctcacaggagggatccagcaggcatggggaaattgatgatataggacagaaagggaagaatggctccttgtgaaagtgaaaggggatgggatctacaggatgaacatgcaaacaaagactggctgcaaagagaggcatgaatagttcatttacagaaacagcaaaggcagagtgttggtacagatgctggtaagtggaaaaatatcatggtaggaggttatggagttccattctaaacacttcaacttcatcagtgaaataagcacggtaatttagcagaatgtgaagatgtaaaagaacagaatttgagaaaacagacgatatgaaataattattagaaaagcagagactgaagaaactgtcatctccttatgtgctaatgagtttaataatgtcctccagtcaccacaagccttctttcaaactacacaattccaactgcttccgtctcagagtatcttgaaataatgatctgaccgcctgttagaccagtgaagggaaggaatttgggttgatttaagaagagaatcctcatggtcatggtagactgatatggagagaaaacattttgaggaaaaatactcaactaaattcatttctactccagcatgcagtttcaagtcaagttccaccttagctccaggtggcaggcagagcaggatgcagaggcacagcacaagtaagggatccaatgactgagtcaagaattacataacctggccagacagctggtacatgggaaagtgctaagagggcaccaacagcgttcctcctccccaaggagcataatgtgatggttcctgccggccctggctgactctcgccgtccttggagataattgggttcagtgccacctggaccagaactggggatgcggaagcaagctgagatggatcttgaggcggcaaagaacggaacagcctggcgccccacgagcgcggagggcgactttgaactgggcatcagcagcaaacaaaaaaggaaaaaaacgaagacagtgaaaatgattggagtattaacattgtttcgatactccgattggcaggataaattgtttatgtcgctgggtaccatcatggccatagctcacggatcaggtctccccctcatgatgatagtatttggagagatgactgacaaatttgttgatactgcaggaaacttctcctttccagtgaacttttccttgtcgctgctaaatccaggcaaaattctggaagaagaaatgactagatatgcatattactactcaggattgggtgctggagttcttgttgctgcctatatacaagtttcattttggactttggcagctggtcgacagatcaggaaaattaggcagaagttttttcatgctattctacgacaggaaataggatggtttgacatcaatgacaccactgaactcaatacgcggctaacagatgacatctccaaaatcagtgaaggaattggtgacaaggttggaatgttctttcaagcagtagccacgttttttgcaggattcatagtgggattcatcagaggatggaagctcacccttgtgataatggccatcagccctattctaggactctctgcagccgtttgggcaaagatactctcggcatttagtgacaaagaactagctgcttatgcaaaagcaggcgccgtggcagaagaggctctgggggccatcaggactgtgatagctttcgggggccagaacaaagagctggaaaggtatcagaaacatttagaaaatgccaaagagattggaattaaaaaagctatttcagcaaacatttccatgggtattgccttcctgttaatatatgcatcatatgcactggccttctggtatggatccactctagtcatatcaaaagaatatactattggaaatgcaatgacagtttttttttcaatcctaattggagctttcagtgttggccaggctgccccatgtattgatgcttttgccaatgcaagaggagcagcatatgtgatctttgatattattgataataatcctaaaattgacagtttttcagagagaggacacaaaccagacagcatcaaagggaatttggagttcaatgatgttcacttttcttacccttctcgagctaacgtcaagatcttgaagggcctcaacctgaaggtgcagagtgggcagacggtggccctggttggaagtagtggctgtgggaagagcacaacggtccagctgatacagaggctctatgaccctgatgagggcacaattaacattgatgggcaggatattaggaactttaatgtaaactatctgagggaaatcattggtgtggtgagtcaggagccggtgctgttttccaccacaattgctgaaaatatttgttatggccgtggaaatgtaaccatggatgagataaagaaagctgtcaaagaggccaacgcctatgagtttatcatgaaattaccacagaaatttgacaccctggttggagagagaggggcccagctgagtggtgggcagaagcagaggatcgccattgcacgtgccctggttcgcaaccccaagatccttctgctggatgaggccacgtcagcattggacacagaaagtgaagctgaggtacaggcagctctggataaggccagagaaggccggaccaccattgtgatagcacaccgactgtctacggtccgaaatgcagatgtcatcgctgggtttgaggatggagtaattgtggagcaaggaagccacagcgaactgatgaagaaggaaggggtgtacttcaaacttgtcaacatgcagacatcaggaagccagatccagtcagaagaatttgaactaaatgatgaaaaggctgccactagaatggccccaaatggctggaaatctcgcctatttaggcattctactcagaaaaaccttaaaaattcacaaatgtgtcagaagagccttgatgtggaaaccgatggacttgaagcaaatgtgccaccagtgtcctttctgaaggtcctgaaactgaataaaacagaatggccctactttgtcgtgggaacagtatgtgccattgccaatggggggcttcagccggcattttcagtcatattctcagagatcatagcgatttttggaccaggcgatgatgcagtgaagcagcagaagtgcaacatattctctttgattttcttatttctgggaattatttctttttttactttcttccttcagggtttcacgtttgggaaagctggcgagatcctcaccagaagactgcggtcaatggcttttaaagcaatgctaagacaggacatgagctggtttgatgaccataaaaacagtactggtgcactttctacaagacttgccacagatgctgcccaagtccaaggagccacaggaaccaggttggctttaattgcacagaatatagctaaccttggaactggtattatcatatcatttatctacggttggcagttaaccctattgctattagcagttgttccaattattgctgtgtcaggaattgttgaaatgaaattgttggctggaaatgccaaaagagataaaaaagaactggaagctgctggaaagattgcaacagaggcaatagaaaatattaggacagttgtgtctttgacccaggaaagaaaatttgaatcaatgtatgttgaaaaattgtatggaccttacaggaattctgtgcagaaggcacacatctatggaattacttttagtatctcacaagcatttatgtatttttcctatgccggttgttttcgatttggtgcatatctcattgtgaatggacatatgcgcttcagagatgttattctggtgttttctgcaattgtatttggtgcagtggctctaggacatgccagttcatttgctccagactatgctaaagctaagctgtctgcagcccacttattcatgctgtttgaaagacaacctctgattgacagctacagtgaagaggggctgaagcctgataaatttgaaggaaatatagcatttaatgtatcctcgtctaaggcgacggacatc

SEQ ID NO: 62340 - DNA, 701 bp, Homo sapiens
gaaactgttattgactctaaatgtttttcttgtaaatagaactgtcaactgttaagcaacagttcattcaacatatttataatttggttaacttgcagaaatatgaaacaagagtgggagataaggggactcagctctcaggaggtcaaaaacagaggattgctattgcccgagccctcatcagacaacctcaaatcctcctgttggatgaagctacatcagctctggatactgaaagtgaaaaggttgtccaagaagccctggacaaagccagagaaggccgcacctgcattgtgattgctcaccgcctgtccaccatccagaatgcagacttaatagtggtgtttcagaatgggagagtcaaggagcatggcacgcatcagcagctgctggcacagaaaggcatctatttttcaatgatcaatttagaagacccaatttggggtttattacggcatttgaaatttgagagttagaagtgacacctgtcttgatgaagtattgaaacaacaggctagctctccctaagttattagaaacatccagaaaaagaacaaaattcaaggtaagtacaggtgtagaaatatagaagccacagacatagggaaatggtcttatggtcctgaatgggttgggtagacaggaaagtttgggaataattttcccaagtacaaaagaaaaataaattgttcaatagcctc

SEQ ID NO: 62341 - DNA, 380 bp, Homo sapiens
aagattctaagatactagaaattaaaagttgattagaaaggtaacattttcaaatttacttgaatgttaaaactaatttatacaatttttgggataaggtgtctgtctgatttatcaataggttgtccaagaagccctggacaaagccagagaaggccgcacctgcattgtgattgctcaccgcctgtccaccatccagaatgcagacttaatagtggtgtttcagaatgggagagtcaaggagcatggcacgcatcagcagctgctggcacagaaaggcatctatttttcaatggtcagtgtccaggctgggacacagaacttatgaacttttgctacagtatattttaaaaataaattcaaattattctacccatttt

SEQ ID NO: 62342 - DNA, 494 bp, Homo sapiens
ttatgtatccatgtatctttgtagtaccttcgacagttacttttgtgcttgctatgtttgttgaactgaataattttgacattttgtgaacatcactcttatatttgaaaatataatagttgaatattgtaactaaacatatttatgttcaattgattgtaaaacattttgtaacagttttaaattgaagcaattctattttttacagcaaacaaaaaaggaaaaaaacgaagacagtgaaaatgattggagtattaacattggtaagctgtgaaatgttaaatgtgaataatcctaccttttattcaaatttgaggtattgaatcaattacctttaaagcaaatactttaagattgtctagctaggcgagctgactcatacttgtaatcccagcactttgggagactgaggtgggagggttgcttgagcacaagagtttgagaccagcctggacaacatagtgagatctcatctctacaaaataataaaaata

SEQ ID NO: 62343 - DNA, 750 bp, Homo sapiens
agactgaagaaactgtcatctccttatgtgctaatgagtttaataatgtcctccagtcaccacaagccttctttcaaactacacaattccaactgcttccgtctcagagtatcttgaaataatgatctgaccgcctgttagaccagtgaagggaaggaatttgggttgatttaagaagagaatcctcatggtcatggtagactgatatggagagaaaacattttgaggaaaaatactcaactaaattcatttctactccagcatgcagtttcaagtcaagttccaccttagctccaggtggcaggcagagcaggatgcagaggcacagcacaagtaaggggtgagtgccgaagctgctggctcctgttccagtctttcttccttggcctcgcctgaacttttactataataatagtcaccatttattaggtgtctcctacgtgcaggacactttacacacagtatccctaatcctaataacacccttattttatagatccaatgactgagtcaagaattacataacctggccagacagctggtacatgggaaaggtgagattcacaccagggtccacccagcatctctacttataccatgctctgctttaaggttctctgagaactcagacaagccttgggctaacaattgtgttaacaggacatagcaggtgcaaggacccactggtcatcctgctacctgatcagaaggaaggaaagttgtatttgttgctcacctactatgttttag

SEQ ID NO: 62344 - DNA, 3735 bp, Homo sapiens
atctctatccttcttctggtccttcctagaaaatcaggtggagatgatagtggcttgcatgatggtggtagagctggaggtgcagggcaaaggtcagattctgaatatattttgaaagtaaaggcaacaagatttcctgacagattgattatggtgtgtcaaagaaagagaggaatgcaggatgattccagtgtttttgttgacaactataagtctggagctgccaactggatgcagaagttcactggagggcccagcctggggaaaggatcaggagcaggttaggcatgttaagcttgagatgtctgttaaacatccagataggaatgtcaaagatgcacttgtgtttaagagtcaggaatgcaagagggaattttaggctagaaacaaaaagttagaaattattcgatacagatggtatttaaagctgtgtgactgactgacatgacagaagtggcgagaatagactgagaagtccaaggaatgagccttggaccactccagtgttaggtaagtagttgaaaaaaagagagagagagaaggcatcaaaggagactgaggaagagtgatcaggaaagcataggaaaatccgagaaacatatggtgtcctggaatctatatgaaaaagatatattcagaaagacagagtgataaatctgtcaaattattgaatttgtcaggtaaaataagaacagagaattgatctttggacttagcaaagcagagattatcagtgacttttataaaaatagtttcggtagtgtggaaagatcaaacttctgtttagagtgggtttcagagagaacaacaggaattgaagaagtaataaactttgccaaccagtttagctccaaaggaaaagagggaaatatgatggtagctggcaggggaagtgtggtcaagagaggttttttgtttgtttttcaagatggaagaaataacagtatgtatgtaagctcacaggagggatccagcaggcatggggaaattgatgatataggacagaaagggaagaatggctccttgtgaaagtgaaaggggatgggatctacaggatgaacatgcaaacaaagactggctgcaaagagaggcatgaatagttcatttacagaaacagcaaaggcagagtgttggtacagatgctggtaagtggaaaaatatcatggtaggaggttatggagttccattctaaacacttcaacttcatcagtgaaataagcacggtaatttagcagaatgtgaagatgtaaaagaacagaatttgagaaaacagacgatatgaaataattattagaaaagcagagactgaagaaactgtcatctccttatgtgctaatgagtttaataatgtcctccagtcaccacaagccttctttcaaactacacaattccaactgcttccgtctcagagtatcttgaaataatgatctgaccgcctgttagaccagtgaagggaaggaatttgggttgatttaagaagagaatcctcatggtcatggtagactgatatggagagaaaacattttgaggaaaaatactcaactaaattcatttctactccagcatgcagtttcaagtcaagttccaccttagctccaggtggcaggcagagcaggatgcagaggcacagcacaagtaagggatccaatgactgagtcaagaattacataacctggccagacagctggtacatgggaaagtgctaagagggcaccaacagcgttcctcctccccaaggagcataatgtgatggttcctgccggccctggctgactctcgccgtccttggagataattgggttcagtgccacctggaccagaactggggatgcggaagcaagctgagatggatcttgaggcggcaaagaacggaacagcctggcgccccacgagcgcggagggcgactttgaactgggcatcagcagcaaacaaaaaaggaaaaaaacgaagacagtgaaaatgattggagtattaacattgtttcgatactccgattggcaggataaattgtttatgtcgctgggtaccatcatggccatagctcacggatcaggtctccccctcatgatgatagtatttggagagatgactgacaaatttgttgatactgcaggaaacttctcctttccagtgaacttttccttgtcgctgctaaatccaggcaaaattctggaagaagaaatgactagatatgcatattactactcaggattgggtgctggagttcttgttgctgcctatatacaagtttcattttggactttggcagctggtcgacagatcaggaaaattaggcagaagttttttcatgctattctacgacaggaaataggatggtttgacatcaatgacaccactgaactcaatacgcggctaacagatgacatctccaaaatcagtgaaggaattggtgacaaggttggaatgttctttcaagcagtagccacgttttttgcaggattcatagtgggattcatcagaggatggaagctcacccttgtgataatggccatcagccctattctaggactctctgcagccgtttgggcaaagatactctcggcatttagtgacaaagaactagctgcttatgcaaaagcaggcgccgtggcagaagaggctctgggggccatcaggactgtgatagctttcgggggccagaacaaagagctggaaaggtatcagaaacatttagaaaatgccaaagagattggaattaaaaaagctatttcagcaaacatttccatgggtattgccttcctgttaatatatgcatcatatgcactggccttctggtatggatccactctagtcatatcaaaagaatatactattggaaatgcaatgacagtttttttttcaatcctaattggagctttcagtgttggccaggctgccccatgtattgatgcttttgccaatgcaagaggagcagcatatgtgatctttgatattattgataataatcctaaaattgacagtttttcagagagaggacacaaaccagacagcatcaaagggaatttggagttcaatgatgttcacttttcttacccttctcgagctaacgtcaagatcttgaagggcctcaacctgaaggtgcagagtgggcagacggtggccctggttggaagtagtggctgtgggaagagcacaacggtccagctgatacagaggctctatgaccctgatgagggcacaattaacattgatgggcaggatattaggaactttaatgtaaactatctgagggaaatcattggtgtggtgagtcaggagccggtgctgttttccaccacaattgctgaaaatatttgttatggccgtggaaatgtaaccatggatgagataaagaaagctgtcaaagaggccaacgcctatgagtttatcatgaaattaccacagaaatttgacaccctggttggagagagaggggcccagctgagtggtgggcagaagcagaggatcgccattgcacgtgccctggttcgcaaccccaagatccttctgctggatgaggccacgtcagcattggacacagaaagtgaagctgaggtacaggcagctctggataaggtcagtagactctaaaaagctgaaggaccaccacattgaaacctattgaagattcttgccagtgcttccggagtctgggctgagaaacagaaacatagcaaatggagctacctcatggagctgtattgatttctcctttctgtcaggttacattgtct

SEQ ID NO: 62345 - DNA, 5662 bp, Homo sapiens
atctctatccttcttctggtccttcctagaaaatcaggtggagatgatagtggcttgcatgatggtggtagagctggaggtgcagggcaaaggtcagattctgaatatattttgaaagtaaaggcaacaagatttcctgacagattgattatggtgtgtcaaagaaagagaggaatgcaggatgattccagtgtttttgttgacaactataagtctggagctgccaactggatgcagaagttcactggagggcccagcctggggaaaggatcaggagcaggttaggcatgttaagcttgagatgtctgttaaacatccagataggaatgtcaaagatgcacttgtgtttaagagtcaggaatgcaagagggaattttaggctagaaacaaaaagttagaaattattcgatacagatggtatttaaagctgtgtgactgactgacatgacagaagtggcgagaatagactgagaagtccaaggaatgagccttggaccactccagtgttaggtaagtagttgaaaaaaagagagagagagaaggcatcaaaggagactgaggaagagtgatcaggaaagcataggaaaatccgagaaacatatggtgtcctggaatctatatgaaaaagatatattcagaaagacagagtgataaatctgtcaaattattgaatttgtcaggtaaaataagaacagagaattgatctttggacttagcaaagcagagattatcagtgacttttataaaaatagtttcggtagtgtggaaagatcaaacttctgtttagagtgggtttcagagagaacaacaggaattgaagaagtaataaactttgccaaccagtttagctccaaaggaaaagagggaaatatgatggtagctggcaggggaagtgtggtcaagagaggttttttgtttgtttttcaagatggaagaaataacagtatgtatgtaagctcacaggagggatccagcaggcatggggaaattgatgatataggacagaaagggaagaatggctccttgtgaaagtgaaaggggatgggatctacaggatgaacatgcaaacaaagactggctgcaaagagaggcatgaatagttcatttacagaaacagcaaaggcagagtgttggtacagatgctggtaagtggaaaaatatcatggtaggaggttatggagttccattctaaacacttcaacttcatcagtgaaataagcacggtaatttagcagaatgtgaagatgtaaaagaacagaatttgagaaaacagacgatatgaaataattattagaaaagcagagactgaagaaactgtcatctccttatgtgctaatgagtttaataatgtcctccagtcaccacaagccttctttcaaactacacaattccaactgcttccgtctcagagtatcttgaaataatgatctgaccgcctgttagaccagtgaagggaaggaatttgggttgatttaagaagagaatcctcatggtcatggtagactgatatggagagaaaacattttgaggaaaaatactcaactaaattcatttctactccagcatgcagtttcaagtcaagttccaccttagctccaggtggcaggcagagcaggatgcagaggcacagcacaagtaagggatccaatgactgagtcaagaattacataacctggccagacagctggtacatgggaaagtgctaagagggcaccaacagcgttcctcctccccaaggagcataatgtgatggttcctgccggccctggctgactctcgccgtccttggagataattgggttcagtgccacctggaccagaactggggatgcggaagcaagctgagatggatcttgaggcggcaaagaacggaacagcctggcgccccacgagcgcggagggcgactttgaactgggcatcagcagcaaacaaaaaaggaaaaaaacgaagacagtgaaaatgattggagtattaacattgtttcgatactccgattggcaggataaattgtttatgtcgctgggtaccatcatggccatagctcacggatcaggtctccccctcatgatgatagtatttggagagatgactgacaaatttgttgatactgcaggaaacttctcctttccagtgaacttttccttgtcgctgctaaatccaggcaaaattctggaagaagaaatgactagatatgcatattactactcaggattgggtgctggagttcttgttgctgcctatatacaagtttcattttggactttggcagctggtcgacagatcaggaaaattaggcagaagttttttcatgctattctacgacaggaaataggatggtttgacatcaatgacaccactgaactcaatacgcggctaacagatgacatctccaaaatcagtgaaggaattggtgacaaggttggaatgttctttcaagcagtagccacgttttttgcaggattcatagtgggattcatcagaggatggaagctcacccttgtgataatggccatcagccctattctaggactctctgcagccgtttgggcaaagatactctcggcatttagtgacaaagaactagctgcttatgcaaaagcaggcgccgtggcagaagaggctctgggggccatcaggactgtgatagctttcgggggccagaacaaagagctggaaaggtatcagaaacatttagaaaatgccaaagagattggaattaaaaaagctatttcagcaaacatttccatgggtattgccttcctgttaatatatgcatcatatgcactggccttctggtatggatccactctagtcatatcaaaagaatatactattggaaatgcaatgacagtttttttttcaatcctaattggagctttcagtgttggccaggctgccccatgtattgatgcttttgccaatgcaagaggagcagcatatgtgatctttgatattattgataataatcctaaaattgacagtttttcagagagaggacacaaaccagacagcatcaaagggaatttggagttcaatgatgttcacttttcttacccttctcgagctaacgtcaagatcttgaagggcctcaacctgaaggtgcagagtgggcagacggtggccctggttggaagtagtggctgtgggaagagcacaacggtccagctgatacagaggctctatgaccctgatgagggcacaattaacattgatgggcaggatattaggaactttaatgtaaactatctgagggaaatcattggtgtggtgagtcaggagccggtgctgttttccaccacaattgctgaaaatatttgttatggccgtggaaatgtaaccatggatgagataaagaaagctgtcaaagaggccaacgcctatgagtttatcatgaaattaccacagaaatttgacaccctggttggagagagaggggcccagctgagtggtgggcagaagcagaggatcgccattgcacgtgccctggttcgcaaccccaagatccttctgctggatgaggccacgtcagcattggacacagaaagtgaagctgaggtacaggcagctctggataaggccagagaaggccggaccaccattgtgatagcacaccgactgtctacggtccgaaatgcagatgtcatcgctgggtttgaggatggagtaattgtggagcaaggaagccacagcgaactgatgaagaaggaaggggtgtacttcaaacttgtcaacatgcagacatcaggaagccagatccagtcagaagaatttgaactaaatgatgaaaaggctgccactagaatggccccaaatggctggaaatctcgcctatttaggcattctactcagaaaaaccttaaaaattcacaaatgtgtcagaagagccttgatgtggaaaccgatggacttgaagcaaatgtgccaccagtgtcctttctgaaggtcctgaaactgaataaaacagaatggccctactttgtcgtgggaacagtatgtgccattgccaatggggggcttcagccggcattttcagtcatattctcagagatcatagcgatttttggaccaggcgatgatgcagtgaagcagcagaagtgcaacatattctctttgattttcttatttctgggaattatttctttttttactttcttccttcagggtttcacgtttgggaaagctggcgagatcctcaccagaagactgcggtcaatggcttttaaagcaatgctaagacaggacatgagctggtttgatgaccataaaaacagtactggtgcactttctacaagacttgccacagatgctgcccaagtccaaggagccacaggaaccaggttggctttaattgcacagaatatagctaaccttggaactggtattatcatatcatttatctacggttggcagttaaccctattgctattagcagttgttccaattattgctgtgtcaggaattgttgaaatgaaattgttggctggaaatgccaaaagagataaaaaagaactggaagctgctggaaagattgcaacagaggcaatagaaaatattaggacagttgtgtctttgacccaggaaagaaaatttgaatcaatgtatgttgaaaaattgtatggaccttacaggaattctgtgcagaaggcacacatctatggaattacttttagtatctcacaagcatttatgtatttttcctatgccggttgttttcgatttggtgcatatctcattgtgaatggacatatgcgcttcagagatgttattctggtgttttctgcaattgtatttggtgcagtggctctaggacatgccagttcatttgctccagactatgctaaagctaagctgtctgcagcccacttattcatgctgtttgaaagacaacctctgattgacagctacagtgaagaggggctgaagcctgataaatttgaaggaaatataacatttaatgaagtcgtgttcaactatcccacccgagcaaacgtgccagtgcttcaggggctgagcctggaggtgaagaaaggccagacactagccctggtgggcagcagtggctgtgggaagagcacggtggtccagctcctggagcggttctacgaccccttggcggggacagtgtttgtggactttggttttcagcttctcgatggtcaagaagcaaagaaactcaatgtccagtggctcagagctcaactcggaatcgtgtctcaggagcctatcctatttgactgcagcattgccgagaatattgcctatggagacaacagccgggttgtatcacaggatgaaattgtgagtgcagccaaagctgccaacatacatcctttcatcgagacgttaccccacgtaagttaaagagtagctgaaatcagaagagactactttttatcccccaaacaattaccaaagttatgccaacaaaatcttgtaacaaaatatgttgatttactaacattaacaacttggacaaggcacttcaggataccaagcttccttatttgtaaatgggaatacattatgcctacctcatacaaatgtagtgagaagctcaaaaccaccatacttcaggttacagactggtggttgagggctgcatttagactgcagtcatgtttggtttagccctatggtacttttaaaacaattatagttttt

SEQ ID NO: 62346 - DNA, 2347 bp, Homo sapiens
ggaggtgcggcaggggcacaggtgacgctcctcccgcctgcctagcagagctccaggcgcacatccgcagtcagccacctcgcgcgcgcctccaggagcaaggatggagaggctggtgatcaggatgcccttctgtcatctgtctacctacagcctggtttgggtcatggcagcagtggtgctgtgcacagcacaagtgcaagtggtgacccaggatgaaagagagcagctgtacacacctgcttccttaaaatgctctctgcaaaatgcccaggaagccctcattgtgacatggcagaaaaagaaagctgtaagcccagaaaacatggtcaccttcagcgagaaccatggggtggtgatccagcctgcctataaggacaagataaacattacccagctgggactccaaaactcaaccatcaccttctggaatatcaccctggaggatgaagggtgttacatgtgtctcttcaatacctttggttttgggaagatctcaggaacggcctgcctcaccgtctatgtacagcccatagtatcccttcactacaaattctctgaagaccacctaaatatcacttgctctgccactgcccgcccagcccccatggtcttctggaaggtccctcggtcagggattgaaaatagtacagtgactctgtctcacccaaatgggaccacgtctgttaccagcatcctccatatcaaagaccctaagaatcaggtggggaaggaggtgatctgccaggtgctgcacctggggactgtgaccgactttaagcaaaccgtcaacaaaggctattggttttcagttccgctattgctaagcattgtttccctggtaattcttctcgtcctaatctcaatcttactgtactgggaaacgtcaccggaatcaggaccgagagccctaaataagtcacacagcaccctgaaagtgattccctggtctacttgaatttgacacaagagaaaagcaggaggaaaaggggccattctccaaaggacctgaaagagcaaaagaggtgggagcgaaagccttaaggatcccacgactttttactgccatctgagctactcagtgtttgaatcccaagaggaagtcagtttacctctcaggtctgttgtaggacttgattttgtaaagcaatgccatgttatgtggttgaaagggcactggacttagttagtatcaggagcactgagctcacagactgacttgggctcctactggtggggacctctgttagtcactttacctcatccaaagtataaaggaattggaccaaataatttaccacatagctctaaaacttaatttaaaatgtaattccagaaaaaaaaagggaataagcaaagggggaagaattgaaagagagagagaagaaagaatacagagagcttaccttttgcctttctgttgatgttacatctcttcttcctatgttcttaggtctatgagtctgtttccccatcatttggtatctagtccagttcctgcttactgctttgctaatagctggccttgctagaatccttggtttcactgctgttcttcatgtgcttctatgagatttactccaacacaaataggactgaatttattgtgaagtaacattggcaatcttaacttattcatttaacttatttttatagctagataaatattgttagtcttagacaatagctcacattttttgagaagcatgccctccctgtccatttgtcttataacatgacccagccctattttacgtcattctaaattcagcctcatataatgaaaatacattatgaaaacagatgtttaggagatttcctgtatagcagtcagccaattcatatgctttgtctctgctggcttctttttccatgcgttaacttttcccaatagcagaggaggcaaatatgagcatacaatccctttgttctaaagatattgttccagctagtggaatgatgttgaatctttaataaccataattagttgctttttcagtatcttctgctttgtctgtgtctatccagtggcctaggaattaaagtgtaagttgttttcgctgttaaattggatatttatatatatatatatagcaagattttcatgtgttatttaattctgtattgtttcttatatttgtagtaaaatattgaacaattaaaagtgttgactccaaatatttggcttatgatattctcttggggaaatgtgggaaatgaatgataatccttgtcttttcccatcatatgtaaaaaccctcccctcctctctatctttcccctcctaaaagatgagctgggctgggcgcggtggctcaagcctgcaatcccagtactttgggaggcc

SEQ ID NO: 62347 - DNA, 2094 bp, Homo sapiens
ggaggtgcggcaggggcacaggtgacgctcctcccgcctgcctagcagagctccaggcgcacatccgcagtcagccacctcgcgcgcgcctccaggagcaaggatggagaggctgtgcaagtggtgacccaggatgaaagagagcagctgtacacacctgcttccttaaaatgctctctgcaaaatgcccaggaagccctcattgtgacatggcagaaaaagaaagctgtaagcccagaaaacatggtcaccttcagcgagaaccatggggtggtgatccagcctgcctataaggacaagataaacattacccagctgggactccaaaactcaaccatcaccttctggaatatcaccctggaggatgaagggtgttacatgtgtctcttcaatacctttggttttgggaagatctcaggaacggcctgcctcaccgtctatgtacagcccatagtatcccttcactacaaattctctgaagaccacctaaatatcacttgctctgccactgcccgcccagcccccatggtcttctggaaggtccctcggtcagggattgaaaatagtacagtgactctgtctcacccaaatgggaccacgtctgttaccagcatcctccatatcaaagaccctaagaatcaggtggggaaggaggtgatctgccaggtgctgcacctggggactgtgaccgactttaagcaaaccgtcaacaaaggctattggttttcagttccgctattgctaagcattgtttccctggtaattcttctcgtcctaatctcaatcttactgtactgggaaacgtcaccggaatcaggaccgagagccctaaataagtcacacagcaccctgaaagtgattccctggtctacttgaatttgacacaagagaaaagcaggaggaaaaggggccattctccaaaggacctgaaagagcaaaagaggtgggagcgaaagccttaaggatcccacgactttttactgccatctgagctactcagtgtttgaatcccaagaggaagtcagtttacctctcaggtctgttgtaggacttgattttgtaaagcaatgccatgttatgtggttgaaagggcactggacttagttagtatcaggagcactgagctcacagactgacttgggctcctactggtggggacctctgttagtcactttacctcatccaaagtataaaggaattggaccaaataatttaccacatagctctaaaacttaatttaaaatgtaattccagaaaaaaaaagggaataagcaaagggggaagaattgaaagagagagagaagaaagaatacagagagcttaccttttgcctttctgttgatgttacatctcttcttcctatgttcttaggtctatgagtctgtttccccatcatttggtatctagtccagttcctgcttactgctttgctaatagctggccttgctagaatccttggtttcactgctgttcttcatgtgcttctatgagatttactccaacacaaataggactgaatttattgtgaagtaacattggcaatcttaacttattcatttaacttatttttatagctagataaatattgttagtcttagacaatagctcacattttttgagaagcatgccctccctgtccatttgtcttataacatgacccagccctattttacgtcattctaaattcagcctcatataatgaaaatacattatgaaaacagatgtttaggagatttcctgtatagcagtcagccaattcatatgctttgtctctgctggcttctttttccatgcgttaacttttcccaatagcagaggaggcaaatatgagcatacaatccctttgttctaaagatattgttccagctagtggaatgatgttgaatctttaataaccataattagttgctttttcagtatcttctgctttgtctgtgtctatccagtggcctaggaattaaagtgtaagttgttttcgctgttaaattggatatttatatatatatatatagcaagattttcatgtgttatttaattctgtattgtttcttatatttgtagtaaaatattgaacaattaaaagtgttgactcca

SEQ ID NO: 62348 - DNA, 2251 bp, Homo sapiens
ggaggtgcggcaggggcacaggtgacgctcctcccgcctgcctagcagagctccaggcgcacatccgcagtcagccacctcgcgcgcgcctccaggagcaaggatggagaggctgactctgaccaggacaattgggggccctctccttacagctacactcctaggaaagaccaccatcaatgattaccaggtgatcaggatgcccttctgtcatctgtctacctacagcctggtttgggtcatggcagcagtggtgctgtgcacagcacaagtgcaagtggtgacccaggatgaaagagagcagctgtacacacctgcttccttaaaatgctctctgcaaaatgcccaggaagccctcattgtgacatggcagaaaaagaaagctgtaagcccagaaaacatggtcaccttcagcgagaaccatggggtggtgatccagcctgcctataaggacaagataaacattacccagctgggactccaaaactcaaccatcaccttctggaatatcaccctggaggatgaagggtgttacatgtgtctcttcaatacctttggttttgggaagatctcaggaacggcctgcctcaccgtctatgtacagcccatagtatcccttcactacaaattctctgaagaccacctaaatatcacttgctctgccactgcccgcccagcccccatggtcttctggaaggtccctcggtcagggattgaaaatagtacagtgactctgtctcacccaaatgggaccacgtctgttaccagcatcctccatatcaaagaccctaagaatcaggtggggaaggaggtgatctgccaggtgctgcacctggggactgtgaccgactttaagcaaaccgtcaacaaaggctattggttttcagttccgctattgctaagcattgtttccctggtaattcttctcgtcctaatctcaatcttactgtactgggaaacgtcaccggaatcaggaccgagagccctaaataagtcacacagcaccctgaaagtgattccctggtctacttgaatttgacacaagagaaaagcaggaggaaaaggggccattctccaaaggacctgaaagagcaaaagaggtgggagcgaaagccttaaggatcccacgactttttactgccatctgagctactcagtgtttgaatcccaagaggaagtcagtttacctctcaggtctgttgtaggacttgattttgtaaagcaatgccatgttatgtggttgaaagggcactggacttagttagtatcaggagcactgagctcacagactgacttgggctcctactggtggggacctctgttagtcactttacctcatccaaagtataaaggaattggaccaaataatttaccacatagctctaaaacttaatttaaaatgtaattccagaaaaaaaaagggaataagcaaagggggaagaattgaaagagagagagaagaaagaatacagagagcttaccttttgcctttctgttgatgttacatctcttcttcctatgttcttaggtctatgagtctgtttccccatcatttggtatctagtccagttcctgcttactgctttgctaatagctggccttgctagaatccttggtttcactgctgttcttcatgtgcttctatgagatttactccaacacaaataggactgaatttattgtgaagtaacattggcaatcttaacttattcatttaacttatttttatagctagataaatattgttagtcttagacaatagctcacattttttgagaagcatgccctccctgtccatttgtcttataacatgacccagccctattttacgtcattctaaattcagcctcatataatgaaaatacattatgaaaacagatgtttaggagatttcctgtatagcagtcagccaattcatatgctttgtctctgctggcttctttttccatgcgttaacttttcccaatagcagaggaggcaaatatgagcatacaatccctttgttctaaagatattgttccagctagtggaatgatgttgaatctttaataaccataattagttgctttttcagtatcttctgctttgtctgtgtctatccagtggcctaggaattaaagtgtaagttgttttcgctgttaaattggatatttatatatatatatatagcaagattttcatgtgttatttaattctgtattgtttcttatatttgtagtaaaatattgaacaattaaaagtgttgactcca

SEQ ID NO: 62349 - DNA, 2117 bp, Homo sapiens
ggaggtgcggcaggggcacaggtgacgctcctcccgcctgcctagcagagctccaggcgcacatccgcagtcagccacctcgcgcgcgcctccaggagcaaggatggagaggctgtgcaagtggtgacccaggatgaaagagagcagctgtacacacctgcttccttaaaatgctctctgcaaaatgcccaggaagccctcattgtgacatggcagaaaaagaaagctgtaagcccagaaaacatggtcaccttcagcgagaaccatggggtggtgatccagcctgcctataaggacaagataaacattacccagctgggactccaaaactcaaccatcaccttctggaatatcaccctggaggatgaagggtgttacatgtgtctcttcaatacctttggttttgggaagatctcaggaacggcctgcctcaccgtctatgatcatatttattttttgtcccagtacagcccatagtatcccttcactacaaattctctgaagaccacctaaatatcacttgctctgccactgcccgcccagcccccatggtcttctggaaggtccctcggtcagggattgaaaatagtacagtgactctgtctcacccaaatgggaccacgtctgttaccagcatcctccatatcaaagaccctaagaatcaggtggggaaggaggtgatctgccaggtgctgcacctggggactgtgaccgactttaagcaaaccgtcaacaaaggctattggttttcagttccgctattgctaagcattgtttccctggtaattcttctcgtcctaatctcaatcttactgtactgggaaacgtcaccggaatcaggaccgagagccctaaataagtcacacagcaccctgaaagtgattccctggtctacttgaatttgacacaagagaaaagcaggaggaaaaggggccattctccaaaggacctgaaagagcaaaagaggtgggagcgaaagccttaaggatcccacgactttttactgccatctgagctactcagtgtttgaatcccaagaggaagtcagtttacctctcaggtctgttgtaggacttgattttgtaaagcaatgccatgttatgtggttgaaagggcactggacttagttagtatcaggagcactgagctcacagactgacttgggctcctactggtggggacctctgttagtcactttacctcatccaaagtataaaggaattggaccaaataatttaccacatagctctaaaacttaatttaaaatgtaattccagaaaaaaaaagggaataagcaaagggggaagaattgaaagagagagagaagaaagaatacagagagcttaccttttgcctttctgttgatgttacatctcttcttcctatgttcttaggtctatgagtctgtttccccatcatttggtatctagtccagttcctgcttactgctttgctaatagctggccttgctagaatccttggtttcactgctgttcttcatgtgcttctatgagatttactccaacacaaataggactgaatttattgtgaagtaacattggcaatcttaacttattcatttaacttatttttatagctagataaatattgttagtcttagacaatagctcacattttttgagaagcatgccctccctgtccatttgtcttataacatgacccagccctattttacgtcattctaaattcagcctcatataatgaaaatacattatgaaaacagatgtttaggagatttcctgtatagcagtcagccaattcatatgctttgtctctgctggcttctttttccatgcgttaacttttcccaatagcagaggaggcaaatatgagcatacaatccctttgttctaaagatattgttccagctagtggaatgatgttgaatctttaataaccataattagttgctttttcagtatcttctgctttgtctgtgtctatccagtggcctaggaattaaagtgtaagttgttttcgctgttaaattggatatttatatatatatatatagcaagattttcatgtgttatttaattctgtattgtttcttatatttgtagtaaaatattgaacaattaaaagtgttgactcca

SEQ ID NO: 62350 - DNA, 1460 bp, Homo sapiens
gttcttgtaaagagtcatagtcccctcacaccatactgggtcagaaatgtctacttctttatctttgccaatgaatatacactagaataactctgtgtttcttaatctctctattatttatcttcttaaaatgtattatgatagaatttacaagtgtccaaagttaataccttgttttccttttatccagagccctaaataagtcacacagcaccctgaaagtgattccctggtctacttgaatttgacacaagagaaaagcaggaggaaaaggggccattctccaaaggacctgaaagagcaaaagaggtgggagcgaaagccttaaggatcccacgactttttactgccatctgagctactcagtgtttgaatcccaagaggaagtcagtttacctctcaggtctgttgtaggacttgattttgtaaagcaatgccatgttatgtggttgaaagggcactggacttagttagtatcaggagcactgagctcacagactgacttgggctcctactggtggggacctctgttagtcactttacctcatccaaagtataaaggaattggaccaaataatttaccacatagctctaaaacttaatttaaaatgtaattccagaaaaaaaaagggaataagcaaagggggaagaattgaaagagagagagaagaaagaatacagagagcttaccttttgcctttctgttgatgttacatctcttcttcctatgttcttaggtctatgagtctgtttccccatcatttggtatctagtccagttcctgcttactgctttgctaatagctggccttgctagaatccttggtttcactgctgttcttcatgtgcttctatgagatttactccaacacaaataggactgaatttattgtgaagtaacattggcaatcttaacttattcatttaacttatttttatagctagataaatattgttagtcttagacaatagctcacattttttgagaagcatgccctccctgtccatttgtcttataacatgacccagccctattttacgtcattctaaattcagcctcatataatgaaaatacattatgaaaacagatgtttaggagatttcctgtatagcagtcagccaattcatatgctttgtctctgctggcttctttttccatgcgttaacttttcccaatagcagaggaggcaaatatgagcatacaatccctttgttctaaagatattgttccagctagtggaatgatgttgaatctttaataaccataattagttgctttttcagtatcttctgctttgtctgtgtctatccagtggcctaggaattaaagtgtaagttgttttcgctgttaaattggatatttatatatatatatatagcaagattttcatgtgttatttaattctgtattgtttcttatatttgtagtaaaatattgaacaattaaaagtgttgactcca

SEQ ID NO: 62351 - DNA, 1242 bp, Homo sapiens
  misc_feature (28)..(28): n is a, c, g, or t
cagccagtgcctcgtctgccgaacgggnttctgcgtagaaaagcaggaggaaaaggggccattctccaaaggacctgaaagagcaaaagaggtgggagcgaaagccttaaggatcccacgactttttactgccatctgagctactcagtgtttgaatcccaagaggaagtcagtttacctctcaggtctgttgtaggacttgattttgtaaagcaatgccatgttatgtggttgaaagggcactggacttagttagtatcaggagcactgagctcacagactgacttgggctcctactggtggggacctctgttagtcactttacctcatccaaagtataaaggaattggaccaaataatttaccacatagctctaaaacttaatttaaaatgtaattccagaaaaaaaaagggaataagcaaagggggaagaattgaaagagagagagaagaaagaatacagagagcttaccttttgcctttctgttgatgttacatctcttcttcctatgttcttaggtctatgagtctgtttccccatcatttggtatctagtccagttcctgcttactgctttgctaatagctggccttgctagaatccttggtttcactgctgttcttcatgtgcttctatgagatttactccaacacaaataggactgaatttattgtgaagtaacattggcaatcttaacttattcatttaacttatttttatagctagataaatattgttagtcttagacaatagctcacattttttgagaagcatgccctccctgtccatttgtcttataacatgacccagccctattttacgtcattctaaattcagcctcatataatgaaaatacattatgaaaacagatgtttaggagatttcctgtatagcagtcagccaattcatatgctttgtctctgctggcttctttttccatgcgttaacttttcccaatagcagaggaggcaaatatgagcatacaatccctttgttctaaagatattgttccagctagtggaatgatgttgaatctttaataaccataattagttgctttttcagtatcttctgctttgtctgtgtctatccagtggcctaggaattaaagtgtaagttgttttcgctgttaaattggatatttatatatatatatatagcaagattttcatgtgttatttaattctgtattgtttcttatatttgtagtaaaatattgaacaattaaaagtgttgactcca

SEQ ID NO: 62352 - DNA, 2176 bp, Homo sapiens
ggaggtgcggcaggggcacaggtgacgctcctcccgcctgcctagcagagctccaggcgcacatccgcagtcagccacctcgcgcgcgcctccaggagcaaggatggagaggctggtgatcaggatgcccttctgtcatctgtctacctacagcctggtttgggtcatggcagcagtggtgctgtgcacagcacaagtgcaagtggtgacccaggatgaaagagagcagctgtacacacctgcttccttaaaatgctctctgcaaaatgcccaggaagccctcattgtgacatggcagaaaaagaaagctgtaagcccagaaaacatggtcaccttcagcgagaaccatggggtggtgatccagcctgcctataaggacaagataaacattacccagctgggactccaaaactcaaccatcaccttctggaatatcaccctggaggatgaagggtgttacatgtgtctcttcaatacctttggttttgggaagatctcaggaacggcctgcctcaccgtctatgtacagcccatagtatcccttcactacaaattctctgaagaccacctaaatatcacttgctctgccactgcccgcccagcccccatggtcttctggaaggtccctcggtcagggattgaaaatagtacagtgactctgtctcacccaaatgggaccacgtctgttaccagcatcctccatatcaaagaccctaagaatcaggtggggaaggaggtgatctgccaggtgctgcacctggggactgtgaccgactttaagcaaaccgtcaacaaaggctattggttttcagttccgctattgctaagcattgtttccctggtaattcttctcgtcctaatctcaatcttactgtactgggaaacgtcaccggaatcaggaccgagagccctaaataagtcacacagcaccctgaaagtgattccctggtctacttgaatttgacacaagagaaaagcaggaggaaaaggggccattctccaaaggacctgaaagagcaaaagaggtgggagcgaaagccttaaggatcccacgactttttactgccatctgagctactcagtgtttgaatcccaagaggaagtcagtttacctctcaggtctgttgtaggacttgattttgtaaagcaatgccatgttatgtggttgaaagggcactggacttagttagtatcaggagcactgagctcacagactgacttgggctcctactggtggggacctctgttagtcactttacctcatccaaagtataaaggaattggaccaaataatttaccacatagctctaaaacttaatttaaaatgtaattccagaaaaaaaaagggaataagcaaagggggaagaattgaaagagagagagaagaaagaatacagagagcttaccttttgcctttctgttgatgttacatctcttcttcctatgttcttaggtctatgagtctgtttccccatcatttggtatctagtccagttcctgcttactgctttgctaatagctggccttgctagaatccttggtttcactgctgttcttcatgtgcttctatgagatttactccaacacaaataggactgaatttattgtgaagtaacattggcaatcttaacttattcatttaacttatttttatagctagataaatattgttagtcttagacaatagctcacattttttgagaagcatgccctccctgtccatttgtcttataacatgacccagccctattttacgtcattctaaattcagcctcatataatgaaaatacattatgaaaacagatgtttaggagatttcctgtatagcagtcagccaattcatatgctttgtctctgctggcttctttttccatgcgttaacttttcccaatagcagaggaggcaaatatgagcatacaatccctttgttctaaagatattgttccagctagtggaatgatgttgaatctttaataaccataattagttgctttttcagtatcttctgctttgtctgtgtctatccagtggcctaggaattaaagtgtaagttgttttcgctgttaaattggatatttatatatatatatatagcaagattttcatgtgttatttaattctgtattgtttcttatatttgtagtaaaatattgaacaattaaaagtgttgactcca

SEQ ID NO: 62353 - DNA, 2176 bp, Homo sapiens
  misc_feature (1572)..(1572): n is a, c, g, or t
  misc_feature (1598)..(1598): n is a, c, g, or t
  misc_feature (1609)..(1610): n is a, c, g, or t
  misc_feature (1619)..(1619): n is a, c, g, or t
  misc_feature (1654)..(1654): n is a, c, g, or t
  misc_feature (1662)..(1662): n is a, c, g, or t
  misc_feature (1673)..(1673): n is a, c, g, or t
  misc_feature (1679)..(1679): n is a, c, g, or t
  misc_feature (1700)..(1700): n is a, c, g, or t
  misc_feature (1702)..(1702): n is a, c, g, or t
  misc_feature (1722)..(1722): n is a, c, g, or t
  misc_feature (1736)..(1736): n is a, c, g, or t
  misc_feature (1738)..(1739): n is a, c, g, or t
  misc_feature (1743)..(1743): n is a, c, g, or t
  misc_feature (1756)..(1756): n is a, c, g, or t
  misc_feature (1771)..(1771): n is a, c, g, or t
ggaggtgcggcaggggcacaggtgacgctcctcccgcctgcctagcagagctccaggcgcacatccgcagtcagccacctcgcgcgcgcctccaggagcaaggatggagaggctggtgatcaggatgcccttctgtcatctgtctacctacagcctggtttgggtcatggcagcagtggtgctgtgcacagcacaagtgcaagtggtgacccaggatgaaagagagcagctgtacacacctgcttccttaaaatgctctctgcaaaatgcccaggaagccctcattgtgacatggcagaaaaagaaagctgtaagcccagaaaacatggtcaccttcagcgagaaccatggggtggtgatccagcctgcctataaggacaagataaacattacccagctgggactccaaaactcaaccatcaccttctggaatatcaccctggaggatgaagggtgttacatgtgtctcttcaatacctttggttttgggaagatctcaggaacggcctgcctcaccgtctatgtacagcccatagtatcccttcactacaaattctctgaagaccacctaaatatcacttgctctgccactgcccgcccagcccccatggtcttctggaaggtccctcggtcagggattgaaaatagtacagtgactctgtctcacccaaatgggaccacgtctgttaccagcatcctccatatcaaagaccctaagaatcaggtggggaaggaggtgatctgccaggtgctgcacctggggactgtgaccgactttaagcaaaccgtcaacaaaggctattggttttcagttccgctattgctaagcattgtttccctggtaattcttctcgtcctaatctcaatcttactgtactgggaaacgtcaccggaatcaggaccgagagccctaaataagtcacacagcaccctgaaagtgattccctggtctacttgaatttgacacaagagaaaagcaggaggaaaaggggccattctccaaaggacctgaaagagcaaaagaggtgggagcgaaagccttaaggatcccacgactttttactgccatctgagctactcagtgtttgaatcccaagaggaagtcagtttacctctcaggtctgttgtaggacttgattttgtaaagcaatgccatgttatgtggttgaaagggcactggacttagttagtatcaggagcactgagctcacagactgacttgggctcctactggtggggacctctgttagtcactttacctcatccaaagtataaaggaattggaccaaataatttaccacatagctctaaaacttaatttaaaatgtaattccagaaaaaaaaagggaataagcaaagggggaagaattgaaagagagagagaagaaagaatacagagagcttaccttttgcctttctgttgatgttacatctcttcttcctatgttcttaggtctatgagtctgtttccccatcatttggtatctagtccagttcctgcttactgctttgctaatagctggccttgctagaacccccggcccaccgccgccccccatgcgcccccacganacccactcccacacaaacagcaccgnacccaccgcgnngccacaccngcaccccccacccacccaccccacccacccccacngccagacnaacaccgccanccccanacaaccgcccacacccccccnanacgcacgccccccccgcccnccccccccaccacncnncccngcccccccccacnccaccccaaacccancctcatataatgaaaatacattatgaaaacagatgtttaggagatttcctgtatagcagtcagccaattcatatgctttgtctctgctggcttctttttccatgcgttaacttttcccaatagcagaggaggcaaatatgagcatacaatccctttgttctaaagatattgttccagctagtggaatgatgttgaatctttaataaccataattagttgctttttcagtatcttctgctttgtctgtgtctatccagtggcctaggaattaaagtgtaagttgttttcgctgttaaattggatatttatatatatatatatagcaagattttcatgtgttatttaattctgtattgtttcttatatttgtagtaaaatattgaacaattaaaagtgttgactcca

SEQ ID NO: 62354 - DNA, 1863 bp, Homo sapiens
ggaggtgcggcaggggcacaggtgacgctcctcccgcctgcctagcagagctccaggcgcacatccgcagtcagccacctcgcgcgcgcctccaggagcaaggatggagaggctggtgatcaggatgcccttctgtcatctgtctacctacagcctggtttgggtcatggcagcagtggtgctgtgcacagcacaagtgcaagtggtgacccaggatgaaagagagcagctgtacacacctgcttccttaaaatgctctctgcaaaatgcccaggaagccctcattgtgacatggcagaaaaagaaagctgtaagcccagaaaacatggtcaccttcagcgagaaccatggggtggtgatccagcctgcctataaggacaagataaacattacccagctgggactccaaaactcaaccatcaccttctggaatatcaccctggaggatgaagggtgttacatgtgtctcttcaatacctttggttttgggaagatctcaggaacggcctgcctcaccgtctatgtacagcccatagtatcccttcactacaaattctctgaagaccacctaaatatcacttgctctgccactgcccgcccagcccccatggtcttctggaaggtccctcggtcagggattgaaaatagtacagtgactctgtctcacccaaatgggaccacgtctgttaccagcatcctccatatcaaagaccctaagaatcaggtggggaaggaggtgatctgccaggtgctgcacctggggactgtgaccgactttaagcaaaccgtcaacaaaggctattggttttcagttccgctattgctaagcattgtttccctggtaattcttctcgtcctaatctcaatcttactgtactgggaaacgtcaccggaatcaggaccgagagccctaaataagtcacacagcaccctgaaagtgattccctggtctacttgaatttgacacaagagaaaagcaggaggaaaaggggccattctccaaaggacctgaaagagcaaaagaggtgggagcgaaagccttaaggatcccacgactttttactgccatctgagctactcagtgtttgaatcccaagaggaagtcagtttacctctcaggtctgttgtaggacttgattttgtaaagcaatgccatgttatgtggttgaaagggcactggacttagttagtatcaggagcactgagctcacagactgacttgggctcctactggtggggacctctgttagtcactttacctcatccaaagtataaaggaattggaccaaataatttaccacatagctctaaaacttaatttaaaatgtaattccagaaaaaaaaagggaataagcaaagggggaagaattgaaagagagagagaagaaagaatacagagagcttaccttttgcctttctgttgatgttacatctcttcttcctatgttcttaggtctatgagtctgtttccccatcatttggtatctagtccagttcctgcttactgctttgctaatagctggccttgctagaatccttggtttcactgctgttcttcatgtgcttctatgagatttactccaacacaaataggactgaatttattgtgaagtaacattggcaatcttaacttattcatttaacttatttttatagctagataaatataattagttgctttttcagtatcttctgctttgtctgtgtctatccagtggcctaggaattaaagtgtaagttgttttcgctgttaaattggatatttatatatatatatatagcaagattttcatgtgttatttaattctgtattgtttcttatatttgtagtaaaatattgaacaattaaaagtgttgactcca

SEQ ID NO: 62355 - DNA, 2034 bp, Homo sapiens
ggaggtgcggcaggggcacaggtgacgctcctcccgcctgcctagcagagctccaggcgcacatccgcagtcagccacctcgcgcgcgcctccaggagcaaggatggagaggctggtgatcaggatgcccttctgtcatctgtctacctacagcctggtttgggtcatggcagcagtggtgctgtgcacagcacaagtgcaagtggtgacccaggatgaaagagagcagctgtacacacctgcttccttaaaatgctctctgcaaaatgcccaggaagccctcattgtgacatggcagaaaaagaaagctgtaagcccagaaaacatggtcaccttcagcgagaaccatggggtggtgatccagcctgcctataaggacaagataaacattacccagctgggactccaaaactcaaccatcaccttctggaatatcaccctggaggatgaagggtgttacatgtgtctcttcaatacctttggttttgggaagatctcaggaacggcctgcctcaccgtctatgtacagcccatagtatcccttcactacaaattctctgaagaccacctaaatatcacttgctctgccactgcccgcccagcccccatggtcttctggaaggtccctcggtcagggattgaaaatagtacagtgactctgtctcacccaaatgggaccacgtctgttaccagcatcctccatatcaaagaccctaagaatcaggtggggaaggaggtgatctgccaggtgctgcacctggggactgtgaccgactttaagcaaaccgtcaacaaaggctattggttttcagttccgctattgctaagcattgtttccctggtaattcttctcgtcctaatctcaatcttactgtactgggaaacgtcaccggaatcaggaccgagagccctaaataagtcacacagcaccctgaaagtgattccctggtctacttgaatttgacacaagagaaaagcaggaggaaaaggggccattctccaaaggacctgaaagagcaaaagaggtgggagcgaaagccttaaggatcccacgactttttactgccatctgagctactcagtgtttgaatcccaagaggaagtcagtttacctctcaggtctgttgtaggacttgattttgtaaagcaatgccatgttatgtggttgaaagggcactggacttagttagtatcaggagcactgagctcacagactgacttgggctcctactggtggggacctctgttagtcactttacctcatccaaagtataaaggaattggaccaaataatttaccacatagctctaaaacttaatttaaaatgtaattccagaaaaaaaaagggaataagcaaagggggaagaattgaaagagagagagaagaaagaatacagagagcttaccttttgcctttctgttgatgttacatctcttcttcctatgttcttaggtctatgagtctgtttccccatcatttggtatctagtccagttcctgcttactgctttgctaatagctggccttgctagaatccttggtttcactgctgttcttcatgtgcttctatgagatttactccaacacaaataggactgaatttattgtgaagtaacattggcaatcttaacttattcatttaacttatttttatagctagataaatataattagttgctttttcagtatcttctgctttgtctgtgtctatccagtggcctaggaattaaagtgtaagttgttttcgctgttaaattggatatttatatatatatatatagcaagattttcatgtgttatttaattctgtattgtttcttatatttgtagtaaaatattgaacaattaaaagtgttgactccaaatatttggcttatgatattctcttggggaaatgtgggaaatgaatgataatccttgtcttttcccatcatatgtaaaaaccctcccctcctctctatctttcccctcctaaaagatgagctgggctgggcgcggtggctcaagcctgcaatcccagtactttgggaggcc

SEQ ID NO: 62356 - DNA, 1064 bp, Homo sapiens
  misc_feature (1001)..(1001): n is a, c, g, or t
tggttcttgttgacattacaagcttttaacacatttttgacctaggagccctgttgctggaagtatagtctccagccagttactctcatgatagtactgctataaaactcattcttgtgtggtgttctgtgctatagagtctgtgtattgctgttcatattcggagttctggttttgtttttcccttaaaacctgttaacagttttttttgggggtggggggattcagaactcttgtttcccattccatagcacctgacattatttcaagttttataatatcttaaggtgtatattttattttttttattggcttagttgttttttgttttgttttgtttgagatggagtttcactgttgcccaggctggggtgcaatggtgtgatcttggctcactgcagcctccacctcccgagttcaaatgattctcctgcctcagcttcctgagtagctgggattacaggtgcatgccaccatgcccggctaatttttatatttttattagagacgggatttcgccatgttaaccaggctggtctcgaactcctgacctcaggtgatctgcccgccttggcctcccaaagtgctgggattacaggcatgagccaccatgcctggccttattggcttagtttttaaattatcctccaaaaattttgggcctttttctgtggggaaacaagtgaagctgctcttcagcatagacactacctttatcccatcattttagtaaaaactaggtttgtttcacttctgaggtgtcttattaatgtacttcatctgagaatttgttgatcttaatgttcgagctatataagaactgccattaaaaaaaatgggataatagatgattttatcagtatacctgtggaatatgtacaaactggatctatagatattttgaactggaccaggtgggtattgaagtaacccatcaaaatatgctctgcagtgattccgcttaatgtttaaattcagtaacgtacttgaaaggcaaatcnggcttgttggggggggtcggggggcagacgttggtgggtgacgggcattttggacttaaattg

SEQ ID NO: 62357 - DNA, 696 bp, Homo sapiens
tggttcttgttgacattacaagcttttaacacatttttgacctaggagccctgttgctggaagtatagtctccagccagttactctcatgatagtactgctataaaactcattcttgtgtggtgttctgtgctatagagtctgtgtattgctgttcatattcggagttctggttttgtttttcccttaaaacctgttaacagttttttttgggggtggggggattcagaactcttgtttcccattccatagcacctgacattatttcaagttttataatatcttaaggtgtatattttattttttttattggcttagttgttttttgttttgttttgtttgagatggagtttcactgttgcccaggctggggtgcaatggtgtgatcttggctcactgcagcctccacctcccgagttcaaatgattctcctgcctcagcttcctgagtagctgggattacaggtgcatgccaccatgcccggctaatttttatatttttattagagacgggatttcgccatgttaaccaggctggtctcgaactcctgacctcaggtgatctgcccgccttggcctcccaaagtgctgggattacaggcatgagccaccatgcctggccatttcccctccttttgaaggatgtgtctgcacgtttcagtatatcactagtgcatcctctttactacaattagact

SEQ ID NO: 62358 - DNA, 687 bp, Homo sapiens
gctcagccgcttggggcccgcacggaccctctacttcagtgtagaatgagccaaggagactcaaacccagcagctattccgcatgcagcagaagatattcaaggagatgaccgatggatgtctcagcacaacagatttgttttggactgtaaagacaaagagcctgatgtactgttcgtgggagactccatggtgcagttaatgcagcaatatgagatatggcgagagcttttttccccacttcatgcactgaattttggaattgggggagatacaacaagacatgttttgtggagactaaagaatggagaactggagaatattaagcctaaggtcattgttgtctgggtaggaacaaataaccacgaaaatacagcagaagaagtagcaggtgggatcgaggccattgtacaacttatcaacacaaggcagccacaggccaaaatcattgtattggtatgtagtctttggtgggtagagagttcgtatctttaggtcagctgaggaatctttttagaaatgtgattgctcatgaatattagagaaccttgaggtggaagcagtttatcatactttcgttgacctcttctttaatgtattttactgtcttactggtttcatcattcccccataccagctgtgggggccatcttttatccacgcatccttgtctagaagtatggaagc

SEQ ID NO: 62359 - DNA, 695 bp, Homo sapiens
  misc_feature (56)..(56): n is a, c, g, or t
  misc_feature (58)..(59): n is a, c, g, or t
cggacgcgtgggtcgacccacgcgtcgaccggaagtggaggagctgctgctggcangnnggggccggaggagggacgcgccggagcgggaccgacgggaccgagcgagcgaccgacgcgccacccgccgacgcctcagccgcttggggcccgcacggaccctctacttcagtgtagaatgagccaaggagactcaaacccagcagctattccgcatgcagcagaagatattcaaggagatgaccgatggatgtctcagagacaggattcatgcacagtggctcatgcatgtaatcccagcactttgggaggcagaggcaggaggattgcaggagtccaggagtttgagaccagcctaggcaacatagtaagagctcatctctacaaaaataaatcaaaattggccgggcatgtgtggctcacacctgtaatcccagcactttggaaggctaaggtgggcagattgcttgagctcaggagttcaagaccagcctgggcaacatggtaaaacctcgtctctacaaaaaaatagaaaaaattagccaggcatggtggcatgcctgtaatcccagctactcaggaggctgaggtgggagaattgcttgaacccaggaggcggaggttaccgtgagacgagattgcgccattgcactccagcctgggcaacagagtgagactctgtctcagaaaaaaaaa

SEQ ID NO: 62360 - DNA, 318 bp, Homo sapiens
tacctgcgcgcctcttctccgaaaggcacatccaggattatgtcatatataataattatcagaatcattctacttggctttaaaacatgttttctccaatttttttaaggttcataatttagccttttgtttttatgttgcttagattctgatgtatactgaatattttattaacatgtagcatcaggttgaacatgcttgtcattgatatatggaagatgctatagttagaagtgaatttgttctgctttcttaatcttttccaagcttagcagtgaaaaacaggttttgccccagtaaagggattttttggagggt

SEQ ID NO: 62361 - DNA, 240 bp, Homo sapiens
agagagagagagagagagagagagagttaaggttcataatttagccttttgtttttatgttgcttagattctgatgtatactgaatattttattaacatgtagcatcaggttgaacatgcttgtcattgatatatggaagatgctatagttagaagtgaatttgttctgctttcttaatcttttccaagcttagcagtgaaaaacaggttttgccccagtaaagggattttttggagggt

SEQ ID NO: 62362 - DNA, 2574 bp, Homo sapiens
tggttcttgttgacattacaagcttttaacacatttttgacctaggagccctgttgctggaagtatagtctccagccagttactctcatgatagtactgctataaaactcattcttgtgtggtgttctgtgctatagagtctgtgtattgctgttcatattcggagttctggttttgtttttcccttaaaacctgttaacagttttttttgggggtggggggattcagaactcttgtttcccattccatagcacctgacattatttcaagttttataatatcttaaggtgtatattttattttttttattggcttagttgttttttgttttgttttgtttgagatggagtttcactgttgcccaggctggggtgcaatggtgtgatcttggctcactgcagcctccacctcccgagttcaaatgattctcctgcctcagcttcctgagtagctgggattacaggtgcatgccaccatgcccggctaatttttatatttttattagagacgggatttcgccatgttaaccaggctggtctcgaactcctgacctcaggtgatctgcccgccttggcctcccaaagtgctgggattacaggcatgagccaccatgcctggccttattggcttagtttttaaattatcctccaaaaattttgggcctttttctgtggggaaacaagtgaagctgctcttcagcatagacactacctttatcccatcattttagtaaaaactaggtttgtttcacttctgaggtgtcttattaatgtacttcatctgagaatttgttgatcttaatgttcgagctatataagaactgccattaaaaaaaatgggataatagatgattttatcagtatacctgtggaatatgtacaaactggatctatagatattttgaactggaccaggtgggtattgaagtaacccatcaaaatatgctctgcagtgattccgcttaatgtttaaattcagtaacgtacttgaaaggcaaatttcagtgcttttgtatgttggaggagggcttactgatgcgtgctaagaccgatttctgattgagggatgaaccttgggctcatttttttcttgtgaagtctctttctagaaaattttttggttttgttctttttaaaaaatacatacttttttgaatgtatcatgtcttcattaacaacagaaaatccacatggtgtttactaaacttgtttacgacattaaaaatttcctttttatttttagtagcccaggttgagtttttcacaagagatttttttcttagctgaggtatagttgtatagcaagaagaattaagccagatttttgtgtgtggaaagacagttttctatccacgtctttttctgtttgtcagaaggtgggagtatggtccaaataaatccattaggttactcctgcagcatgcgcttttagcttctctcttgactgaggatcaaatatccctttgtgagctggccctcagctcctttgctcatgtgtacaaacctcagatgttactacattttatatctaccagagctattcaagcaatagtatttgaaccactagccttttaaataaaattctgccccattactgatgtgcagatattgagttcactttcattttttgccagatttctttgcactactttaggtaaaaatagttaatctatttttctttgacatcctagtttgcgtcagtgacagaacttactgcttagtctttgtactttttaaaaaatctataaatttaatgcactgtccaagtgaaatgtcctagttgtcattgtgattaaggggccaactttccaggcagctagcagagatactattctcttcctctcccagcaaatttgtattccttcgcccacgcattcctgctatactagatggcagccagtgatggaactataaagatgtctgtggtcatatgttgaatgtggcagcttgaagatgtactgccacgggtgatctagggcaggctgtcttccagtccatgtgttctcggtcgccgtagacagcgctctggctaccaccgtgaggctacttgaactgtcaggggcatctgcctaaaccagaatcttttgtcagaaaccttaacccaacaaaacaaatcttgagtagctcatgcccggctcttaggaattttgtctgtttaaaaaaaaaaaaaaaaaaaagtccaacttactttattttatttttttaacctagtcactgtttacaattgtatgctaaagcctgaaatattgtctgtgctgtggtgtatgagcattgccaactttatatttattgcagtgaagaagaaactaaaaatatatggaaatgaggagcatgtccaagctcctaaatccgtgtgggtgcatgtgggagaagtgagttagggcctcttgaaaggaggctttttggagaggggtcccccaggtttcttggtgttcctgcttggggatcactgctgctagctgactggacctccccattggaagtttgtgattttgctttggcaaagtttcattgactagtagaactcattctgttttagtgtatatttcaatataaatgtaaacattttgctcaa

SEQ ID NO: 62363 - DNA, 2623 bp, Homo sapiens
  misc_feature (2601)..(2601): n is a, c, g, or t
tggttcttgttgacattacaagcttttaacacatttttgacctaggagccctgttgctggaagtatagtctccagccagttactctcatgatagtactgctataaaactcattcttgtgtggtgttctgtgctatagagtctgtgtattgctgttcatattcggagttctggttttgtttttcccttaaaacctgttaacagttttttttgggggtggggggattcagaactcttgtttcccattccatagcacctgacattatttcaagttttataatatcttaaggtgtatattttattttttttattggcttagttgttttttgttttgttttgtttgagatggagtttcactgttgcccaggctggggtgcaatggtgtgatcttggctcactgcagcctccacctcccgagttcaaatgattctcctgcctcagcttcctgagtagctgggattacaggtgcatgccaccatgcccggctaatttttatatttttattagagacgggatttcgccatgttaaccaggctggtctcgaactcctgacctcaggtgatctgcccgccttggcctcccaaagtgctgggattacaggcatgagccaccatgcctggccttattggcttagtttttaaattatcctccaaaaattttgggcctttttctgtggggaaacaagtgaagctgctcttcagcatagacactacctttatcccatcattttagtaaaaactaggtttgtttcacttctgaggtgtcttattaatgtacttcatctgagaatttgttgatcttaatgttcgagctatataagaactgccattaaaaaaaatgggataatagatgattttatcagtatacctgtggaatatgtacaaactggatctatagatattttgaactggaccaggtgggtattgaagtaacccatcaaaatatgctctgcagtgattccgcttaatgtttaaattcagtaacgtacttgaaaggcaaatttcagtgcttttgtatgttggaggagggcttactgatgcgtgctaagaccgatttctgattgagggatgaaccttgggctcatttttttcttgtgaagtctctttctagaaaattttttggttttgttctttttaaaaaatacatacttttttgaatgtatcatgtcttcattaacaacagaaaatccacatggtgtttactaaacttgtttacgacattaaaaatttcctttttatttttagtagcccaggttgagtttttcacaagagatttttttcttagctgaggtatagttgtatagcaagaagaattaagccagatttttgtgtgtggaaagacagttttctatccacgtctttttctgtttgtcagaaggtgggagtatggtccaaataaatccattaggttactcctgcagcatgcgcttttagcttctctcttgactgaggatcaaatatccctttgtgagctggccctcagctcctttgctcatgtgtacaaacctcagatgttactacattttatatctaccagagctattcaagcaatagtatttgaaccactagccttttaaataaaattctgccccattactgatgtgcagatattgagttcactttcattttttgccagatttctttgcactactttaggtaaaaatagttaatctatttttctttgacatcctagtttgcgtcagtgacagaacttactgcttagtctttgtactttttaaaaaatctataaatttaatgcactgtccaagtgaaatgtcctagttgtcattgtgattaaggggccaactttccaggcagctagcagagatactattctcttcctctcccagcaaatttgtattccttcgcccacgcattcctgctatactagatggcagccagtgatggaactataaagatgtctgtggtcatatgttgaatgtggcagcttgaagatgtactgccacgggtgatctagggcaggctgtcttccagtccatgtgttctcggtcgccgtagacagcgctctggctaccaccgtgaggctacttgaactgtcaggggcatctgcctaaaccagaatcttttgtcagaaaccttaacccaacaaaacaaatcttgagtagctcatgcccggctcttaggaattttgtctgtttaaaaaaaaaaaaaaaaaaaagtccaacttactttattttatttttttaacctagtcactgtttacaattgtatgctaaagcctgaaatattgtctgtgctgtggtgtatgagcattgccaactttatatttattgcagtgaagaagaaactaaaaatatatggaaatgaggagcatgtccaagctcctaaatccgtgtgggtgcatgtgggagaagtgagttagggcctcttgaaaggaggctttttggagaggggtcccccaggtttcttggtgttcctgcttggggatcactgctgctagctgactggacctccccattggaagtttgtgattttgctttggcaaagtttcattgactagtagaactcattctgttttagtgtatatttcaatataaatgtaaacattttgctcaaaaaaaactcgtgccgaattcttgggcncgaggggccaaattccccatag

SEQ ID NO: 62364 - DNA, 2610 bp, Homo sapiens
  misc_feature (2597)..(2597): n is a, c, g, or t
tggttcttgttgacattacaagcttttaacacatttttgacctaggagccctgttgctggaagtatagtctccagccagttactctcatgatagtactgctataaaactcattcttgtgtggtgttctgtgctatagagtctgtgtattgctgttcatattcggagttctggttttgtttttcccttaaaacctgttaacagttttttttgggggtggggggattcagaactcttgtttcccattccatagcacctgacattatttcaagttttataatatcttaaggtgtatattttattttttttattggcttagttgttttttgttttgttttgtttgagatggagtttcactgttgcccaggctggggtgcaatggtgtgatcttggctcactgcagcctccacctcccgagttcaaatgattctcctgcctcagcttcctgagtagctgggattacaggtgcatgccaccatgcccggctaatttttatatttttattagagacgggatttcgccatgttaaccaggctggtctcgaactcctgacctcaggtgatctgcccgccttggcctcccaaagtgctgggattacaggcatgagccaccatgcctggccttattggcttagtttttaaattatcctccaaaaattttgggcctttttctgtggggaaacaagtgaagctgctcttcagcatagacactacctttatcccatcattttagtaaaaactaggtttgtttcacttctgaggtgtcttattaatgtacttcatctgagaatttgttgatcttaatgttcgagctatataagaactgccattaaaaaaaatgggataatagatgattttatcagtatacctgtggaatatgtacaaactggatctatagatattttgaactggaccaggtgggtattgaagtaacccatcaaaatatgctctgcagtgattccgcttaatgtttaaattcagtaacgtacttgaaaggcaaatttcagtgcttttgtatgttggaggagggcttactgatgcgtgctaagaccgatttctgattgagggatgaaccttgggctcatttttttcttgtgaagtctctttctagaaaattttttggttttgttctttttaaaaaatacatacttttttgaatgtatcatgtcttcattaacaacagaaaatccacatggtgtttactaaacttgtttacgacattaaaaatttcctttttatttttagtagcccaggttgagtttttcacaagagatttttttcttagctgaggtatagttgtatagcaagaagaattaagccagatttttgtgtgtggaaagacagttttctatccacgtctttttctgtttgtcagaaggtgggagtatggtccaaataaatccattaggttactcctgcagcatgcgcttttagcttctctcttgactgaggatcaaatatccctttgtgagctggccctcagctcctttgctcatgtgtacaaacctcagatgttactacattttatatctaccagagctattcaagcaatagtatttgaaccactagccttttaaataaaattctgccccattactgatgtgcagatattgagttcactttcattttttgccagatttctttgcactactttaggtaaaaatagttaatctatttttctttgacatcctagtttgcgtcagtgacagaacttactgcttagtctttgtactttttaaaaaatctataaatttaatgcactgtccaagtgaaatgtcctagttgtcattgtgattaaggggccaactttccaggcagctagcagagatactattctcttcctctcccagcaaatttgtattccttcgcccacgcattcctgctatactagatggcagccagtgatggaactataaagatgtctgtggtcatatgttgaatgtggcagcttgaagatgtactgccacgggtgatctagggcaggctgtcttccagtccatgtgttctcggtcgccgtagacagcgctctggctaccaccgtgaggctacttgaactgtcaggggcatctgcctaaaccagaatcttttgtcagaaaccttaacccaacaaaacaaatcttgagtagctcatgcccggctcttaggaattttgtctgtttaaaaaaaaaaaaaaaaaaaagtccaacttactttattttatttttttaacctagtcactgtttacaattgtatgctaaagcctgaaatattgtctgtgctgtggtgtatgagcattgccaactttatatttattgcagtgaagaagaaactaaaaatatatggaaatgaggagcatgtccaagctcctaaatccgtgtgggtgcatgtgggagaagtgagttagggcctcttgaaaggaggctttttggagaggggtcccccaggtttcttggtgttcctgcttggggatcactgctgctagctgactggacctccccattggaagtttgtgattttgctttggcaaagtttcattgactagtagaactcattctgttttagtgtatatttcaatataaatgtaaacattttgctcaaaaaacaaaaaaaaaaaaaaaaanaacaaaaaaaaaa

SEQ ID NO: 62365 - DNA, 2502 bp, Homo sapiens
  misc_feature (2200)..(2200): n is a, c, g, or t
  misc_feature (2489)..(2489): n is a, c, g, or t
tggttcttgttgacattacaagcttttaacacatttttgacctaggagccctgttgctggaagtatagtctccagccagttactctcatgatagtactgctataaaactcattcttgtgtggtgttctgtgctatagagtctgtgtattgctgttcatattcggagttctggttttgtttttcccttaaaacctgttaacagttttttttgggggtggggggattcagaactcttgtttcccattccatagcacctgacattatttcaagttttataatatcttaaggtgtatattttattttttttattggcttagttgttttttgttttgttttgtttgagatggagtttcactgttgcccaggctggggtgcaatggtgtgatcttggctcactgcagcctccacctcccgagttcaaatgattctcctgcctcagcttcctgagtagctgggattacaggtgcatgccaccatgcccggctaatttttatatttttattagagacgggatttcgccatgttaaccaggctggtctcgaactcctgacctcaggtgatctgcccgccttggcctcccaaagtgctgggattacaggcatgagccaccatgcctggccttattggcttagtttttaaattatcctccaaaaattttgggcctttttctgtggggaaacaagtgaagctgctcttcagcatagacactacctttatcccatcattttagtaaaaactaggtttgtttcacttctgaggtgtcttattaatgtacttcatctgagaatttgttgatcttaatgttcgagctatataagaactgccattaaaaaaaatgggataatagatgattttatcagtatacctgtggaatatgtacaaactggatctatagatattttgaactggaccaggtgggtattgaagtaacccatcaaaatatgctctgcagtgattccgcttaatgtttaaattcagtaacgtacttgaaaggcaaatttcagtgcttttgtatgttggaggagggcttactgatgcgtgctaagaccgatttctgattgagggatgaaccttgggctcatttttttcttgtgaagtctctttctagaaaattttttggttttgttctttttaaaaaatacatacttttttgaatgtatcatgtcttcattaacaacagaaaatccacatggtgtttactaaacttgtttacgacattaaaaatttcctttttatttttagtagcccaggttgagtttttcacaagagatttttttcttagctgaggtatagttgtatagcaagaagaattaagccagatttttgtgtgtggaaagacagttttctatccacgtctttttctgtttgtcagaaggtgggagtatggtccaaataaatccattaggttactcctgcagcatgcgcttttagcttctctcttgactgaggatcaaatatccctttgtgagctggccctcagctcctttgctcatgtgtacaaacctcagatgttactacattttatatctaccagagctattcaagcaatagtatttgaaccactagccttttaaataaaattctgccccattactgatgtgcagatattgagttcactttcattttttgccagatttctttgcactactttaggtaaaaatagttaatctatttttctttgacatcctagtttgcgtcagtgacagaacttactgcttagtctttgtactttttaaaaaatctataaatttaatgcactgtccaagtgaaatgtcctagttgtcattgtgattaaggggccaactttccaggcagctagcagagatactattctcttcctctcccagcaaatttgtattccttcgcccacgcattcctgctatactagatggcagccagtgatggaactataaagatgtctgtggtcatatgttgaatgtggcagcttgaagatgtactgccacgggtgatctagggcaggctgtcttccagtccatgtgttctcggtcgccgtagacagcgctctggctaccaccgtgaggctacttgaactgtcaggggcatctgcctaaaccagaatcttttgtcagaaaccttaacccaacaaaacaaatcttgagtagctcatgcccggctcttaggaattttgtctgtttaaaaaaaaaaaaaaaaaaaagtccaacttactttcttcccacantgcacccacacgggatttaggagctgggacattgctaaatccgtgtgggtgcatgtgggagaagtgagttagggcctcttgaaaggaggctttttggagaggggtcccccaggtttcttggtgttcctgcttggggatcactgctgctagctgactggacctccccattggaagtttgtgattttgctttggcaaagtttcattgactagtagaactcattctgttttagtgtatatttcaatataaatgtaaacattttgctcaaaaaacaaaaaaaaaaaaaaaaanaacaaaaaaaaaa

SEQ ID NO: 62366 - DNA, 2466 bp, Homo sapiens
  misc_feature (2200)..(2200): n is a, c, g, or t
tggttcttgttgacattacaagcttttaacacatttttgacctaggagccctgttgctggaagtatagtctccagccagttactctcatgatagtactgctataaaactcattcttgtgtggtgttctgtgctatagagtctgtgtattgctgttcatattcggagttctggttttgtttttcccttaaaacctgttaacagttttttttgggggtggggggattcagaactcttgtttcccattccatagcacctgacattatttcaagttttataatatcttaaggtgtatattttattttttttattggcttagttgttttttgttttgttttgtttgagatggagtttcactgttgcccaggctggggtgcaatggtgtgatcttggctcactgcagcctccacctcccgagttcaaatgattctcctgcctcagcttcctgagtagctgggattacaggtgcatgccaccatgcccggctaatttttatatttttattagagacgggatttcgccatgttaaccaggctggtctcgaactcctgacctcaggtgatctgcccgccttggcctcccaaagtgctgggattacaggcatgagccaccatgcctggccttattggcttagtttttaaattatcctccaaaaattttgggcctttttctgtggggaaacaagtgaagctgctcttcagcatagacactacctttatcccatcattttagtaaaaactaggtttgtttcacttctgaggtgtcttattaatgtacttcatctgagaatttgttgatcttaatgttcgagctatataagaactgccattaaaaaaaatgggataatagatgattttatcagtatacctgtggaatatgtacaaactggatctatagatattttgaactggaccaggtgggtattgaagtaacccatcaaaatatgctctgcagtgattccgcttaatgtttaaattcagtaacgtacttgaaaggcaaatttcagtgcttttgtatgttggaggagggcttactgatgcgtgctaagaccgatttctgattgagggatgaaccttgggctcatttttttcttgtgaagtctctttctagaaaattttttggttttgttctttttaaaaaatacatacttttttgaatgtatcatgtcttcattaacaacagaaaatccacatggtgtttactaaacttgtttacgacattaaaaatttcctttttatttttagtagcccaggttgagtttttcacaagagatttttttcttagctgaggtatagttgtatagcaagaagaattaagccagatttttgtgtgtggaaagacagttttctatccacgtctttttctgtttgtcagaaggtgggagtatggtccaaataaatccattaggttactcctgcagcatgcgcttttagcttctctcttgactgaggatcaaatatccctttgtgagctggccctcagctcctttgctcatgtgtacaaacctcagatgttactacattttatatctaccagagctattcaagcaatagtatttgaaccactagccttttaaataaaattctgccccattactgatgtgcagatattgagttcactttcattttttgccagatttctttgcactactttaggtaaaaatagttaatctatttttctttgacatcctagtttgcgtcagtgacagaacttactgcttagtctttgtactttttaaaaaatctataaatttaatgcactgtccaagtgaaatgtcctagttgtcattgtgattaaggggccaactttccaggcagctagcagagatactattctcttcctctcccagcaaatttgtattccttcgcccacgcattcctgctatactagatggcagccagtgatggaactataaagatgtctgtggtcatatgttgaatgtggcagcttgaagatgtactgccacgggtgatctagggcaggctgtcttccagtccatgtgttctcggtcgccgtagacagcgctctggctaccaccgtgaggctacttgaactgtcaggggcatctgcctaaaccagaatcttttgtcagaaaccttaacccaacaaaacaaatcttgagtagctcatgcccggctcttaggaattttgtctgtttaaaaaaaaaaaaaaaaaaaagtccaacttactttcttcccacantgcacccacacgggatttaggagctgggacattgctaaatccgtgtgggtgcatgtgggagaagtgagttagggcctcttgaaaggaggctttttggagaggggtcccccaggtttcttggtgttcctgcttggggatcactgctgctagctgactggacctccccattggaagtttgtgattttgctttggcaaagtttcattgactagtagaactcattctgttttagtgtatatttcaatataaatgtaaacattttgctcaa

SEQ ID NO: 62367 - DNA, 2579 bp, Homo sapiens
tggttcttgttgacattacaagcttttaacacatttttgacctaggagccctgttgctggaagtatagtctccagccagttactctcatgatagtactgctataaaactcattcttgtgtggtgttctgtgctatagagtctgtgtattgctgttcatattcggagttctggttttgtttttcccttaaaacctgttaacagttttttttgggggtggggggattcagaactcttgtttcccattccatagcacctgacattatttcaagttttataatatcttaaggtgtatattttattttttttattggcttagttgttttttgttttgttttgtttgagatggagtttcactgttgcccaggctggggtgcaatggtgtgatcttggctcactgcagcctccacctcccgagttcaaatgattctcctgcctcagcttcctgagtagctgggattacaggtgcatgccaccatgcccggctaatttttatatttttattagagacgggatttcgccatgttaaccaggctggtctcgaactcctgacctcaggtgatctgcccgccttggcctcccaaagtgctgggattacaggcatgagccaccatgcctggccttattggcttagtttttaaattatcctccaaaaattttgggcctttttctgtggggaaacaagtgaagctgctcttcagcatagacactacctttatcccatcattttagtaaaaactaggtttgtttcacttctgaggtgtcttattaatgtacttcatctgagaatttgttgatcttaatgttcgagctatataagaactgccattaaaaaaaatgggataatagatgattttatcagtatacctgtggaatatgtacaaactggatctatagatattttgaactggaccaggtgggtattgaagtaacccatcaaaatatgctctgcagtgattccgcttaatgtttaaattcagtaacgtacttgaaaggcaaatttcagtgcttttgtatgttggaggagggcttactgatgcgtgctaagaccgatttctgattgagggatgaaccttgggctcatttttttcttgtgaagtctctttctagaaaattttttggttttgttctttttaaaaaatacatacttttttgaatgtatcatgtcttcattaacaacagaaaatccacatggtgtttactaaacttgtttacgacattaaaaatttcctttttatttttagtagcccaggttgagtttttcacaagagatttttttcttagctgaggtatagttgtatagcaagaagaattaagccagatttttgtgtgtggaaagacagttttctatccacgtctttttctgtttgtcagaaggtgggagtatggtccaaataaatccattaggttactcctgcagcatgcgcttttagcttctctcttgactgaggatcaaatatccctttgtgagctggccctcagctcctttgctcatgtgtacaaacctcagatgttactacattttatatctaccagagctattcaagcaatagtatttgaaccactagccttttaaataaaattctgccccattactgatgtgcagatattgagttcactttcattttttgccagatttctttgcactactttaggtaaaaatagttaatctatttttctttgacatcctagtttgcgtcagtgacagaacttactgcttagtctttgtactttttaaaaaatctataaatttaatgcactgtccaagtgaaatgtcctagttgtcattgtgattaaggggccaactttccaggcagctagcagagatactattctcttcctctcccagcaaatttgtattccttcgcccacgcattcctgctatactagatggcagccagtgatggaactataaagatgtctgtggtcatatgttgaatgtggcagcttgaagatgtactgccacgggtgatctagggcaggctgtcttccagtccatgtgttctcggtcgccgtagacagcgctctggctaccaccgtgaggctacttgaactgtcaggggcatctgcctaaaccagaatcttttgtcagaaaccttaacccaacaaaacaaatcttgagtagctcatgcccggctcttaggaattttgtctgtttaaaaaaaaaaaaaaaaaaaagtccaacttactttattttatttttttaacctagtcactgtttacaattgtatgctaaagcctgaaatattgtctgtgctgtggtgtatgagcattgccaactttatatttattgcagtgaagaagaaactaaaaatatatggaaatgaggagcatgtccaagctccgtagtgagggtacataagagatgatcacgatgacgcccttctttcacacgaccctttgtaataaggtgaacaacagattcaaagagcgatatcgtcgtaggtatttgaacaaactgtcatatgtatgggacctacgctagatttatattctttacactagcattttgcatttaataggttacaatgtctgttttagtgtatctttcaaaataaatgaaaacattttgctcaaaaaa

SEQ ID NO: 62368 - DNA, 2298 bp, Homo sapiens
ggtcagacaggctggtgtgaatcggacgaggctcacactgtaattctagcactttggcaggctgaggcaggaagatccctgttgcccaggctggggtgcaatggtgtgatcttggctcactgcagcctccacctcccgagttcaaatgattctcctgcctcagcttcctgagtagctgggattacaggtgcatgccaccatgcccggctaatttttatatttttattagagacgggatttcgccatgttaaccaggctggtctcgaactcctgacctcaggtgatctgcccgccttggcctcccaaagtgctgggattacaggcatgagccaccatgcctggccttattggcttagtttttaaattatcctccaaaaattttgggcctttttctgtggggaaacaagtgaagctgctcttcagcatagacactacctttatcccatcattttagtaaaaactaggtttgtttcacttctgaggtgtcttattaatgtacttcatctgagaatttgttgatcttaatgttcgagctatataagaactgccattaaaaaaaatgggataatagatgattttatcagtatacctgtggaatatgtacaaactggatctatagatattttgaactggaccaggtgggtattgaagtaacccatcaaaatatgctctgcagtgattccgcttaatgtttaaattcagtaacgtacttgaaaggcaaatttcagtgcttttgtatgttggaggagggcttactgatgcgtgctaagaccgatttctgattgagggatgaaccttgggctcatttttttcttgtgaagtctctttctagaaaattttttggttttgttctttttaaaaaatacatacttttttgaatgtatcatgtcttcattaacaacagaaaatccacatggtgtttactaaacttgtttacgacattaaaaatttcctttttatttttagtagcccaggttgagtttttcacaagagatttttttcttagctgaggtatagttgtatagcaagaagaattaagccagatttttgtgtgtggaaagacagttttctatccacgtctttttctgtttgtcagaaggtgggagtatggtccaaataaatccattaggttactcctgcagcatgcgcttttagcttctctcttgactgaggatcaaatatccctttgtgagctggccctcagctcctttgctcatgtgtacaaacctcagatgttactacattttatatctaccagagctattcaagcaatagtatttgaaccactagccttttaaataaaattctgccccattactgatgtgcagatattgagttcactttcattttttgccagatttctttgcactactttaggtaaaaatagttaatctatttttctttgacatcctagtttgcgtcagtgacagaacttactgcttagtctttgtactttttaaaaaatctataaatttaatgcactgtccaagtgaaatgtcctagttgtcattgtgattaaggggccaactttccaggcagctagcagagatactattctcttcctctcccagcaaatttgtattccttcgcccacgcattcctgctatactagatggcagccagtgatggaactataaagatgtctgtggtcatatgttgaatgtggcagcttgaagatgtactgccacgggtgatctagggcaggctgtcttccagtccatgtgttctcggtcgccgtagacagcgctctggctaccaccgtgaggctacttgaactgtcaggggcatctgcctaaaccagaatcttttgtcagaaaccttaacccaacaaaacaaatcttgagtagctcatgcccggctcttaggaattttgtctgtttaaaaaaaaaaaaaaaaaaaagtccaacttactttattttatttttttaacctagtcactgtttacaattgtatgctaaagcctgaaatattgtctgtgctgtggtgtatgagcattgccaactttatatttattgcagtgaagaagaaactaaaaatatatggaaatgaggagcatgtccaagctcctaaatccgtgtgggtgcatgtgggagaagtgagttagggcctcttgaaaggaggctttttggagaggggtcccccaggtttcttggtgttcctgcttggggatcactgctgctagctgactggacctccccattggaagtttgtgattttgctttggcaaagtttcattgactagtagaactcattctgttttagtgtatatttcaatataaatgtaaacattttgctcaa

SEQ ID NO: 62369 - DNA, 2520 bp, Homo sapiens
tggttcttgttgacattacaagcttttaacacatttttgacctaggagccctgttgctggaagtatagtctccagccagttactctcatgatagtactgctataaaactcattcttgtgtggtgttctgtgctatagagtctgtgtattgctgttcatattcggagttctggttttgtttttcccttaaaacctgttaacagttttttttgggggtggggggattcagaactcttgtttcccattccatagcacctgacattatttcaagttttataatatcttaaggtgtatattttattttttttattggcttagttgttttttgttttgttttgtttgagatggagtttcactgttgcccaggctggggtgcaatggtgtgatcttggctcactgcagcctccacctcccgagttcaaatgattctcctgcctcagcttcctgagtagctgggattacaggtgcatgccaccatgcccggctaatttttatatttttattagagacgggatttcgccatgttaaccaggctggtctcgaactcctgacctcaggtgatctgcccgccttggcctcccaaagtgctgggattacaggcatgagccaccatgcctggccttattggcttagtttttaaattatcctccaaaaattttgggcctttttctgtggggaaacaagtgaagctgctcttcagcatagacactacctttatcccatcattttagtaaaaactaggtttgtttcacttctgaggtgtcttattaatgtacttcatctgagaatttgttgatcttaatgttcgagctatataagaactgccattaaaaaaaatgggataatagatgattttatcagtatacctgtggaatatgtacaaactggatctatagatattttgaactggaccaggtgggtattgaagtaacccatcaaaatatgctctgcagtgattccgcttaatgtttaaattcagtaacgtacttgaaaggcaaatttcagtgcttttgtatgttggaggagggcttactgatgcgtgctaagaccgatttctgattgagggatgaaccttgggctcatttttttcttgtgaagtctctttctagaaaattttttggttttgttctttttaaaaaatacatacttttttgaatgtatcatgtcttcattaacaacagaaaatccacatggtgtttactaaacttgtttacgacattatttcttagctgaggtatagttgtatagcaagaagaattaagccagatttttgtgtgtggaaagacagttttctatccacgtctttttctgtttgtcagaaggtgggagtatggtccaaataaatccattaggttactcctgcagcatgcgcttttagcttctctcttgactgaggatcaaatatccctttgtgagctggccctcagctcctttgctcatgtgtacaaacctcagatgttactacattttatatctaccagagctattcaagcaatagtatttgaaccactagccttttaaataaaattctgccccattactgatgtgcagatattgagttcactttcattttttgccagatttctttgcactactttaggtaaaaatagttaatctatttttctttgacatcctagtttgcgtcagtgacagaacttactgcttagtctttgtactttttaaaaaatctataaatttaatgcactgtccaagtgaaatgtcctagttgtcattgtgattaaggggccaactttccaggcagctagcagagatactattctcttcctctcccagcaaatttgtattccttcgcccacgcattcctgctatactagatggcagccagtgatggaactataaagatgtctgtggtcatatgttgaatgtggcagcttgaagatgtactgccacgggtgatctagggcaggctgtcttccagtccatgtgttctcggtcgccgtagacagcgctctggctaccaccgtgaggctacttgaactgtcaggggcatctgcctaaaccagaatcttttgtcagaaaccttaacccaacaaaacaaatcttgagtagctcatgcccggctcttaggaattttgtctgtttaaaaaaaaaaaaaaaaaaaagtccaacttactttattttatttttttaacctagtcactgtttacaattgtatgctaaagcctgaaatattgtctgtgctgtggtgtatgagcattgccaactttatatttattgcagtgaagaagaaactaaaaatatatggaaatgaggagcatgtccaagctcctaaatccgtgtgggtgcatgtgggagaagtgagttagggcctcttgaaaggaggctttttggagaggggtcccccaggtttcttggtgttcctgcttggggatcactgctgctagctgactggacctccccattggaagtttgtgattttgctttggcaaagtttcattgactagtagaactcattctgttttagtgtatatttcaatataaatgtaaacattttgctcaa

SEQ ID NO: 62370 - DNA, 2538 bp, Homo sapiens
tggttcttgttgacattacaagcttttaacacatttttgacctaggagccctgttgctggaagtatagtctccagccagttactctcatgatagtactgctataaaactcattcttgtgtggtgttctgtgctatagagtctgtgtattgctgttcatattcggagttctggttttgtttttcccttaaaacctgttaacagttttttttgggggtggggggattcagaactcttgtttcccattccatagcacctgacattatttcaagttttataatatcttaaggtgtatattttattttttttattggcttagttgttttttgttttgttttgtttgagatggagtttcactgttgcccaggctggggtgcaatggtgtgatcttggctcactgcagcctccacctcccgagttcaaatgattctcctgcctcagcttcctgagtagctgggattacaggtgcatgccaccatgcccggctaatttttatatttttattagagacgggatttcgccatgttaaccaggctggtctcgaactcctgacctcaggtgatctgcccgccttggcctcccaaagtgctgggattacaggcatgagccaccatgcctggccttattggcttagtttttaaattatcctccaaaaattttgggcctttttctgtggggaaacaagtgaagctgctcttcagcatagacactacctttatcccatcattttagtaaaaactaggtttgtttcacttctgaggtgtcttattaatgtacttcatctgagaatttgttgatcttaatgttcgagctatataagaactgccattaaaaaaaatgggataatagatgattttatcaatattttgaactggaccaggtgggtattgaagtaacccatcaaaatatgctctgcagtgattccgcttaatgtttaaattcagtaacgtacttgaaaggcaaatttcagtgcttttgtatgttggaggagggcttactgatgcgtgctaagaccgatttctgattgagggatgaaccttgggctcatttttttcttgtgaagtctctttctagaaaattttttggttttgttctttttaaaaaatacatacttttttgaatgtatcatgtcttcattaacaacagaaaatccacatggtgtttactaaacttgtttacgacattaaaaatttcctttttatttttagtagcccaggttgagtttttcacaagagatttttttcttagctgaggtatagttgtatagcaagaagaattaagccagatttttgtgtgtggaaagacagttttctatccacgtctttttctgtttgtcagaaggtgggagtatggtccaaataaatccattaggttactcctgcagcatgcgcttttagcttctctcttgactgaggatcaaatatccctttgtgagctggccctcagctcctttgctcatgtgtacaaacctcagatgttactacattttatatctaccagagctattcaagcaatagtatttgaaccactagccttttaaataaaattctgccccattactgatgtgcagatattgagttcactttcattttttgccagatttctttgcactactttaggtaaaaatagttaatctatttttctttgacatcctagtttgcgtcagtgacagaacttactgcttagtctttgtactttttaaaaaatctataaatttaatgcactgtccaagtgaaatgtcctagttgtcattgtgattaaggggccaactttccaggcagctagcagagatactattctcttcctctcccagcaaatttgtattccttcgcccacgcattcctgctatactagatggcagccagtgatggaactataaagatgtctgtggtcatatgttgaatgtggcagcttgaagatgtactgccacgggtgatctagggcaggctgtcttccagtccatgtgttctcggtcgccgtagacagcgctctggctaccaccgtgaggctacttgaactgtcaggggcatctgcctaaaccagaatcttttgtcagaaaccttaacccaacaaaacaaatcttgagtagctcatgcccggctcttaggaattttgtctgtttaaaaaaaaaaaaaaaaaaaagtccaacttactttattttatttttttaacctagtcactgtttacaattgtatgctaaagcctgaaatattgtctgtgctgtggtgtatgagcattgccaactttatatttattgcagtgaagaagaaactaaaaatatatggaaatgaggagcatgtccaagctcctaaatccgtgtgggtgcatgtgggagaagtgagttagggcctcttgaaaggaggctttttggagaggggtcccccaggtttcttggtgttcctgcttggggatcactgctgctagctgactggacctccccattggaagtttgtgattttgctttggcaaagtttcattgactagtagaactcattctgttttagtgtatatttcaatataaatgtaaacattttgctcaa

SEQ ID NO: 62371 - DNA, 2372 bp, Homo sapiens
tggttcttgttgacattacaagcttttaacacatttttgacctaggagccctgttgctggaagtatagtctccagccagttactctcatgatagtactgctataaaactcattcttgtgtggtgttctgtgctatagagtctgtgtattgctgttcatattcggagttctggttttgtttttcccttaaaacctgttaacagttttttttgggggtggggggattcagaactcttgtttcccattccatagcacctgacattatttcaagttttataatatcttaaggtgtatattttattttttttattggcttagttgttttttgttttgttttgtttgagatggagtttcactgttgcccaggctggggtgcaatggtgtgatcttggctcactgcagcctccacctcccgagttcaaatgattctcctgcctcagcttcctgagtagctgggattacaggtgcatgccaccatgcccggctaatttttatatttttattagagacgggatttcgccatgttaaccaggctggtctcgaactcctgacctcaggtgatctgcccgccttggcctcccaaagtgctgggattacaggcatgagccaccatgcctggccttattggcttagtttttaaattatcctccaaaaattttgggcctttttctgtggggaaacaagtgaagctgctcttcagcatagacactacctttatcccatcattttagtaaaaactaggtttgtttcacttctgaggtgtcttattaatgtacttcatctgagaatttgttgatcttcagtgcttttgtatgttggaggagggcttactgatgcgtgctaagaccgatttctgattgagggatgaaccttgggctcatttttttcttgtgaagtctctttctagaaaattttttggttttgttctttttaaaaaatacatacttttttgaatgtatcatgtcttcattaacaacagaaaatccacatggtgtttactaaacttgtttacgacattaaaaatttcctttttatttttagtagcccaggttgagtttttcacaagagatttttttcttagctgaggtatagttgtatagcaagaagaattaagccagatttttgtgtgtggaaagacagttttctatccacgtctttttctgtttgtcagaaggtgggagtatggtccaaataaatccattaggttactcctgcagcatgcgcttttagcttctctcttgactgaggatcaaatatccctttgtgagctggccctcagctcctttgctcatgtgtacaaacctcagatgttactacattttatatctaccagagctattcaagcaatagtatttgaaccactagccttttaaataaaattctgccccattactgatgtgcagatattgagttcactttcattttttgccagatttctttgcactactttaggtaaaaatagttaatctatttttctttgacatcctagtttgcgtcagtgacagaacttactgcttagtctttgtactttttaaaaaatctataaatttaatgcactgtccaagtgaaatgtcctagttgtcattgtgattaaggggccaactttccaggcagctagcagagatactattctcttcctctcccagcaaatttgtattccttcgcccacgcattcctgctatactagatggcagccagtgatggaactataaagatgtctgtggtcatatgttgaatgtggcagcttgaagatgtactgccacgggtgatctagggcaggctgtcttccagtccatgtgttctcggtcgccgtagacagcgctctggctaccaccgtgaggctacttgaactgtcaggggcatctgcctaaaccagaatcttttgtcagaaaccttaacccaacaaaacaaatcttgagtagctcatgcccggctcttaggaattttgtctgtttaaaaaaaaaaaaaaaaaaaagtccaacttactttattttatttttttaacctagtcactgtttacaattgtatgctaaagcctgaaatattgtctgtgctgtggtgtatgagcattgccaactttatatttattgcagtgaagaagaaactaaaaatatatggaaatgaggagcatgtccaagctcctaaatccgtgtgggtgcatgtgggagaagtgagttagggcctcttgaaaggaggctttttggagaggggtcccccaggtttcttggtgttcctgcttggggatcactgctgctagctgactggacctccccattggaagtttgtgattttgctttggcaaagtttcattgactagtagaactcattctgttttagtgtatatttcaatataaatgtaaacattttgctcaa

SEQ ID NO: 62372 - DNA, 2169 bp, Homo sapiens
tggttcttgttgacattacaagcttttaacacatttttgacctaggagccctgttgctggaagtatagtctccagccagttactctcatgatagtactgctataaaactcattcttgtgtggtgttctgtgctatagagtctgtgtattgctgttcatattcggagttctggttttgtttttcccttaaaacctgttaacagttttttttgggggtggggggattcagaactcttgtttcccattccatagcacctgacattatttcaagttttataatatcttaaggtgtatattttattttttttattggcttagttgttttttgttttgttttgtttgagatggagtttcactgttgcccaggctggggtgcaatggtgtgatcttggctcactgcagcctccacctcccgagttcaaatgattctcctgcctcagcttcctgagtagctgggattacaggtgcatgccaccatgcccggctaatttttatatttttattagagacgggatttcgccatgttaaccaggctggtctcgaactcctgacctcaggtgatctgcccgccttggcctcccaaagtgctgggattacaggcatgagccaccatgcctggccttattggcttagtttttaaattatcctccaaaaattttgggcctttttctgtggggaaacaagtgaagctgctcttcagcatagacactacctttatcccatcattttagtaaaaactaggtttgtttcacttctgaggtgtcttattaatgtacttcatctgagaatttgttgatcttaatgttcgagctatataagaactgccattaaaaaaaatgggataatagatgattttatcagtatacctgtggaatatgtacaaactggatctatagatattttgaactggaccaggtgggtattgaagtaacccatcaaaatatgctctgcagtgattccgcttaatgtttaaattcagtaacgtacttgaaaggcaaatttcagtgcttttgtatgttggaggagggcttactgatgcgtgctaagaccgatttctgattgagggatgaaccttgggctcatttttttcttgtgaagtctctttctagaaaattttttggttttgttctttttaaaaaatacatacttttttgaatgtatcatgtcttcattaacaacagaaaatccacatggtgtttactaaacttgtttacgacattaaaaatttcctttttatttttagtagcccaggttgagtttttcacaagagatttttttcttagctgaggtatagttgtatagcaagaagaattaagccagatttttgtgtgtggaaagacagttttctatccacgtctttttctgtttgtcagaaggtgggagtatggtccaaataaatccattaggttactcctgcagcatgcgcttttagcttctctcttgactgaggatcaaatatccctttgtgagctggccctcagctcctttgctcatgtgtacaaacctcagatgttactacattttatatctaccagagctattcaagcaatagtatttgaaccactagccttttaaataaaattctgccccattactgatgtgcagatattgagttcactttcattttttgccagatttctttgcactactttaggtaaaaatagttaatctatttttctttgacatcctagtttgcgtcagtgacagaacttactgcttagtctttgtactttttaaaaaatctataaatttaatgcactgtccaagtgaaatgtcctagttgtcattgtgattaaggggccaactttccaggcagctagcagagatactattctcttcctctcccagcaaatttgtattccttcgcccacgcattcctgctatactagatggcagccagtgatggaactataaagatgtctgtggtcatatgttgaatgtggcagcttgaagatgtactgccacgggtgatctagggcaggctgtcttccagtccatgtgttctcggtcgccgtagacagcgctctggctaccaccgtgaggctacttgaactgtcaggggcatctgcctaaaccagaatcttttgtcagaaaccttaacccaacaaaacaaatcttgagtagctcatgcccggctcttaggaatttgggcgtacaggcgccaacaggg

SEQ ID NO: 62373 - DNA, 1358 bp, Homo sapiens
cggacgcgtgggtcgacccacgcgtcgaccccaggttgagtttttcacaagagatttttttcttagctgaggtatagttgtatagcaagaagaattaagccagatttttgtgtgtggaaagacagttttctatccacgtctttttctgtttgtcagaaggtgggagtatggtccaaataaatccattaggttactcctgcagcatgcgcttttagcttctctcttgactgaggatcaaatatccctttgtgagctggccctcagctcctttgctcatgtgtacaaacctcagatgttactacattttatatctaccagagctattcaagcaatagtatttgaaccactagccttttaaataaaattctgccccattactgatgtgcagatattgagttcactttcattttttgccagatttctttgcactactttaggtaaaaatagttaatctatttttctttgacatcctagtttgcgtcagtgacagaacttactgcttagtctttgtactttttaaaaaatctataaatttaatgcactgtccaagtgaaatgtcctagttgtcattgtgattaaggggccaactttccaggcagctagcagagatactattctcttcctctcccagcaaatttgtattccttcgcccacgcattcctgctatactagatggcagccagtgatggaactataaagatgtctgtggtcatatgttgaatgtggcagcttgaagatgtactgccacgggtgatctagggcaggctgtcttccagtccatgtgttctcggtcgccgtagacagcgctctggctaccaccgtgaggctacttgaactgtcaggggcatctgcctaaaccagaatcttttgtcagaaaccttaacccaacaaaacaaatcttgagtagctcatgcccggctcttaggaattttgtctgtttaaaaaaaaaaaaaaaaaaaagtccaacttactttattttatttttttaacctagtcactgtttacaattgtatgctaaagcctgaaatattgtctgtgctgtggtgtatgagcattgccaactttatatttattgcagtgaagaagaaactaaaaatatatggaaatgaggagcatgtccaagctcctaaatccgtgtgggtgcatgtgggagaagtgagttagggcctcttgaaaggaggctttttggagaggggtcccccaggtttcttggtgttcctgcttggggatcactgctgctagctgactggacctccccattggaagtttgtgattttgctttggcaaagtttcattgactagtagaactcattctgttttagtgtatatttcaatataaatgtaaacattttgctcaa

SEQ ID NO: 62374 - DNA, 2098 bp, Homo sapiens
tggttcttgttgacattacaagcttttaacacatttttgacctaggagccctgttgctggaagtatagtctccagccagttactctcatgatagtactgctataaaactcattcttgtgtggtgttctgtgctatagagtctgtgtattgctgttcatattcggagttctggttttgtttttcccttaaaacctgttaacagttttttttgggggtggggggattcagaactcttgtttcccattccatagcacctgacattatttcaagttttataatatcttaaggtgtatattttattttttttattggcttagttgttttttgttttgttttgtttgagatggagtttcactgttgcccaggctggggtgcaatggtgtgatcttggctcactgcagcctccacctcccgagttcaaatgattctcctgcctcagcttcctgagtagctgggattacaggtgcatgccaccatgcccggctaatttttatatttttattagagacgggatttcgccatgttaaccaggctggtctcgaactcctgacctcaggtgatctgcccgccttggcctcccaaagtgctgggattacaggcatgagccaccatgcctggccttattggcttagtttttaaattatcctccaaaaattttgggcctttttctgtggggaaacaagtgaagctgctcttcagcatagacactacctttatcccatcattttagtaaaaactaggtttgtttcacttctgaggtgtcttattaatgtacttcatctgagaatttgttgatcttaatgttcgagctatataagaactgccattaaaaaaaatgggataatagatgattttatcagtatacctgtggaatatgtacaaactggatctatagatattttgaactggaccaggtgggtattgaagtaacccatcaaaatatgctctgcagtgattccgcttaatgtttaaattcagtaacgtacttgaaaggcaaatttcagtgcttttgtatgttggaggagggcttactgatgcgtgctaagaccgatttctgattgagggatgaaccttgggctcatttttttcttgtgaagtctctttctagaaaattttttggttttgttctttttaaaaaatacatacttttttgaatgtatcatgtcttcattaacaacagaaaatccacatggtgtttactaaacttgtttacgacattaaaaatttcctttttatttttagtagcccaggttgagtttttcacaagagatttttttcttagctgaggtatagttgtatagcaagaagaattaagccagatttttgtgtgtggaaagacagttttctatccacgtctttttctgtttgtcagaaggtgggagtatggtccaaataaatccattaggttactcctgcagcatgcgcttttagcttctctcttgactgaggatcaaatatccctttgtgagctggccctcagctcctttgctcatgtgtacaaacctcagatgttactacattttatatctaccagagctattcaagcaatagtatttgaaccactagccttttaaataaaattctgccccattactgatgtgcagatattgagttcactttcattttttgccagatttctttgcactactttaggtaaaaatagttaatctatttttctttgacatcctagtttgcgtcagtgacagaacttactgcttagtctttgtactttttaaaaaatctataaatttaatgcactgtccaagtgaaatgtcctagttgtcattgtgattaaggggccaactttccaggcagctagcagagatactattctcttcctctcccagcaaatttgtattccttcgcccacgcattcctgctatactagatggcagccagtgatggaactataaagatgtctgtggtcatatgttgaatgtggcagcttgaagatgtactgccacgggtgatctagggcaggctgtcttccagtccatgtgttctcggtcgccgtagacagcgctctggctaccaccgtgaggctacttgaactgtcagggtcgacgcggccgcgaatttagtagtagtaggcggccgc

SEQ ID NO: 62375 - DNA, 1938 bp, Homo sapiens
tggttcttgttgacattacaagcttttaacacatttttgacctaggagccctgttgctggaagtatagtctccagccagttactctcatgatagtactgctataaaactcattcttgtgtggtgttctgtgctatagagtctgtgtattgctgttcatattcggagttctggttttgtttttcccttaaaacctgttaacagttttttttgggggtggggggattcagaactcttgtttcccattccatagcacctgacattatttcaagttttataatatcttaaggtgtatattttattttttttattggcttagttgttttttgttttgttttgtttgagatggagtttcactgttgcccaggctggggtgcaatggtgtgatcttggctcactgcagcctccacctcccgagttcaaatgattctcctgcctcagcttcctgagtagctgggattacaggtgcatgccaccatgcccggctaatttttatatttttattagagacgggatttcgccatgttaaccaggctggtctcgaactcctgacctcaggtgatctgcccgccttggcctcccaaagtgctgggattacaggcatgagccaccatgcctggccttattggcttagtttttaaattatcctccaaaaattttgggcctttttctgtggggaaacaagtgaagctgctcttcagcatagacactacctttatcccatcattttagtaaaaactaggtttgtttcacttctgaggtgtcttattaatgtacttcatctgagaatttgttgatcttaatgttcgagctatataagaactgccattaaaaaaaatgggataatagatgattttatcagtatacctgtggaatatgtacaaactggatctatagatattttgaactggaccaggtgggtattgaagtaacccatcaaaatatgctctgcagtgattccgcttaatgtttaaattcagtaacgtacttgaaaggcaaatttcagtgcttttgtatgttggaggagggcttactgatgcgtgctaagaccgatttctgattgagggatgaaccttgggctcatttttttcttgtgaagtctctttctagaaaattttttggttttgttctttttaaaaaatacatacttttttgaatgtatcatgtcttcattaacaacagaaaatccacatggtgtttactaaacttgtttacgacattaaaaatttcctttttatttttagtagcccaggttgagtttttcacaagagatttttttcttagctgaggtatagttgtatagcaagaagaattaagccagatttttgtgtgtggaaagacagttttctatccacgtctttttctgtttgtcagaaggtgggagtatggtccaaataaatccattaggttactcctgcagcatgcgcttttagcttctctcttgactgaggatcaaatatccctttgtgagctggccctcagctcctttgctcatgtgtacaaacctcagatgttactacattttatatctaccagagctattcaagcaatagtatttgaaccactagccttttaaataaaattctgccccattactgatgtgcagatattgagttcactttcattttttgccagatttctttgcactactttaggtaaaaatagttaatctatttttctttgacatcctagtttgcgtcagtgacagaacttactgcttagtctttgtactttttaaaaaatctataaatttaatgcactgtccaagtgaaatgtcctagttgtcattgtgattaaggggccaactttccaggcagctagcagagatactattctcttcctctcccagcaaatttgtattccttcgcccacgcagtccagccgagagctagatggacacacaggggacggcgatttaacaacaggaaacgaggtaaacc

SEQ ID NO: 62376 - DNA, 1102 bp, Homo sapiens
aagcatggtatcaacgcgcagggcccattacggccgatgttactacattttatatctaccagagctattcaagcaatagtatttgaaccactagccttttaaataaaattctgccccattactgatgtgcagatattgagttcactttcattttttgccagatttctttgcactactttaggtaaaaatagttaatctatttttctttgacatcctagtttgcgtcagtgacagaacttactgcttagtctttgtactttttaaaaaatctataaatttaatgcactgtccaagtgaaatgtcctagttgtcattgtgattaaggggccaactttccaggcagctagcagagatactattctcttcctctcccagcaaatttgtattccttcgcccacgcattcctgctatactagatggcagccagtgatggaactataaagatgtctgtggtcatatgttgaatgtggcagcttgaagatgtactgccacgggtgatctagggcaggctgtcttccagtccatgtgttctcggtcgccgtagacagcgctctggctaccaccgtgaggctacttgaactgtcaggggcatctgcctaaaccagaatcttttgtcagaaaccttaacccaacaaaacaaatcttgagtagctcatgcccggctcttaggaattttgtctgtttaaaaaaaaaaaaaaaaaaaagtccaacttactttattttatttttttaacctagtcactgtttacaattgtatgctaaagcctgaaatattgtctgtgctgtggtgtatgagcattgccaactttatatttattgcagtgaagaagaaactaaaaatatatggaaatgaggagcatgtccaagctcctaaatccgtgtgggtgcatgtgggagaagtgagttagggcctcttgaaaggaggctttttggagaggggtcccccaggtttcttggtgttcctgcttggggatcactgctgctagctgactggacctccccattggaagtttgtgattttgctttggcaaagtttcattgactagtagaactcattctgttttagtgtatatttcaatataaatgtaaacattttgctcaa

SEQ ID NO: 62377 - DNA, 1741 bp, Homo sapiens
tggttcttgttgacattacaagcttttaacacatttttgacctaggagccctgttgctggaagtatagtctccagccagttactctcatgatagtactgctataaaactcattcttgtgtggtgttctgtgctatagagtctgtgtattgctgttcatattcggagttctggttttgtttttcccttaaaacctgttaacagttttttttgggggtggggggattcagaactcttgtttcccattccatagcacctgacattatttcaagttttataatatcttaaggtgtatattttattttttttattggcttagttgttttttgttttgttttgtttgagatggagtttcactgttgcccaggctggggtgcaatggtgtgatcttggctcactgcagcctccacctcccgagttcaaatgattctcctgcctcagcttcctgagtagctgggattacaggtgcatgccaccatgcccggctaatttttatatttttattagagacgggatttcgccatgttaaccaggctggtctcgaactcctgacctcaggtgatctgcccgccttggcctcccaaagtgctgggattacaggcatgagccaccatgcctggccttattggcttagtttttaaattatcctccaaaaattttgggcctttttctgtggggaaacaagtgaagctgctcttcagcatagacactacctttatcccatcattttagtaaaaactaggtttgtttcacttctgaggtgtcttattaatgtacttcatctgagaatttgttgatcttaatgttcgagctatataagaactgccattaaaaaaaatgggataatagatgattttatcagtatacctgtggaatatgtacaaactggatctatagatattttgaactggaccaggtgggtattgaagtaacccatcaaaatatgctctgcagtgattccgcttaatgtttaaattcagtaacgtacttgaaaggcaaatttcagtgcttttgtatgttggaggagggcttactgatgcgtgctaagaccgatttctgattgagggatgaaccttgggctcatttttttcttgtgaagtctctttctagaaaattttttggttttgttctttttaaaaaatacatacttttttgaatgtatcatgtcttcattaacaacagaaaatccacatggtgtttactaaacttgtttacgacattaaaaatttcctttttatttttagtagcccaggttgagtttttcacaagagatttttttcttagctgaggtatagttgtatagcaagaagaattaagccagatttttgtgtgtggaaagacagttttctatccacgtctttttctgtttgtcagaaggtgggagtatggtccaaataaatccattaggttactcctgcagcatgcgcttttagcttctctcttgactgaggatcaaatatccctttgtgagctggccctcagctcctttgctcatgtgtacaaacctcagatgttactacattttatatctaccagagctattcaagcaatagtatttgaaccactagccttttaaataaaattctgccccattactgatgtgcagatattgagttcactttcattttttgccagatttctttgcactactttaggtaaaaatagttaatctatttttctttgacatctttgtggagaataagttacaacacaggatggttatgatctagtcgactatgaata

SEQ ID NO: 62378 - DNA, 1058 bp, Homo sapiens
  misc_feature (13)..(13): n is a, c, g, or t
  misc_feature (18)..(18): n is a, c, g, or t
actagtccacggnttggnctggtggttcaacatggtatttgaaccactagccttttaaataaaattctgccccattactgatgtgcagatattgagttcactttcattttttgccagatttctttgcactactttaggtaaaaatagttaatctatttttctttgacatcctagtttgcgtcagtgacagaacttactgcttagtctttgtactttttaaaaaatctataaatttaatgcactgtccaagtgaaatgtcctagttgtcattgtgattaaggggccaactttccaggcagctagcagagatactattctcttcctctcccagcaaatttgtattccttcgcccacgcattcctgctatactagatggcagccagtgatggaactataaagatgtctgtggtcatatgttgaatgtggcagcttgaagatgtactgccacgggtgatctagggcaggctgtcttccagtccatgtgttctcggtcgccgtagacagcgctctggctaccaccgtgaggctacttgaactgtcaggggcatctgcctaaaccagaatcttttgtcagaaaccttaacccaacaaaacaaatcttgagtagctcatgcccggctcttaggaattttgtctgtttaaaaaaaaaaaaaaaaaaaagtccaacttactttattttatttttttaacctagtcactgtttacaattgtatgctaaagcctgaaatattgtctgtgctgtggtgtatgagcattgccaactttatatttattgcagtgaagaagaaactaaaaatatatggaaatgaggagcatgtccaagctcctaaatccgtgtgggtgcatgtgggagaagtgagttagggcctcttgaaaggaggctttttggagaggggtcccccaggtttcttggtgttcctgcttggggatcactgctgctagctgactggacctccccattggaagtttgtgattttgctttggcaaagtttcattgactagtagaactcattctgttttagtgtatatttcaatataaatgtaaacattttgctcaa

SEQ ID NO: 62379 - DNA, 1503 bp, Homo sapiens
  misc_feature (56)..(56): n is a, c, g, or t
  misc_feature (58)..(59): n is a, c, g, or t
cggacgcgtgggtcgacccacgcgtcgaccggaagtggaggagctgctgctggcangnnggggccggaggagggacgcgccggagcgggaccgacgggaccgagcgagcgaccgacgcgccacccgccgacgcctcagccgcttggggcccgcacggaccctctacttcagtgtagaatgagccaaggagactcaaacccagcagctattccgcatgcagcagaagatattcaaggagatgaccgatggatgtctcagcacaacagatttgttttggactgtaaagacaaagagcctgatgtactgttcgtgggagactccatggtgcagttaatgcagcaatatgagatatggcgagagcttttttccccacttcatgcactgaattttggaattgggggagatacaacaagacatgttttgtggagactaaagaatggagaactggagaatattaagcctaaggtcattgttgtctgggtaggaacaaataaccacgaaaatacagcagaagaagtagcaggtgggatcgaggccattgtacaacttatcaacacaaggcagccacaggccaaaatcattgtattgggtttgttacctcgaggtgagaaacccaatcctttgaggcaaaagaacgccaaggtgaaccaactcctcaaggtttcgctgccgaagcttgccaacgtgcagctcctggataccgacgggggttttgtgcactcggacggtgccatctcctgccacgacatgtttgattttctgcatctgacaggagggggctatgcaaagatctgcaaacccctgcatgaactgatcatgcagttgttggaggaaacacctgaggagaaacaaaccaccattgcctgactggctcttatcagtgttaatagcatctcagcttcctcagatcagttctatcactggcactacagaatccttctctttcttaaggcactttgcattgtagaatgttcctggatgttcatatctagtgtttgaaggggaggagggatttaaactggtcctgtacatagaaggtttgtttgacagaggagaaaaattagccaaggaagattgttgtttaaattcatttgaaaccagaaggggactttttagttgtatgtgtaacacattcattgaattattatcactgttttcttgggacaacatcaagcctaaatactgaacaatatgaagattcttttcttggcctttctgtggattatgtcatatataataattatcagaatcattctacttggctttaaaacatgttttctccaatttttttaaggttcataatttagccttttgtttttatgttgcttagattctgatgtatactgaatattttattaacatgtagcatcaggttgaacatgcttgtcattgatatatggaagatgctatagttagaagtgaatttgttctgctttcttaatcttttccaagcttagcagtgaaaaacaggttttgccccagtaaagggattttttggagggt

SEQ ID NO: 62380 - DNA, 967 bp, Homo sapiens
  misc_feature (56)..(56): n is a, c, g, or t
  misc_feature (58)..(59): n is a, c, g, or t
cggacgcgtgggtcgacccacgcgtcgaccggaagtggaggagctgctgctggcangnnggggccggaggagggacgcgccggagcgggaccgacgggaccgagcgagcgaccgacgcgccacccgccgacgcctcagccgcttggggcccgcacggaccctctacttcagtgtagaatgagccaaggagactcaaacccagcagctattccgcatgcagcagaagatattcaaggagatgaccgatggatgtctcagcacaacagatttgttttggactgtaaagacaaagagcctgatgtactgttcgtgggagactccatggtgcagttaatgcagcaatatgagatatggcgagagcttttttccccacttcatgcactgaattttggaattgggggagatacaacaagacatgttttgtggagactaaagaatggagaactggagaatattaagcctaaggtcattgttgtctgggtaggaacaaataaccacgaaaatacagcagaagaagtagcaggtgggatcgaggccattgtacaacttatcaacacaaggcagccacaggccaaaatcattgtattgggtttgttacctcgaggtgagaaacccaatcctttgaggcaaaagaacgccaaggtgaaccaactcctcaaggtttcgctgccgaagcttgccaacgtgcagctcctggataccgacgggggttttgtgcactcggacggtgccatctcctgccacgacatgtttgattttctgcatctgacaggagggggctatgcaaagatctgcaaacccctgcatgaactgatcatgcagttgttggaggaaacacctgaggagaaacaaaccaccattgcctgactggctcttatcagtgttaatagcatctcagcttcctcagatcagcgccattgcactccagcctgggcaacagagtgagactctgtctcagaaaaaaaaa

SEQ ID NO: 62381 - DNA, 1369 bp, Homo sapiens
  misc_feature (56)..(56): n is a, c, g, or t
  misc_feature (58)..(59): n is a, c, g, or t
cggacgcgtgggtcgacccacgcgtcgaccggaagtggaggagctgctgctggcangnnggggccggaggagggacgcgccggagcgggaccgacgggaccgagcgagcgaccgacgcgccacccgccgacgcctcagccgcttggggcccgcacggaccctctacttcagtgtagaatgagccaaggagactcaaacccagcagctattccgcatgcgcttttagcttctctcttgactgaggatcaaatatccctttgtgagctggccctcagctcctttgctcatgtgtacaaacctcagatgttactacattttatatctaccagagctattcaagcaatagtatttgaaccactagccttttaaataaaattctgccccattactgatgtgcagatattgagttcactttcattttttgccagatttctttgcactactttaggtaaaaatagttaatctatttttctttgacatcctagtttgcgtcagtgacagaacttactgcttagtctttgtactttttaaaaaatctataaatttaatgcactgtccaagtgaaatgtcctagttgtcattgtgattaaggggccaactttccaggcagctagcagagatactattctcttcctctcccagcaaatttgtattccttcgcccacgcattcctgctatactagatggcagccagtgatggaactataaagatgtctgtggtcatatgttgaatgtggcagcttgaagatgtactgccacgggtgatctagggcaggctgtcttccagtccatgtgttctcggtcgccgtagacagcgctctggctaccaccgtgaggctacttgaactgtcaggggcatctgcctaaaccagaatcttttgtcagaaaccttaacccaacaaaacaaatcttgagtagctcatgcccggctcttaggaattttgtctgtttaaaaaaaaaaaaaaaaaaaagtccaacttactttattttatttttttaacctagtcactgtttacaattgtatgctaaagcctgaaatattgtctgtgctgtggtgtatgagcattgccaactttatatttattgcagtgaagaagaaactaaaaatatatggaaatgaggagcatgtccaagctcctaaatccgtgtgggtgcatgtgggagaagtgagttagggcctcttgaaaggaggctttttggagaggggtcccccaggtttcttggtgttcctgcttggggatcactgctgctagctgactggacctccccattggaagtttgtgattttgctttggcaaagtttcattgactagtagaactcattctgttttagtgtatatttcaatataaatgtaaacattttgctcaa

SEQ ID NO: 62382 - DNA, 392 bp, Homo sapiens
gaacataaacatggcaacaacagacaccgaggactactagaagggagagcgggcagggcttcaaggtttggaaaactaacctcagcatcacaccaaacctcagcatcacacaatatacctgaaccaaacctcagcatcacacaatatacctgaataacaaacttcgacatggaccccagaatttaaaagctgaaaaaataataataatataaaatttcatactgaactccgttatcagtcctgaggaagacgataacataaaaacaagtagtatcacctttgtgttttctgtttataagctggtatctgcaacagggagatgtaggataaatgggtgtttggagaactgtcaacactgatgtttttatagtcttaggagtactaactctctt

SEQ ID NO: 62383 - DNA, 1958 bp, Homo sapiens
aggcacgagagaaagaaagagaaggaaagaaaataattcatcatgaaattgtatagaatactagcatttatgtcatgacctcgtaggtttagctctttgttagaaaaggaaaccatagaaagagacaagggagaaactgacaaactagggtgtttccgaaaaaaggctctcagtatcgggctcaagggcttgtgcccacatctgagcatgcagggaaatagatgtcccccactggctgcacatgtgagtgactgcggcacaaggctgtgatgtgaagagtcgtgacaccatttcctcacacctccacgcaatgccagatatgattcgacaacattcttcctgtcttataaaaagtgtttatctagcccgttggtttggcagatgaaatcaactaggcttttggcttgcttttactgagcatattcaaaaccatttcaggtcactatagtggtttgctcgggttgccataacaaagtaccacggactgagtggcttaaataacagaaatgtatttcctcacagttctggagatgggagtccaagatcaaggtgctggcagggtcgatcgcattctgaggcctctctccttggcttatagatggcgccttctcccttgtctgcacatggcctttcctccatgcatccgtgtcttaataccatcttcttagagggtcaccaggcattggatcagggccaccctaatggcctcatcttaactacctatatctgcaatgaccctatttctgaacaatttcacattgtgagattctgtgggttagaactggaacatatgaatttggtggtggtatatttttattataagtcaaacccaagtaaagatgtggggtaagattgtgtttaccaagcacaaagaaatggaaatttggggatgtgtaactctggagagcacagatgactaatctatttaatgtagggctccaggggatttgatgaggcctgtgaatcttccacttttattgcctctcttttccaatgacacccataaagaaaaaaaatggaatatccatgaacaggtgcagccaaggaggccaggcccgccatgtgtccactgtatactgtctcctagctcacaggaatgatactgatccactccttgtgctgctctttgtaaagtgatttcacatccattctctggtaatcatcatcacattccctgtgatgaggaattagcaccaattatagaggagaaaactggatctgacatttctcatctcatttgctctatacattaacctcttgcaaaaaatttgtgagtcttgcccaagacccattacaactaattaacggctgaactggtcgtctgatttcaaggccagaattaactttctactgcagctcatggatcagaggttttctttatttaaacaaacaaacaaaaaatcctttgaccgtagcccttgctataacgtttcccactgagttgagggagaaattgaaagtaaacttaggagctttttatagcttgtcaaaccatgcaagagtgggggaagcttatccatctgtggaattgatagaccaggaggaagtaactccggcttagataatgctaccattttgaataaatcaaatggtcttcttttccccttcatggtagttgctgcttaagtttctctaacatgcctgcagtaagtttccattaagaataggaaattaggctcggtacagtggctcacgtctgtagtcttagcactttgggagaccgaggagtgtggatcacttgaggtcaggagttcaagaccagcctggccaacatggtgaaacccccatctctactaaaaatacaaaaattagccaggcatagtggcatgcacctgtaatcccagctactcgagaggctgaggcaggagaatcacttgaaccagggagatggaggttgcagtgagccaagatcatgccactgcactccagcctgggcgatagactgagactctgtctca

SEQ ID NO: 62384 - DNA, 1904 bp, Homo sapiens
aggcacgagagaaagaaagagaaggaaagaaaataattcatcatgaaattgtatagaatactagcatttatgtcatgacctcgtaggtttagctctttgttagaaaaggaaaccatagaaagagacaagggagaaactgacaaactagggtgtttccgaaaaaaggctctcagtatcgggctcaagggcttgtgcccacatctgagcatgcagggaaatagatgtcccccactggctgcacatgtgagtgactgcggcacaaggctgtgatgtgaagagtcgtgacaccatttcctcacacctccacgcaatgccagatatgattcgacaacattcttcctgtcttataaaaagtgtttatctagcccgttggtttggcagatgaaatcaactaggcttttggcttgcttttactgagcatattcacggactgagtggcttaaataacagaaatgtatttcctcacagttctggagatgggagtccaagatcaaggtgctggcagggtcgatcgcattctgaggcctctctccttggcttatagatggcgccttctcccttgtctgcacatggcctttcctccatgcatccgtgtcttaataccatcttcttagagggtcaccaggcattggatcagggccaccctaatggcctcatcttaactacctatatctgcaatgaccctatttctgaacaatttcacattgtgagattctgtgggttagaactggaacatatgaatttggtggtggtatatttttattataagtcaaacccaagtaaagatgtggggtaagattgtgtttaccaagcacaaagaaatggaaatttggggatgtgtaactctggagagcacagatgactaatctatttaatgtagggctccaggggatttgatgaggcctgtgaatcttccacttttattgcctctcttttccaatgacacccataaagaaaaaaaatggaatatccatgaacaggtgcagccaaggaggccaggcccgccatgtgtccactgtatactgtctcctagctcacaggaatgatactgatccactccttgtgctgctctttgtaaagtgatttcacatccattctctggtaatcatcatcacattccctgtgatgaggaattagcaccaattatagaggagaaaactggatctgacatttctcatctcatttgctctatacattaacctcttgcaaaaaatttgtgagtcttgcccaagacccattacaactaattaacggctgaactggtcgtctgatttcaaggccagaattaactttctactgcagctcatggatcagaggttttctttatttaaacaaacaaacaaaaaatcctttgaccgtagcccttgctataacgtttcccactgagttgagggagaaattgaaagtaaacttaggagctttttatagcttgtcaaaccatgcaagagtgggggaagcttatccatctgtggaattgatagaccaggaggaagtaactccggcttagataatgctaccattttgaataaatcaaatggtcttcttttccccttcatggtagttgctgcttaagtttctctaacatgcctgcagtaagtttccattaagaataggaaattaggctcggtacagtggctcacgtctgtagtcttagcactttgggagaccgaggagtgtggatcacttgaggtcaggagttcaagaccagcctggccaacatggtgaaacccccatctctactaaaaatacaaaaattagccaggcatagtggcatgcacctgtaatcccagctactcgagaggctgaggcaggagaatcacttgaaccagggagatggaggttgcagtgagccaagatcatgccactgcactccagcctgggcgatagactgagactctgtctca

SEQ ID NO: 62385 - DNA, 596 bp, Homo sapiens
tgataatatagcttataattagcttatcaattaaatatgcatggctgtatctaaagggcttgaaaactgtttttaaggtttttcttttctatcttgattttatatttaggaaaacccaggtaaactcacaaatagaggaacatttttttaagcaggaaaatatgtaacaatttttgggccaaatgcttaagaagtgagaattttgaaatggaaacaaaagttggaatctgtcttagaagtaatctactccaccccttctctcccagcagtttgagtgctctatttaaagctagaattttgagcatgagaacgccactgtggacaacagagagattttctctctctctcacctcttctctttctctccttctatctccccctccaccaccatctctctcatcttcttccctttgtccccaccccattgcttttttctttctgcttttcctgttccctatccttacgcaggattgttttactgttagccaggttaagtttaagcttcttgaggactttagtactgaaagacaatggctcacttgtaagacctagttgaagagtacagatttagatttgttcagtgtgctgtgatctgt

SEQ ID NO: 62386 - DNA, 591 bp, Homo sapiens
tcattctaatcacccagattttaattaatttatgtaccagcctcatcactaatgtcagtacctacaatctagctgtcttcctgtccattctgtctcttaccaatattatctttccaaaacagtttacttccctgacttaaaacctagatttattcccttttgtttctgtttttgtttttcaggtcttggcccaaacctgttgaagtgttgggcccaaaagagtgttgtcagtcttcttttcccacctgcctctttccattcaccatgcacactacacttctttacaggcattactacaatgctttatggacacactaggcttattcccaacttagatttttactcattgctgactcttctgcctagaatactttattccacgtcctttcccagcaaattcctgtcaccctccaataccagcttaaatttcagcttcatcaggcagaggtgattgctcttcccaatgtttcccctgcatcactttgagtgtctcttcacgtttctccaggaaaatcccttatttagtgttatagtcccagcattcagcatcacaccctgtacatagatgcataggtggtgcttgatgagaga

SEQ ID NO: 62387 - DNA, 460 bp, Homo sapiens
accaattgctttgtattagttcattaccttgctgctgataaagacatacccgagacagggtaatttataaagaaaaagaggtttaatggactcacagttccacgtggctggggaggcctcacactcatggcagaaggtgaaaggcacgtcttacatggcagcaggcaagagagaatgagagccaagtgaatggggaaaccccttataaaaacatcagatctcatgagacttattcagtagcatgagaacagtgtgagggaaacccccacccgcccatgtttccattacctcccaccgggcccctcccatgacacgtgggaattatggcagtacaattcacgatgagatttgggtggggacacagccaaaccatatcatgcttcttttcatttttcccctaaagaaagaatatcgctttctaaaaagatgaaatccctgaaaagatggaatttatttccta

SEQ ID NO: 62388 - DNA, 325 bp, Homo sapiens
cagatggatcagttcatactctggcagttaattttatttcctctaaataaaaatggacaggttaatttattaagcagctgtgttatcaatatggtacgtgtgtgtgcttgtatagatagatgtatatgtacatacataactatacatttttctggacacataatattttaggtgcctattgtatgctagacactgttctaccatcagtaaaaaagcactgccctgttttactgttgattaaaaacaaaattctgaaaatagtgaacaatgaggcttacaacatttgttacaggataagaaatctcaatttagaaaaatgttgtca

SEQ ID NO: 62389 - DNA, 749 bp, Homo sapiens
tgacaatccttttcattcctgttgtttatgatcactaggtcacagggtttgcctttttccaaacctgcatctcaattttcccatcaaaaacatttcccaaatttggataaagaacccatatctagacttgccacatttctgcaccaaaagctcactctcatggttggaacagagccaagcaaagggcacagtaaattgtggtttcttccactcctcatgtgtcttcagatgaaatcattctttccaataatcccagaaattctttctctcctctctcaagcatgtgaaaaggtccagagctctgcagtgtgagctttctactgaaatggcccttggactttgtggttcattcatactcagtggtctagcttgtactacttttgagaatgcaaagcttaactgtggacggattccaatcctggccaggcagggttgctggacactctgagagaagaaagggttaatcccatgaccatcaacttccatgggatttcagccatcctggacaagctaccacaccctcctgccccaggggaggaggaaatgtggaccatcccatcagatattgaccaggtttggctctttaaagagggttacatgcaagaaaataaaattttttaaaaaggtgctgggcaggtgggggactcagatgtaatggaaaagtgtcttttctagaaaagaaaagctaattctaatatgtgtcactaccccacgagacaaatatatacatcttgatttaaaaaaggaaa

SEQ ID NO: 62390 - DNA, 1811 bp, Homo sapiens
agggggcggtggccttgcctctggctctgaggcggcggcgccgggcgctgcgaaggctcggccgctgtagtcagtggtgtggggtgcgcaagggcacggacctcggagctctccccgttcccccgccggccatgaacgccgctcgcaccggctaccgagtcttctcggccaactccacggccgcctgcacggagctggccaagcgcatcacagagcgccttggtgctgaattggggaagtctgttgtatatcaagagaccaatggagaaacaagagttgaaataaaagaatctgttcgtggccaagatattttcattatacagacaatacccagagatgtgaatacagctgtgatggagttgctcatcatggcttacgcactgaagactgcctgtgccaggaacattattggggtcatcccctacttcccctacagcaagcagagcaagatgaggaagaggggttccattgtgtgcaagctgctagcatccatgctggcgaaagcaggtttaactcacattatcactatggatcttcatcaaaaggaaatacaaggctttttcagctttcctgtggacaaccttagagcctcacctttcctgcttcagtatatccaggaagaaattccaaattacagaaatgcagtcattgtagctaagtctcctgatgctgcaaagagggcccagtcctatgcggagagactgcgtctgggtttggccgtcattcacggggaagctcagtgcacggaactggacatggacgatggtcgtcactccccgcctatggtcaaaaatgctactgtgcacccaggcctggagttgccattgatgatggccaaagagaagccaccgataactgtagttggagatgttggaggccgcatcgcaatcatcgtggatgacattattgacgatgtggagagttttgttgctgccgcggagatcctgaaagagagaggcgcctataagatctatgttatggccacccacggcatcctgtctgcagaggcccctcgcctgattgaggagtcctccgtagacgaggtggtggtgacgaatactgtccctcatgaggttcagaagctgcaatgtcccaagataaagactgtggatatcagtttgattctttctgaagccattcggagaatccacaatggagagtccatggcctaccttttccgaaacatcactgtggatgactagctttcacgagggtctcgaccctggacctcctgagggaaacatggaaaaagcagtgccatgagtgatacagtgtttccttgcaagggaggactcgaaacagcctggagttagatatcttcttttgcccggattgatggggaggagggattaaaagagtcaggaagaagacagagctaatggataaatatcataacatggccttacatgtctgctgtcatcagccctgttccttaaaagttctagctgctttcttaaaaataatctgaaaatcttattgatactaaagaggagttaaaggcacataaagtcttaactctataatgttcatttagttgtttcagctccagggaaatggaggtattgatgttgaacctggttagggaagctgagcgcctgtggccctattactatccagttggcctctcccaaatcaacttcaagtcttttatagagaatcgtatttttctttcagaaattgttatgcctacagccattgaaaaatgaagcattcatgttgttacatcttccaaggatgtcagattagaaaatagcatcccacctctgggtatctgagtggctctgaagttgcaaataaaataatttgttgtc

SEQ ID NO: 62391 - DNA, 508 bp, Homo sapiens
ggcctgatcgctttagacagctacttcataaacagccccacaagaaaagaaaaatcgcgatcccgatataaacctgattgcatttagacatacatggccttacatgtctgctgtcatcagccctgttccttaaaagttctagctgctttcttaaaaataatctgaaaatcttattgatactaaagaggagttaaaggcacataaagtcttaactctataatgttcatttagttgtttcagctccagggaaatggaggtattgatgttgaacctggttagggaagctgagcgcctgtggccctattactatccagttggcctctcccaaatcaacttcaagtcttttatagagaatcgtatttttctttcagaaattgttatgcctacagccattgaaaaatgaagcattcatgttgttacatcttccaaggatgtcagattagaaaatagcatcccacctctgggtatctgagtggctctgaagttgcaaataaaataatttgttgtc

SEQ ID NO: 62392 - DNA, 2800 bp, Homo sapiens
agggggcggtggccttgcctctggctctgaggcggcggcgccgggcgctgcgaaggctcggccgctgtagtcagtggtgtggggtgcgcaagggcacggacctcggagctctccccgcttgcgccgagtttctcagcgccttccccacccaaaccggggtctcgcagtcggaagcactcagagtgcagccccgcgcggggccggtcgtaaccgcgccgcgggccggacgatgcccaagaagctgctgctgttgcccccgccctccgcgtcctcggctttccgcgtcccgcgcgcccgccccgttcccccgccggccatgaacgccgctcgcaccggctaccgagtcttctcggccaactccacggccgcctgcacggagctggccaagcgcatcacagagcgccttggtgctgaattggggaagtctgttgtatatcaagagaccaatggagaaacaagagttgaaataaaagaatctgttcgtggccaagatattttcattatacagacaatacccagagatgtgaatacagctgtgatggagttgctcatcatggcttacgcactgaagactgcctgtgccaggaacattattggggtcatcccctacttcccctacagcaagcagagcaagatgaggaagaggggttccattgtgtgcaagctgctagcatccatgctggcgaaagcaggtttaactcacattatcactatggatcttcatcaaaaggaaatacaaggctttttcagctttcctgtggacaaccttagagcctcacctttcctgcttcagtatatccaggaagaaattccaaattacagaaatgcagtcattgtagctaagtctcctgatgctgcaaagagggcccagtcctatgcggagagactgcgtctgggtttggccgtcattcacggggaagctcagtgcacggaactggacatggacgatggtcgtcactccccgcctatggtcaaaaatgctactgtgcacccaggcctggagttgccattgatgatggccaaagagaagccaccgataactgtagttggagatgttggaggccgcatcgcaatcatcgtggtatggttatatgtcatccatgtgcagaggtggcactcctggctcttggtcagtaggttgtccactctgggactgtatttctaggaacgatgatccgaatggatccatgtatcctttctcacccaaactcccttgtgccaagtggcagaaacctgtatccaggtgaacatacattaaagtataacctacagataggaaatgagcacagtactcccgtgagaaaattcagcaccttcaccttcatcatgtggattctaggttctttaaaccagctcacctaatcatgcttgagcgttagggccgaaagatgaactgaagatgagctgttccgttttcacaagtaagaatgggtgtccccgtgcagactcgttctgcatgttgacatactttttttcccagctctaaatatctgctggctagtgggtcatgagtcctttgcagtagcacactttatttcagttttcttctcatgtcacagtctatttgaaaaaaaaataaatggaacgctggctatgtgggattcaccagaaacgtgagacaggaaaatgagtgttggcaatcctcagctccagccgtaatgtcacaggtgcttgactgcgcccgcctctgacagacacacaaggtactgtcaggtgcttctgttgccatttctggatgctcgttctttgacccaggcacacagctctgattttccatcagaaatcctctgaaactgagtgcagaagagagtagagtggtgtgtgcattgacagtatgggctagagggtgtttctttcctaccaactcactctgttctcctcccaggatgacattattgacgatgtggagagttttgttgctgccgcggagatcctgaaagagagaggcgcctataagatctatgttatggccacccacggcatcctgtctgcagaggcccctcgcctgattgaggagtcctccgtagacgaggtggtggtgacgaatactgtccctcatgaggttcagaagctgcaatgtcccaagataaagactgtggatatcagtttgattctttctgaagccattcggagaatccacaatggagagtccatggcctaccttttccgaaacatcactgtggatgactagctttcacgagggtctcgaccctggacctcctgagggaaacatggaaaaagcagtgccatgagtgatacagtgtttccttgcaagggaggactcgaaacagcctggagttagatatcttcttttgcccggattgatggggaggagggattaaaagagtcaggaagaagacagagctaatggataaatatcataacatggccttacatgtctgctgtcatcagccctgttccttaaaagttctagctgctttcttaaaaataatctgaaaatcttattgatactaaagaggagttaaaggcacataaagtcttaactctataatgttcatttagttgtttcagctccagggaaatggaggtattgatgttgaacctggttagggaagctgagcgcctgtggccctattactatccagttggcctctcccaaatcaacttcaagtcttttatagagaatcgtatttttctttcagaaattgttatgcctacagccattgaaaaatgaagcattcatgttgttacatcttccaaggatgtcagattagaaaatagcatcccacctctgggtatctgagtggctctgaagttgcaaataaaataatttgttgtc

SEQ ID NO: 62393 - DNA, 1683 bp, Homo sapiens
atgcagagctagatcgtatacctcctcggaggcggacatgttgggtcctggccaaaaagttggaaacacctggggccactaccgaggcgccttggtgctgaattggggaagtctgttgtatatcaagagaccaatggagaaacaagagttgaaataaaagaatctgttcgtggccaagatattttcattatacagacaatacccagagatgtgaatacagctgtgatggagttgctcatcatggcttacgcactgaagactgcctgtgccaggaacattattggggtcatcccctacttcccctacagcaagcagagcaagatgaggaagaggggttccattgtgtgcaagctgctagcatccatgctggcgaaagcaggtttaactcacattatcactatggatcttcatcaaaaggaaatacaaggctttttcagctttcctgtggacaaccttagagcctcacctttcctgcttcagtatatccaggaagaaattccaaattacagaaatgcagtcattgtagctaagtctcctgatgctgcaaagagggcccagtcctatgcggagagactgcgtctgggtttggccgtcattcacggggaagctcagtgcacggaactggacatggacgatggtcgtcactccccgcctatggtcaaaaatgctactgtgcacccaggcctggagttgccattgatgatggccaaagagaagccaccgataactgtagttggagatgttggaggccgcatcgcaatcatcgtggatgacattattgacgatgtggagagttttgttgctgccgcggagatcctgaaagagagaggcgcctataagatctatgttatggccacccacggcatcctgtctgcagaggcccctcgcctgattgaggagtcctccgtagacgaggtggtggtgacgaatactgtccctcatgaggttcagaagctgcaatgtcccaagataaagactgtggatatcagtttgattctttctgaagccattcggagaatccacaatggagagtccatggcctaccttttccgaaacatcactgtggatgactagctttcacgagggtctcgaccctggacctcctgagggaaacatggaaaaagcagtgccatgagtgatacagtgtttccttgcaagggaggactcgaaacagcctggagttagatatcttcttttgcccggattgatggggaggagggattaaaagagtcaggaagaagacagagctaatggataaatatcataacatggccttacatgtctgctgtcatcagccctgttccttaaaagttctagctgctttcttaaaaataatctgaaaatcttattgatactaaagaggagttaaaggcacataaagtcttaactctataatgttcatttagttgtttcagctccagggaaatggaggtattgatgttgaacctggttagggaagctgagcgcctgtggccctattactatccagttggcctctcccaaatcaacttcaagtcttttatagagaatcgtatttttctttcagaaattgttatgcctacagccattgaaaaatgaagcattcatgttgttacatcttccaaggatgtcagattagaaaatagcatcccacctctgggtatctgagtggctctgaagttgcaaataaaataatttgttgtc

SEQ ID NO: 62394 - DNA, 1990 bp, Homo sapiens
ggaataggggccaggctgctgcaggctcagggcagctcaacttccaaatcctgtagcttcagacttgtggtccttcacgacatgctgagtcacaatctactgctccctcaagcccaatgtcaccacaagcagagtctctaaaggacattctcagaagatggtactgtcaatgtgagaggcacctctcctcccctcgagttctggtgcagctgataactagagatctcaaatgcttccctgggctttactttctacttcaacaagtactgattgcgggcctctggagcccacacactgccctatacactgggtaacacggagcactcaggaatacacgatcttggcggggcgtgatggctgaggcctgtaatgtcggcattttgaatgactgaggcgccttggtgctgaattggggaagtctgttgtatatcaagagaccaatggagaaacaagagttgaaataaaagaatctgttcgtggccaagatattttcattatacagacaatacccagagatgtgaatacagctgtgatggagttgctcatcatggcttacgcactgaagactgcctgtgccaggaacattattggggtcatcccctacttcccctacagcaagcagagcaagatgaggaagaggggttccattgtgtgcaagctgctagcatccatgctggcgaaagcaggtttaactcacattatcactatggatcttcatcaaaaggaaatacaaggctttttcagctttcctgtggacaaccttagagcctcacctttcctgcttcagtatatccaggaagaaattccaaattacagaaatgcagtcattgtagctaagtctcctgatgctgcaaagagggcccagtcctatgcggagagactgcgtctgggtttggccgtcattcacggggaagctcagtgcacggaactggacatggacgatggtcgtcactccccgcctatggtcaaaaatgctactgtgcacccaggcctggagttgccattgatgatggccaaagagaagccaccgataactgtagttggagatgttggaggccgcatcgcaatcatcgtggatgacattattgacgatgtggagagttttgttgctgccgcggagatcctgaaagagagaggcgcctataagatctatgttatggccacccacggcatcctgtctgcagaggcccctcgcctgattgaggagtcctccgtagacgaggtggtggtgacgaatactgtccctcatgaggttcagaagctgcaatgtcccaagataaagactgtggatatcagtttgattctttctgaagccattcggagaatccacaatggagagtccatggcctaccttttccgaaacatcactgtggatgactagctttcacgagggtctcgaccctggacctcctgagggaaacatggaaaaagcagtgccatgagtgatacagtgtttccttgcaagggaggactcgaaacagcctggagttagatatcttcttttgcccggattgatggggaggagggattaaaagagtcaggaagaagacagagctaatggataaatatcataacatggccttacatgtctgctgtcatcagccctgttccttaaaagttctagctgctttcttaaaaataatctgaaaatcttattgatactaaagaggagttaaaggcacataaagtcttaactctataatgttcatttagttgtttcagctccagggaaatggaggtattgatgttgaacctggttagggaagctgagcgcctgtggccctattactatccagttggcctctcccaaatcaacttcaagtcttttatagagaatcgtatttttctttcagaaattgttatgcctacagccattgaaaaatgaagcattcatgttgttacatcttccaaggatgtcagattagaaaatagcatcccacctctgggtatctgagtggctctgaagttgcaaataaaataatttgttgtc

SEQ ID NO: 62395 - DNA, 1607 bp, Homo sapiens
ggacgcgtgggtcgacccacgcgtccgggggaaggtctgttgtatatcaagagaccaatggagaaacaagagttgaaataaaagaatctgttcgtggccaagatattttcattatacagacaatacccagagatgtgaatacagctgtgatggagttgctcatcatggcttacgcactgaagactgcctgtgccaggaacattattggggtcatcccctacttcccctacagcaagcagagcaagatgaggaagaggggttccattgtgtgcaagctgctagcatccatgctggcgaaagcaggtttaactcacattatcactatggatcttcatcaaaaggaaatacaaggctttttcagctttcctgtggacaaccttagagcctcacctttcctgcttcagtatatccaggaagaaattccaaattacagaaatgcagtcattgtagctaagtctcctgatgctgcaaagagggcccagtcctatgcggagagactgcgtctgggtttggccgtcattcacggggaagctcagtgcacggaactggacatggacgatggtcgtcactccccgcctatggtcaaaaatgctactgtgcacccaggcctggagttgccattgatgatggccaaagagaagccaccgataactgtagttggagatgttggaggccgcatcgcaatcatcgtggatgacattattgacgatgtggagagttttgttgctgccgcggagatcctgaaagagagaggcgcctataagatctatgttatggccacccacggcatcctgtctgcagaggcccctcgcctgattgaggagtcctccgtagacgaggtggtggtgacgaatactgtccctcatgaggttcagaagctgcaatgtcccaagataaagactgtggatatcagtttgattctttctgaagccattcggagaatccacaatggagagtccatggcctaccttttccgaaacatcactgtggatgactagctttcacgagggtctcgaccctggacctcctgagggaaacatggaaaaagcagtgccatgagtgatacagtgtttccttgcaagggaggactcgaaacagcctggagttagatatcttcttttgcccggattgatggggaggagggattaaaagagtcaggaagaagacagagctaatggataaatatcataacatggccttacatgtctgctgtcatcagccctgttccttaaaagttctagctgctttcttaaaaataatctgaaaatcttattgatactaaagaggagttaaaggcacataaagtcttaactctataatgttcatttagttgtttcagctccagggaaatggaggtattgatgttgaacctggttagggaagctgagcgcctgtggccctattactatccagttggcctctcccaaatcaacttcaagtcttttatagagaatcgtatttttctttcagaaattgttatgcctacagccattgaaaaatgaagcattcatgttgttacatcttccaaggatgtcagattagaaaatagcatcccacctctgggtatctgagtggctctgaagttgcaaataaaataatttgttgtc

SEQ ID NO: 62396 - DNA, 1941 bp, Homo sapiens
agggggcggtggccttgcctctggctctgaggcggcggcgccgggcgctgcgaaggctcggccgctgtagtcagtggtgtggggtgcgcaagggcacggacctcggagctctccccgcttgcgccgagtttctcagcgccttccccacccaaaccggggtctcgcagtcggaagcactcagagtgcagccccgcgcggggccggtcgtaaccgcgccgcgggccggacgatgcccaagaagctgctgctgttgcccccgccctccgcgtcctcggctttccgcgtcccgcgcgcccgccccgttcccccgccggccatgaacgccgctcgcaccggctaccgagtcttctcggccaactccacggccgcctgcacggagctggccaagcgcatcacagagcgccttggtgctgaattggggaagtctgttgtatatcaagagaccaatggagaaacaagagttgagatgtgaatacagctgtgatggagttgctcatcatggcttacgcactgaagactgcctgtgccaggaacattattggggtcatcccctacttcccctacagcaagcagagcaagatgaggaagaggggttccattgtgtgcaagctgctagcatccatgctggcgaaagcaggtttaactcacattatcactatggatcttcatcaaaaggaaatacaaggctttttcagctttcctgtggacaaccttagagcctcacctttcctgcttcagtatatccaggaagaaattccaaattacagaaatgcagtcattgtagctaagtctcctgatgctgcaaagagggcccagtcctatgcggagagactgcgtctgggtttggccgtcattcacggggaagctcagtgcacggaactggacatggacgatggtcgtcactccccgcctatggtcaaaaatgctactgtgcacccaggcctggagttgccattgatgatggccaaagagaagccaccgataactgtagttggagatgttggaggccgcatcgcaatcatcgtggatgacattattgacgatgtggagagttttgttgctgccgcggagatcctgaaagagagaggcgcctataagatctatgttatggccacccacggcatcctgtctgcagaggcccctcgcctgattgaggagtcctccgtagacgaggtggtggtgacgaatactgtccctcatgaggttcagaagctgcaatgtcccaagataaagactgtggatatcagtttgattctttctgaagccattcggagaatccacaatggagagtccatggcctaccttttccgaaacatcactgtggatgactagctttcacgagggtctcgaccctggacctcctgagggaaacatggaaaaagcagtgccatgagtgatacagtgtttccttgcaagggaggactcgaaacagcctggagttagatatcttcttttgcccggattgatggggaggagggattaaaagagtcaggaagaagacagagctaatggataaatatcataacatggccttacatgtctgctgtcatcagccctgttccttaaaagttctagctgctttcttaaaaataatctgaaaatcttattgatactaaagaggagttaaaggcacataaagtcttaactctataatgttcatttagttgtttcagctccagggaaatggaggtattgatgttgaacctggttagggaagctgagcgcctgtggccctattactatccagttggcctctcccaaatcaacttcaagtcttttatagagaatcgtatttttctttcagaaattgttatgcctacagccattgaaaaatgaagcattcatgttgttacatcttccaaggatgtcagattagaaaatagcatcccacctctgggtatctgagtggctctgaagttgcaaataaaataatttgttgtc

SEQ ID NO: 62397 - DNA, 2487 bp, Homo sapiens
atgcagagctagatcgtatacctcctcggaggcggacatgttgggtcctggccaaaaagttggaaacacctggggccactaccgaggcgccttggtgctgaattggggaagtctgttgtatatcaagagaccaatggagaaacaagagttgaaataaaagaatctgttcgtggccaagatattttcattatacagacaatacccagagatgtgaatacagctgtgatggagttgctcatcatggcttacgcactgaagactgcctgtgccaggaacattattggggtcatcccctacttcccctacagcaagcagagcaagatgaggaagaggggttccattgtgtgcaagctgctagcatccatgctggcgaaagcaggtttaactcacattatcactatggatcttcatcaaaaggaaatacaaggctttttcagctttcctgtggacaaccttagagcctcacctttcctgcttcagtatatccaggaagaaattccaaattacagaaatgcagtcattgtagctaagtctcctgatgctgcaaagagggcccagtcctatgcggagagactgcgtctgggtttggccgtcattcacggggaagctcagtgcacggaactggacatggacgatggtcgtcactccccgcctatggtcaaaaatgctactgtgcacccaggcctggagttgccattgatgatggccaaagagaagccaccgataactgtagttggagatgttggaggccgcatcgcaatcatcgtggtatggttatatgtcatccatgtgcagaggtggcactcctggctcttggtcagtaggttgtccactctgggactgtatttctaggaacgatgatccgaatggatccatgtatcctttctcacccaaactcccttgtgccaagtggcagaaacctgtatccaggtgaacatacattaaagtataacctacagataggaaatgagcacagtactcccgtgagaaaattcagcaccttcaccttcatcatgtggattctaggttctttaaaccagctcacctaatcatgcttgagcgttagggccgaaagatgaactgaagatgagctgttccgttttcacaagtaagaatgggtgtccccgtgcagactcgttctgcatgttgacatactttttttcccagctctaaatatctgctggctagtgggtcatgagtcctttgcagtagcacactttatttcagttttcttctcatgtcacagtctatttgaaaaaaaaataaatggaacgctggctatgtgggattcaccagaaacgtgagacaggaaaatgagtgttggcaatcctcagctccagccgtaatgtcacaggtgcttgactgcgcccgcctctgacagacacacaaggtactgtcaggtgcttctgttgccatttctggatgctcgttctttgacccaggcacacagctctgattttccatcagaaatcctctgaaactgagtgcagaagagagtagagtggtgtgtgcattgacagtatgggctagagggtgtttctttcctaccaactcactctgttctcctcccaggatgacattattgacgatgtggagagttttgttgctgccgcggagatcctgaaagagagaggcgcctataagatctatgttatggccacccacggcatcctgtctgcagaggcccctcgcctgattgaggagtcctccgtagacgaggtggtggtgacgaatactgtccctcatgaggttcagaagctgcaatgtcccaagataaagactgtggatatcagtttgattctttctgaagccattcggagaatccacaatggagagtccatggcctaccttttccgaaacatcactgtggatgactagctttcacgagggtctcgaccctggacctcctgagggaaacatggaaaaagcagtgccatgagtgatacagtgtttccttgcaagggaggactcgaaacagcctggagttagatatcttcttttgcccggattgatggggaggagggattaaaagagtcaggaagaagacagagctaatggataaatatcataacatggccttacatgtctgctgtcatcagccctgttccttaaaagttctagctgctttcttaaaaataatctgaaaatcttattgatactaaagaggagttaaaggcacataaagtcttaactctataatgttcatttagttgtttcagctccagggaaatggaggtattgatgttgaacctggttagggaagctgagcgcctgtggccctattactatccagttggcctctcccaaatcaacttcaagtcttttatagagaatcgtatttttctttcagaaattgttatgcctacagccattgaaaaatgaagcattcatgttgttacatcttccaaggatgtcagattagaaaatagcatcccacctctgggtatctgagtggctctgaagttgcaaataaaataatttgttgtc

SEQ ID NO: 62398 - DNA, 1603 bp, Homo sapiens
agagatcttatttagtttttctctggtatcagatttcgatattggaaggcacatcaaatgagctctcccttaagtcacaatgcctgaggcagcagacagggtcagctttagtcgtggacgatcatagctttaaaagacactaaaaacagattttttttctacgtatctttagcaatttgcttatgttttctaaaatgaatgttttaagaattatttttaaaaaattcttgacgtaggagtgctttttccagtgatgttaattgataaatattgaaaaatctaaaacttgtgactaaaattctagcatatttgatgactagtttggatcattataagagggaaaacttgaataccagcatccaggtgttattttctgataacttttcagtattttctatttttccttcaaatctagattccaaattacagaaatgcagtcattgtagctaagtctcctgatgctgcaaagagggcccagtcctatgcggagagactgcgtctgggtttggccgtcattcacggggaagctcagtgcacggaactggacatggacgatggtcgtcactccccgcctatggtcaaaaatgctactgtgcacccaggcctggagttgccattgatgatggccaaagagaagccaccgataactgtagttggagatgttggaggccgcatcgcaatcatcgtggatgacattattgacgatgtggagagttttgttgctgccgcggagatcctgaaagagagaggcgcctataagatctatgttatggccacccacggcatcctgtctgcagaggcccctcgcctgattgaggagtcctccgtagacgaggtggtggtgacgaatactgtccctcatgaggttcagaagctgcaatgtcccaagataaagactgtggatatcagtttgattctttctgaagccattcggagaatccacaatggagagtccatggcctaccttttccgaaacatcactgtggatgactagctttcacgagggtctcgaccctggacctcctgagggaaacatggaaaaagcagtgccatgagtgatacagtgtttccttgcaagggaggactcgaaacagcctggagttagatatcttcttttgcccggattgatggggaggagggattaaaagagtcaggaagaagacagagctaatggataaatatcataacatggccttacatgtctgctgtcatcagccctgttccttaaaagttctagctgctttcttaaaaataatctgaaaatcttattgatactaaagaggagttaaaggcacataaagtcttaactctataatgttcatttagttgtttcagctccagggaaatggaggtattgatgttgaacctggttagggaagctgagcgcctgtggccctattactatccagttggcctctcccaaatcaacttcaagtcttttatagagaatcgtatttttctttcagaaattgttatgcctacagccattgaaaaatgaagcattcatgttgttacatcttccaaggatgtcagattagaaaatagcatcccacctctgggtatctgagtggctctgaagttgcaaataaaataatttgttgtc

SEQ ID NO: 62399 - DNA, 2141 bp, Homo sapiens
agggggcggtggccttgcctctggctctgaggcggcggcgccgggcgctgcgaaggctcggccgctgtagtcagtggtgtggggtgcgcaagggcacggacctcggagctctccccgcttgcgccgagtttctcagcgccttccccacccaaaccggggtctcgcagtcggaagcactcagagtgcagccccgcgcggggccggtcgtaaccgcgccgcgggccggacgatgcccaagaagctgctgctgttgcccccgccctccgcgtcctcggctttccgcgtcccgcgcgcccgccccgttcccccgccggccatgaacgccgctcgcaccggctaccgagtcttctcggccaactccacggccgcctgcacggagctggccaagcgcatcacagagcgccttggtgctgaattggggaagtctgttgtatatcaagagaccaatggagaaacaagagttgaaataaaagaatctgttcgtggccaagatattttcattatacagacaatacccagagatgtgaatacagctgtgatggagttgctcatcatggcttacgcactgaagactgcctgtgccaggaacattattggggtcatcccctacttcccctacagcaagcagagcaagatgaggaagaggggttccattgtgtgcaagctgctagcatccatgctggcgaaagcaggtttaactcacattatcactatggatcttcatcaaaaggaaatacaaggctttttcagctttcctgtggacaaccttagagcctcacctttcctgcttcagtatatccaggaagaaattccaaattacagaaatgcagtcattgtagctaagtctcctgatgctgcaaagagggcccagtcctatgcggagagactgcgtctgggtttggccgtcattcacggggaagctcagtgcacggaactggacatggacgatggtcgtcactccccgcctatggtcaaaaatgctactgtgcacccaggcctggagttgccattgatgatggccaaagagaagccaccgataactgtagttggagatgttggaggccgcatcgcaatcatcgtggatgacattattgacgatgtggagagttttgttgctgccgcggagatcctgaaagagagaggcgcctataagatctatgttatggccacccacggcatcctgtctgcagaggcccctcgcctgattgaggagtcctccgtagacgaggtggtggtgacgaatactgtccctcatgaggttcagaagctgcaatgtcccaagataaagactgtggatatcagtttgattctttctgaagccattcggagaatccacaatggagagtccatggcctaccttttccgaaacatcactgtggatgactagctttcacgagggtctcgaccctggacctcctgagggaaacatggaaaaagcagtgccatgagtgatacagtgtttccttgcaagggaggactcgaaacagcctggagttagatatcttcttttgcccggattgatggggaggagggattaaaagagtcaggaagaagacagagctaatggataaatatcataacatggccttacatgtctgctgtcatcagccctgttccttaaaagttctagctgctttcttaaaaataatctgaaaatcttattgatactaaagaggagttaaaggcacataaagtcttaactctataatgttcatttagttgtttcagctccaggtattactatccagttggcctctcccaaatcaacttcaagtcttttatagagaatcgtatttttctttcagaaattgttatgcctacagccattgaaaaatgaagcattcatgttgttacatcttccaaggatgtcagattagaaaatagcatcccacctctgggtatctgagtggctctgaagttgcaaataaaataatttgttgtcaaaaaaaaaaaaaaaaaaaaaaataaaaaattaaaaggaaaataaatccccgccggatccgaccgccactttcaaaaccccccaccgttctagaaccgggggagcttccgtccctgagtagaattcgagggggtaaagaagaggaaggggaaaaatattttgtaccagcccaggggggaaaaagcccccggcttgaaaa

SEQ ID NO: 62400 - DNA, 727 bp, Homo sapiens
agttcgacggagactctccattgtggatatcagtttgattctttctgaagccattcggagaatccacaatggagagtccatggcctaccttttccgaaacatcactgtggatgactagctttcacgagggtctcgaccctggacctcctgagggaaacatggaaaaagcagtgccatgagtgatacagtgtttccttgcaagggaggactcgaaacagcctggagttagatatcttcttttgcccggattgatggggaggagggattaaaagagtcaggaagaagacagagctaatggataaatatcataacatggccttacatgtctgctgtcatcagccctgttccttaaaagttctagctgctttcttaaaaataatctgaaaatcttattgatactaaagaggagttaaaggcacataaagtcttaactctataatgttcatttagttgtttcagctccagggaaatggaggtattgatgttgaacctggttagggaagctgagcgcctgtggccctattactatccagttggcctctcccaaatcaacttcaagtcttttatagagaatcgtatttttctttcagaaattgttatgcctacagccattgaaaaatgaagcattcatgttgttacatcttccaaggatgtcagattagaaaatagcatcccacctctgggtatctgagtggctctgaagttgcaaataaaataatttgttgtc

SEQ ID NO: 62401 - DNA, 1311 bp, Homo sapiens
agggggcggtggccttgcctctggctctgaggcggcggcgccgggcgctgcgaaggctcggccgctgtagtcagtggtgtggggtgcgcaagggcacggacctcggagctctccccgcttgcgccgagtttctcagcgccttccccacccaaaccggggtctcgcagtcggaagcactcagagtgcagccccgcgcggggccggtcgtaaccgcgccgcgggccggacgatgcccaagaagctgctgctgttgcccccgccctccgcgtcctcggctttccgcgtcccgcgcgcccgccccgttcccccgccggccatgaacgccgctcgcaccggctaccgagtcttctcggccaactccacggccgcctgcacggagctggccaagcgcatcacagagcgccttggtgctgaattggggaagtctgttgtatatcaagagaccaatggagaaacaagagttgaaataaaagaatctgttcgtggccaagatattttcattatacagacaatacccagagatgtgaatacagctgtgatggagttgctcatcatggcttacgcactgaagactgcctgtgccaggaacattattggggtcatcccctacttcccctacagcaagcagagcaagatgaggaagaggggttccattgtgtgcaagctgctagcatccatgctggcgaaagcaggtttaactcacattatcactatggatcttcatcaaaaggaaatacaaggctttttcagctttcctgtggacaaccttagagcctcacctttcctgcttcagtatatccaggaagaaattccaaattacagaaatgcagtcattgtagctaagtctcctgatgctgcaaagagggcccagtcctatgcggagagactgcgtctgggtttggccgtcattcacggggaagctcagtgcacggaactggacatggacgatggtcgtcactccccgcctatggtcaaaaatgctactgtgcacccaggcctggagttgccattgatgatggccaaagagaagccaccgataactgtagttggagatgttggaggccgcatcgcaatcatcgtggatgacattattgacgatgtggagagttttgttgctgccgcggagatcctgaaagagagaggcgcctataagatctatgttatggccacccacggcatcctgtctgcagaggcccctcgcctgattgaggagtcctccgtagacgaggtcaggctgcttctaaatcttgagccaagatttactgctgtgttttctgggaataataaaatgattcagtcaatactaaaaag

SEQ ID NO: 62402 - DNA, 677 bp, Homo sapiens
ctatcagctcgcaccctgccatttactccatggcctaccttttccgaaacatcactgtggatgactagctttcacgagggtctcgaccctggacctcctgagggaaacatggaaaaagcagtgccatgagtgatacagtgtttccttgcaagggaggactcgaaacagcctggagttagatatcttcttttgcccggattgatggggaggagggattaaaagagtcaggaagaagacagagctaatggataaatatcataacatggccttacatgtctgctgtcatcagccctgttccttaaaagttctagctgctttcttaaaaataatctgaaaatcttattgatactaaagaggagttaaaggcacataaagtcttaactctataatgttcatttagttgtttcagctccagggaaatggaggtattgatgttgaacctggttagggaagctgagcgcctgtggccctattactatccagttggcctctcccaaatcaacttcaagtcttttatagagaatcgtatttttctttcagaaattgttatgcctacagccattgaaaaatgaagcattcatgttgttacatcttccaaggatgtcagattagaaaatagcatcccacctctgggtatctgagtggctctgaagttgcaaataaaataatttgttgtc

SEQ ID NO: 62403 - DNA, 398 bp, Homo sapiens
agggggcggtggccttgcctctggctctgaggcggcggcgccgggcgctgcgaaggctcggccgctgtagtcagtggtgtggggtgcgcaagggcacggacctcggagctctccccgcttgcgccgagtttctcagcgccttccccacccaaaccggggtctcgcagtcggaagcactcagagtgcagccccgcgcggggccggtcgtaaccgcgccgcgggccggacgatgcccaagaagctgctgctgttgacgatgcccataaaagacctagggtttaaggaattgcgctgacaccagtgtcacattccaggtatacaaatggctaaaccgaaggtcccgagagtgctaatggctcattttaggttcgctgcggactgggggtagtgaatgtaac

SEQ ID NO: 62404 - DNA, 710 bp, Homo sapiens
tacttcccctacagcaagcagagcaagatgaggaagaggggttccattgtgtgcaagctgctagcatccatgctggcgaaagcaggtgagtgtgcgcgggggccctggggttccagcatgatcctttagggctctttcctagttggacttagctcatacctcagatatccaatctgggatctgagtgtttgtttccttttgaacagttttggctaaggatatgtgagctcggttagaaattcttttttttcccttattcgctttgtcctactttagaataccattgctttagtgtcttctcttctctgtcatctgtcacatattttctatttcatcttgtcatcgctaaattcttagctggcagtcttggcattcttatgtgatcttttgatcttcaggtctagatttctatatctgctttgttagctaaattccatttttgttcatagtattcaagctggattttcttttactccctctcccccacccttgcctttctacatagtggctcattttcattgctttattctccttgtgtggcgggggcacgctttctggcctgtaaatcaatgtaatattttacaattgggtttctattcatctgatgtctgttctaaaactttaacgtatatttgggtcctcggaaagaaatgtatggtcctccctcaatgtccttataggattggttccaggaacccatctcccgcttc

SEQ ID NO: 62405 - DNA, 1996 bp, Homo sapiens
agggggcggtggccttgcctctggctctgaggcggcggcgccgggcgctgcgaaggctcggccgctgtagtcagtggtgtggggtgcgcaagggcacggacctcggagctctccccgcttgcgccgagtttctcagcgccttccccacccaaaccggggtctcgcagtcggaagcactcagagtgcagccccgcgcggggccggtcgtaaccgcgccgcgggccggacgatgcccaagaagctgctgctgttgcccccgccctccgcgtcctcggctttccgcgtcccgcgcgcccgccccgttcccccgccggccatgaacgccgctcgcaccggctaccgagtcttctcggccaactccacggccgcctgcacggagctggccaagcgcatcacagagcgccttggtgctgaattggggaagtctgttgtatatcaagagaccaatggagaaacaagagttgaaataaaagaatctgttcgtggccaagatattttcattatacagacaatacccagagatgtgaatacagctgtgatggagttgctcatcatggcttacgcactgaagactgcctgtgccaggaacattattggggtcatcccctacttcccctacagcaagcagagcaagatgaggaagaggggttccattgtgtgcaagctgctagcatccatgctggcgaaagcaggtttaactcacattatcactatggatcttcatcaaaaggaaatacaaggctttttcagctttcctgtggacaaccttagagcctcacctttcctgcttcagtatatccaggaagaaattccaaattacagaaatgcagtcattgtagctaagtctcctgatgctgcaaagagggcccagtcctatgcggagagactgcgtctgggtttggccgtcattcacggggaagctcagtgcacggaactggacatggacgatggtcgtcactccccgcctatggtcaaaaatgctactgtgcacccaggcctggagttgccattgatgatggccaaagagaagccaccgataactgtagttggagatgttggaggccgcatcgcaatcatcgtggatgacattattgacgatgtggagagttttgttgctgccgcggagatcctgaaagagagaggcgcctataagatctatgttatggccacccacggcatcctgtctgcagaggcccctcgcctgattgaggagtcctccgtagacgaggtggtggtgacgaatactgtccctcatgaggttcagaagctgcaatgtcccaagataaagactgtggatatcagtttgattctttctgaagccattcggagaatccacaatggagagtccatggcctaccttttccgaaacatcactgtggatgactagctttcacgagggtctcgaccctggacctcctgagggaaacatggaaaaagcagtgccatgagtgatacagtgtttccttgcaagggaggactcgaaacagcctggagttagatatcttcttttgcccggattgatggggaggagggattaaaagagtcaggaagaagacagagctaatggataaatatcataacatggccttacatgtctgctgtcatcagccctgttccttaaaagttctagctgctttcttaaaaataatctgaaaatcttattgatactaaagaggagttaaaggcacataaagtcttaactctataatgttcatttagttgtttcagctccagggaaatggaggtattgatgttgaacctggttagggaagctgagcgcctgtggccctattactatccagttggcctctcccaaatcaacttcaagtcttttatagagaatcgtatttttctttcagaaattgttatgcctacagccattgaaaaatgaagcattcatgttgttacatcttccaaggatgtcagattagaaaatagcatcccacctctgggtatctgagtggctctgaagttgcaaataaaataatttgttgtc

SEQ ID NO: 62406 - DNA, 2195 bp, Homo sapiens
agggggcggtggccttgcctctggctctgaggcggcggcgccgggcgctgcgaaggctcggccgctgtagtcagtggtgtggggtgcgcaagggcacggacctcggagctctccccgcttgcgccgagtttctcagcgccttccccacccaaaccggggtctcgcagtcggaagcactcagagtgcagccccgcgcggggccggtcgtaaccgcgccgcgggccggacgatgcccaagaagctgctgctgttgcccccgccctccgcgtcctcggctttccgcgtcccgcgcgcccgccccgttcccccgccggccatgaacgccgctcgcaccggctaccgagtcttctcggccaactccacggccgcctgcacggagctggccaagcgcatcacagagcgccttggtgctgaattggggaagtctgttgtatatcaagagaccaatggagaaacaagagttgaaataaaagaatctgttcgtggccaagatattttcattatacagacaatacccagagatgtgaatacagctgtgatggagttgctcatcatggcttacgcactgaagactgcctgtgccaggaacattattggggtcatcccctacttcccctacagcaagcagagcaagatgaggaagaggggttccattgtgtgcaagctgctagcatccatgctggcgaaagcaggtttaactcacattatcactatggatcttcatcaaaaggaaatacaaggctttttcagctttcctgtggacaaccttagagcctcacctttcctgcttcagtatatccaggaagaaattccaaattacagaaatgcagtcattgtagctaagtctcctgatgctgcaaagagggcccagtcctatgcggagagactgcgtctgggtttggccgtcattcacggggaagctcagtgcacggaactggacatggacgatggtcgtcactccccgcctatggtcaaaaatgctactgtgcacccaggcctggagttgccattgatgatggccaaagagaagccaccgataactgtagttggagatgttggaggccgcatcgcaatcatcgtggatgacattattgacgatgtggagagttttgttgctgccgcggagatcctgaaagagagaggcgcctataagatctatgttatggccacccacggcatcctgtctgcagaggcccctcgcctgattgaggagtcctccgtagacgaggtggtggtgacgaatactgtccctcatgaggttcagaagctgcaatgtcccaagataaagactgtggatatcagtttgattctttctgaagccattcggagaatccacaatggagagtccatggcctaccttttccgaaacatcactgtggatgactagctttcacgagggtctcgaccctggacctcctgagggaaacatggaaaaagcagtgccatgagtgatacagtgtttccttgcaagggaggactcgaaacagcctggagttagatatcttcttttgcccggattgatggggaggagggattaaaagagtcaggaagaagacagagctaatggataaatatcataacatggccttacatgtctgctgtcatcagccctgttccttaaaagttctagctgctttcttaaaaataatctgaaaatcttattgatactaaagaggagttaaaggcacataaagtcttaactctataatgttcatttagttgtttcagctccagggaaatggaggtattgatgttgaacctggttagggaagctgagcgcctgtggccctattactatccagttggcctctcccaaatcaacttcaagtcttttatagagaatcgtatttttctttcagaaattgttatgcctacagccattgaaaaatgaagcattcatgttgttacatcttccaaggatgtcagattagaaaatagcatcccacctctgggtatctgagtggctctgaagttgcaaataaaataatttgttgtcaaaaaaaaaaaaaaaaaaaaaaataaaaaattaaaaggaaaataaatccccgccggatccgaccgccactttcaaaaccccccaccgttctagaaccgggggagcttccgtccctgagtagaattcgagggggtaaagaagaggaaggggaaaaatattttgtaccagcccaggggggaaaaagcccccggcttgaaaa

SEQ ID NO: 62407 - DNA, 2577 bp, Homo sapiens
agggggcggtggccttgcctctggctctgaggcggcggcgccgggcgctgcgaaggctcggccgctgtagtcagtggtgtggggtgcgcaagggcacggacctcggagctctccccgcttgcgccgagtttctcagcgccttccccacccaaaccggggtctcgcagtcggaagcactcagagtgcagccccgcgcggggccggtcgtaaccgcgccgcgggccggacgatgcccaagaagctgctgctgttgcccccgccctccgcgtcctcggctttccgcgtcccgcgcgcccgccccgttcccccgccggccatgaacgccgctcgcaccggctaccgagtcttctcggccaactccacggccgcctgcacggagctggccaagcgcatcacagagcgccttggtgctgaattggggaagtctgttgtatatcaagagaccaatggagaaacaagagttgaaataaaagaatctgttcgtggccaagatattttcattatacagacaatacccagagatgtgaatacagctgtgatggagttgctcatcatggcttacgcactgaagactgcctgtgccaggaacattattggggtcatcccctacttcccctacagcaagcagagcaagatgaggaagaggggttccattgtgtgcaagctgctagcatccatgctggcgaaagcaggtttaactcacattatcactatggatcttcatcaaaaggaaatacaaggctttttcagctttcctgtggacaaccttagagcctcacctttcctgcttcagtatatccaggaagaaattccaaattacagaaatgcagtcattgtagctaagtctcctgatgctgcaaagaggtaagtaagctagacatgggtcctgatccctcctgagtgctcccgaagtcagaatgagctgctttggaatccagaggctgtcactcgtggcctttgaaagcccactggctctcatgttaacccctccatcgttgtcatgtcccatgccacacacagctttatctccagcctccagacagcacacatgatcgctgagttgctcagctttcctctgggaaaacaaagttccttcaagttctcagagaaaggaaagcaatgaggctatgagcatttttcaagcaatggtttttttttttgttttttttttgaaatggagtttcattccagcctgggtgacagtgagaccttgtctcaaaaaaaaaaaaaaaatgtctagaatcagatacaatcccaaaccctaactcacgtgccctttgagtcatttacatgctggcctgggcctcacattctcatttatataaataatgcctttgtatgtccctgaaacgttaaatattttcattttatggttaaaaaatgatgccgtagtgatgcgtgggatttcttcctgtcagtttcaccatttccctttgtccttctagggcccagtcctatgcggagagactgcgtctgggtttggccgtcattcacggggaagctcagtgcacggaactggacatggacgatggtcgtcactccccgcctatggtcaaaaatgctactgtgcacccaggcctggagttgccattgatgatggccaaagagaagccaccgataactgtagttggagatgttggaggccgcatcgcaatcatcgtggatgacattattgacgatgtggagagttttgttgctgccgcggagatcctgaaagagagaggcgcctataagatctatgttatggccacccacggcatcctgtctgcagaggcccctcgcctgattgaggagtcctccgtagacgaggtggtggtgacgaatactgtccctcatgaggttcagaagctgcaatgtcccaagataaagactgtggatatcagtttgattctttctgaagccattcggagaatccacaatggagagtccatggcctaccttttccgaaacatcactgtggatgactagctttcacgagggtctcgaccctggacctcctgagggaaacatggaaaaagcagtgccatgagtgatacagtgtttccttgcaagggaggactcgaaacagcctggagttagatatcttcttttgcccggattgatggggaggagggattaaaagagtcaggaagaagacagagctaatggataaatatcataacatggccttacatgtctgctgtcatcagccctgttccttaaaagttctagctgctttcttaaaaataatctgaaaatcttattgatactaaagaggagttaaaggcacataaagtcttaactctataatgttcatttagttgtttcagctccagggaaatggaggtattgatgttgaacctggttagggaagctgagcgcctgtggccctattactatccagttggcctctcccaaatcaacttcaagtcttttatagagaatcgtatttttctttcagaaattgttatgcctacagccattgaaaaatgaagcattcatgttgttacatcttccaaggatgtcagattagaaaatagcatcccacctctgggtatctgagtggctctgaagttgcaaataaaataatttgttgtc

SEQ ID NO: 62408 - DNA, 1942 bp, Homo sapiens
agggggcggtggccttgcctctggctctgaggcggcggcgccgggcgctgcgaaggctcggccgctgtagtcagtggtgtggggtgcgcaagggcacggacctcggagctctccccgcttgcgccgagtttctcagcgccttccccacccaaaccggggtctcgcagtcggaagcactcagagtgcagccccgcgcggggccggtcgtaaccgcgccgcgggccggacgatgcccaagaagctgctgctgttgcccccgccctccgcgtcctcggctttccgcgtcccgcgcgcccgccccgttcccccgccggccatgaacgccgctcgcaccggctaccgagtcttctcggccaactccacggccgcctgcacggagctggccaagcgcatcacagagcgccttggtgctgaattggggaagtctgttgtatatcaagagaccaatggagaaacaagagttgaaataaaagaatctgttcgtggccaagatattttcattatacagacaatacccagagatgtgaatacagctgtgatggagttgctcatcatggcttacgcactgaagactgcctgtgccaggaacattattggggtcatcccctacttcccctacagcaagcagagcaagatgaggaagaggggttccattgtgtgcaagctgctagcatccatgctggcgaaagcaggtttaactcacattatcactatggatcttcatcctttcctgcttcagtatatccaggaagaaattccaaattacagaaatgcagtcattgtagctaagtctcctgatgctgcaaagagggcccagtcctatgcggagagactgcgtctgggtttggccgtcattcacggggaagctcagtgcacggaactggacatggacgatggtcgtcactccccgcctatggtcaaaaatgctactgtgcacccaggcctggagttgccattgatgatggccaaagagaagccaccgataactgtagttggagatgttggaggccgcatcgcaatcatcgtggatgacattattgacgatgtggagagttttgttgctgccgcggagatcctgaaagagagaggcgcctataagatctatgttatggccacccacggcatcctgtctgcagaggcccctcgcctgattgaggagtcctccgtagacgaggtggtggtgacgaatactgtccctcatgaggttcagaagctgcaatgtcccaagataaagactgtggatatcagtttgattctttctgaagccattcggagaatccacaatggagagtccatggcctaccttttccgaaacatcactgtggatgactagctttcacgagggtctcgaccctggacctcctgagggaaacatggaaaaagcagtgccatgagtgatacagtgtttccttgcaagggaggactcgaaacagcctggagttagatatcttcttttgcccggattgatggggaggagggattaaaagagtcaggaagaagacagagctaatggataaatatcataacatggccttacatgtctgctgtcatcagccctgttccttaaaagttctagctgctttcttaaaaataatctgaaaatcttattgatactaaagaggagttaaaggcacataaagtcttaactctataatgttcatttagttgtttcagctccagggaaatggaggtattgatgttgaacctggttagggaagctgagcgcctgtggccctattactatccagttggcctctcccaaatcaacttcaagtcttttatagagaatcgtatttttctttcagaaattgttatgcctacagccattgaaaaatgaagcattcatgttgttacatcttccaaggatgtcagattagaaaatagcatcccacctctgggtatctgagtggctctgaagttgcaaataaaataatttgttgtc

SEQ ID NO: 62409 - DNA, 2142 bp, Homo sapiens
agggggcggtggccttgcctctggctctgaggcggcggcgccgggcgctgcgaaggctcggccgctgtagtcagtggtgtggggtgcgcaagggcacggacctcggagctctccccgcttgcgccgagtttctcagcgccttccccacccaaaccggggtctcgcagtcggaagcactcagagtgcagccccgcgcggggccggtcgtaaccgcgccgcgggccggacgatgcccaagaagctgctgctgttgcccccgccctccgcgtcctcggctttccgcgtcccgcgcgcccgccccgttcccccgccggccatgaacgccgctcgcaccggctaccgagtcttctcggccaactccacggccgcctgcacggagctggccaagcgcatcacagagcgccttggtgctgaattggggaagtctgttgtatatcaagagaccaatggagaaacaagagttgaaataaaagaatctgttcgtggccaagatattttcattatacagacaatacccagagatgtgaatacagctgtgatggagttgctcatcatggcttacgcactgaagactgcctgtgccaggaacattattggggtcatcccctacttcccctacagcaagcagagcaagatgaggaagaggggttccattgtgtgcaagctgctagcatccatgctggcgaaagcaggtttaactcacattatcactatggatcttcatcaaaaggaaatacaaggctttttcagctttcctgtggacaaccttagagcctcacctttcctgcttcagtatatccaggaagaaattccaaattacagaaatgcagtcattgtagctaagtctcctgatgctgcaaagagggcccagtcctatgcggagagactgcgtctgggtttggccgtcattcacggggaagctcagtgcacggaactggacatggacgatggtcgtcactccccgcctatggtcaaaaatgctactgtgcacccaggcctggagttgccattgatgatggccaaagagaagccaccgataactgtagttggagatgttggaggccgcatcgcaatcatcgtggatgacattattgacgatgtggagagttttgttgctgccgcggagatcctgaaagagagaggcgcctataagatctatgttatggccacccacggcatcctgtctgcagaggcccctcgcctgattgaggagtcctccgtagacgaggtggtggtgacgaatactgtccctcatgaggttcagaagctgcaatgtcccaagataaagactgtggatatcagtttgattctttctgaagccattcggagaatccacaatggagagtccatggcctaccttttccgaaacatcactgtggatgactagctttcacgagggtctcgaccctggacctcctgagggaaacatggaaaaagcagtgccatgagtgatacagtgtttccttgcaagggaggactcgaaacagcctggagttagatatcttcttttgcccggattgatggggaggagggattaaaagagtcaggaagaagacagagctaatggataaatatcataacatggccttacatgtctgctgtcatcagccctgttccttaaaagttctagctgctttcttaaaaataatctgaaaatcttattgatactaaagaggagttaaaggcacataaagtcttaactctataatgttcatttagttgtttcagctccagggaaatggaggtattgatgttgaacctggttagggaagctgagcgcctgtggccctattactatccagttggcctctcccaaatcaacttcaagtcttttatagagaatcgtatttttctttcagaaattgttatgcctacagccattgaaaaatgaagcattcatgttgttacatcttccaaggatgtcagattagaaaatagcatcccacctctgggtatctgagtggctctgaagttgcaaataaaataatttgttgtcttgctagtcttttcattagacagcagaagaccatggatacagaacagcagtcaggtctgtggctggacacaaacactttcccaggttccaccctcttcctaagtgttgaagctaaatccttgttgaatactgtattttaaatcttt

SEQ ID NO: 62410 - DNA, 1479 bp, Homo sapiens
gttttgggtaacagatggaaaggcgtgggaggatcacctgagcctcaggaggttgaggctgcagtgagccatgttgacgccactgcactccagcctgggtgacagtgagaccttgtctcaaaaaaaaaaaaaaaatgtctagaatcagatacaatcccaaaccctaactcacgtgccctttgagtcatttacatgctggcctgggcctcacattctcatttatataaataatgcctttgtatgtccctgaaacgttaaatattttcattttatggttaaaaaatgatgccgtagtgatgcgtgggatttcttcctgtcagtttcaccatttccctttgtccttctagggcccagtcctatgcggagagactgcgtctgggtttggccgtcattcacggggaagctcagtgcacggaactggacatggacgatggtcgtcactccccgcctatggtcaaaaatgctactgtgcacccaggcctggagttgccattgatgatggccaaagagaagccaccgataactgtagttggagatgttggaggccgcatcgcaatcatcgtggatgacattattgacgatgtggagagttttgttgctgccgcggagatcctgaaagagagaggcgcctataagatctatgttatggccacccacggcatcctgtctgcagaggcccctcgcctgattgaggagtcctccgtagacgaggtggtggtgacgaatactgtccctcatgaggttcagaagctgcaatgtcccaagataaagactgtggatatcagtttgattctttctgaagccattcggagaatccacaatggagagtccatggcctaccttttccgaaacatcactgtggatgactagctttcacgagggtctcgaccctggacctcctgagggaaacatggaaaaagcagtgccatgagtgatacagtgtttccttgcaagggaggactcgaaacagcctggagttagatatcttcttttgcccggattgatggggaggagggattaaaagagtcaggaagaagacagagctaatggataaatatcataacatggccttacatgtctgctgtcatcagccctgttccttaaaagttctagctgctttcttaaaaataatctgaaaatcttattgatactaaagaggagttaaaggcacataaagtcttaactctataatgttcatttagttgtttcagctccagggaaatggaggtattgatgttgaacctggttagggaagctgagcgcctgtggccctattactatccagttggcctctcccaaatcaacttcaagtcttttatagagaatcgtatttttctttcagaaattgttatgcctacagccattgaaaaatgaagcattcatgttgttacatcttccaaggatgtcagattagaaaatagcatcccacctctgggtatctgagtggctctgaagttgcaaataaaataatttgttgtc

SEQ ID NO: 62411 - DNA, 1866 bp, Homo sapiens
agggggcggtggccttgcctctggctctgaggcggcggcgccgggcgctgcgaaggctcggccgctgtagtcagtggtgtggggtgcgcaagggcacggacctcggagctctccccgcttgcgccgagtttctcagcgccttccccacccaaaccggggtctcgcagtcggaagcactcagagtgcagccccgcgcggggccggtcgtaaccgcgccgcgggccggacgatgcccaagaagctgctgctgttgcccccgccctccgcgtcctcggctttccgcgtcccgcgcgcccgccccgttcccccgccggccatgaacgccgctcgcaccggctaccgagtcttctcggccaactccacggccgcctgcacggagctggccaagcgcatcacagagcgccttggtgctgaattggggaagtctgttgtatatcaagagaccaatggagaaacaagagttgaaataaaagaatctgttcgtggccaagatattttcattatacagacaatacccagagatgtgaatacagctgtgatggagttgctcatcatggcttacgcactgaagactgcctgtgccaggaacattattggggtcatcccctacttcccctacagcaagcagagcaagatgaggaagaggggttccattgtgtgcaagctgctagcatccatgctggcgaaagcaggtttaactcacattatcactatggatcttcatcaaaaggaaatacaaggctttttcagctttcctgtggacaaccttagagcctcacctttcctgcttcagtatatccaggaagaaattccaaattacagaaatgcagtcattgtagctaagtctcctgatgctgcaaagagggcccagtcctatgcggagagactgcgtctgggtttggccgtcattcacggggaagctcagtgcacggaactggacatggacgatggtcgtcactccccgcctatggtcaaaaatgctactgtgcacccaggcctggagttgccattgatgatggccaaagagaagccaccgataactgtagttggagatgttggaggccgcatcgcaatcatcgtggatgacattattgacgatgtggagagttttgttgctgccgcggagatcctgaaagagagaggcgcctataagatctatgttatggccacccacggcatcctgtctgcagaggcccctcgcctgattgaggagtcctccgtagacgaggtggtggtgacgaatactgtccctcatgaggttcagaagctgcaatgtcccaagataaagactgtggatatcagtttgattctttctgaagccattcggagaatccacaatggagagtccatggcctaccttttccgaaacatcactgtggatgactagctttcacgagggtctcgaccctggacctcctgagggaaacatggaaaaagcagtgccatgagtgatacagtgtttccttgcaagggaggactcgaaacagcctggagttagatatcttcttttgcccggattgatggggaggagggattaaaagagtcaggaagaagacagagctaatggataaatatcataacatggccttacatgtctgctgtcatcagccctgttccttaaaagttctagctgctttcttaaaaataatctgaaaatcttattgatactaaagaggagttaaaggcacataaagtcttaactctataatgttcatttagttgtttcagctccagggaaatggaggtattgatgttgaacctggttaggacaagcatgtgtgcttttaggcaaaccacaagtagtaaaagaatcccacctctgattcaagtgtcatattcatgtttgaaaatataaagcatacattg

SEQ ID NO: 62412 - DNA, 2115 bp, Homo sapiens
agggggcggtggccttgcctctggctctgaggcggcggcgccgggcgctgcgaaggctcggccgctgtagtcagtggtgtggggtgcgcaagggcacggacctcggagctctccccgcttgcgccgagtttctcagcgccttccccacccaaaccggggtctcgcagtcggaagcactcagagtgcagccccgcgcggggccggtcgtaaccgcgccgcgggccggacgatgcccaagaagctgctgctgttgcccccgccctccgcgtcctcggctttccgcgtcccgcgcgcccgccccgttcccccgccggccatgaacgccgctcgcaccggctaccgagtcttctcggccaactccacggccgcctgcacggagctggccaagcgcatcacagagcgccttggtgctgaattggggaagtctgttgtatatcaagagaccaatggagaaacaagagttgaaataaaagaatctgttcgtggccaagatattttcattatacagacaatacccagagatgtgaatacagctgtgatggagttgctcatcatggcttacgcactgaagactgcctgtgccaggaacattattggggtcatcccctacttcccctacagcaagcagagcaagatgaggaagaggggttccattgtgtgcaagctgctagcatccatgctggcgaaagcaggtttaactcacattatcactatggatcttcatcaaaaggaaatacaaggctttttcagctttcctgtggacaaccttagagcctcacctttcctgcttcagtatatccaggaagaaattccaaattacagaaatgcagtcattgtagctaagtctcctgatgctgcaaagagggcccagtcctatgcggagagactgcgtctgggtttggccgtcattcacggggaagctcagtgcacggaactggacatggacgatggtcgtcactccccgcctatggtcaaaaatgctactgtgcacccaggcctggagttgccattgatgatggccaaagagaagccaccgataactgtagttggagatgttggaggccgcatcgcaatcatcgtggtatggttatatgtcatccatgtgcagaggtggcactcctggctcttggtcagtaggttgtccactctgggactgtatttctaggaacgatgatccgaatggatccatgtatcctttctcacccaaactcccttgtgccaagtggcagaaacctgtatccaggtgaacatacattaaagtataacctacagataggaaatgagcacagtactcccgtgagaaaattcagcaccttcaccttcatcatgtggattctaggttctttaaaccagctcacctaatcatgcttgagcgttagggccgaaagatgaactgaagatgagctgttccgttttcacaagtaagaatgggtgtccccgtgcagactcgttctgcatgttgacatactttttttcccagctctaaatatctgctggctagtgggtcatgagtcctttgcagtagcacactttatttcagttttcttctcatgtcacagtctatttgaaaaaaaaataaatggaacgctggctatgtgggattcaccagaaacgtgagacaggaaaatgagtgttggcaatcctcagctccagccgtaatgtcacaggtgcttgactgcgcccgcctctgacagacacacaaggtactgtcaggtgcttctgttgccatttctggatgctcgttctttgacccaggcacacagctctgattttccatcagaaatcctctgaaactgagtgcagaagagagtagagtggtgtgtgcattgacagtatgggctagagggtgtttctttcctaccaactcactctgttctcctcccaggatgacattattgacgatgtggagagttttgttgctgccgcggagatcctgaaagagagaggcgcctataagatctatgttatggccacccacggcatcctgtctgcagaggcccctcgcctgattgaggagtcctccgtagacgaggtcaggctgcttctaaatcttgagccaagatttactgctgtgttttctgggaataataaaatgattcagtcaatactaaaaag

SEQ ID NO: 62413 - DNA, 831 bp, Homo sapiens
aaatccggtgacctgagaggatgttgttacatgaacatcttagtaggtgaaatggaaaagagtcaggggagaaagtgagtcatcacagaattcatcaacctccaaggagcttgtgccttctcatcagcaacacattcaccttggaactggggactgagtttcaataaaccaccatctgtctgccaggtcactaatttcagtttttattgtctataagagtttcgtttgtatgtaaaatcaatgatataataaaatatacatatatatccagtctttgtccctagttcctggagcagagcttcaaaaacctgtggaatttcctgaacgttaggagtgtcttttgttaacaagcctcttttaggggccacatatgagtttatgcttgtgaggtgatggggcagggtgtggatagcttcaggatgagggctggtccctagaaaaactaaccacatgatcagacggttggaacttccagctcccccatttgacctctatccaaggaggggagtgggctggagactgagttcaatcctgcagccagtaatttaatcaatcacacatacataatgaaacccaatacaaactgtgaacaccaagggttggggagtccccaaattcatgaacagatgaatgtacagagagggtggtacacctgactccccagggacagaagctcctgcacttgggaccctttcagaccttgtcctgtgcacctcttcaatggctgtccatcaattcctttataataaaatggtaatcataagccataacactttcctgagttctgtgagtcattttagcaaattatcaaacctaaagggaggtcatggg

SEQ ID NO: 62414 - DNA, 290 bp, Homo sapiens
tgaaaaccacctcaaggacacaacaagccatagagggtttctacaacttgtgtttttccagggtatgccctcaagctctggtccaataaacctcaattgattcagacacaaacctcaactgattcagacacttgaatcaggcactcaatttggttaacattttgccaaccatgaagggggtcctcttaatggagtttagaacctttgacctgcagtgcttcttttgttcatgctcagtaccaactatagagctttagttgtgaccagtcatgtgactttctgagaattgg

SEQ ID NO: 62415 - DNA, 458 bp, Homo sapiens
gtttaccttatgttatcagttcctaatatgtgacgtatgggccacagatgctggtgtattatttcacatgcatttatatagattgttttcagggaattcagaaattctgttatctctacactagtgattgtgctttcttgatttttctcttttcattattcttaaatcctccctttttttaatttgcatctcagttcgtttatactcgggaagtgcaagacatggctactagaaagagatgtcaagagaaccggaatccagtaggctacaatttggcaaatcttagcttaaaacttcctaaatgttgaccacagtggatgcaaatggctctgtgcatcgtctgttcaatatggtcaggtgaccacccaggttcacgtggtttgtcaccagggtgacacgagccacacggagtgccctcctcagaggccatgtctcagagacgtttattttgagtggtt

SEQ ID NO: 62416 - DNA, 301 bp, Homo sapiens
gaaaatgaactttgtttgaaaagttagtatgggttagaaatgggaagaaaatctaaaatgtaagagtaaaagcaaggccttcatggcattctcttttaatatgggcttttctgtgttagttaacatctgataatatgaccccccaatctattaatatttattatactcataaaattacagaaaaaacctaagaaagggtatgtattgaagtggaatgaataaatgcaaaaaatgtagtacttataacattttgaagaaaatctttaaaaatttttgtttacacagaaaataatcttagaaa

SEQ ID NO: 62417 - DNA, 271 bp, Homo sapiens
gagccagcataccactgtgtgtataattaatttaaattcaaattaacaaattcaatgcatttatgtattcaagaaacaaatattcatttagtatctacaacgcagaatggttgctgccctcttggaacagggtcccagcagaaaacagaaagcattctgtatgctttctgtttccttaagaaacagaaggaaaattcaatgaagggactatttacaaaggtgtaaacaagtttaaggaaatacaaagagatgctgacacgtctgtgaatat

SEQ ID NO: 62418 - DNA, 275 bp, Homo sapiens
acttttatggctgctttcacttggctccatgttctgctgataattaaacagtttgtgtgtcctgtctttcctcaaaggaacttgtcaacctttggaattttgttcatctcagagggacgtcttaagtactcagctttctgaatgtttaagaaaaaaataatacttttcagaattacctacctctttctcatttttagcctgggatcaatattcccttcacactttttacatccgaagtagaaataaaactcttatctattttttttcagtattgg

SEQ ID NO: 62419 - DNA, 540 bp, Homo sapiens
caaaatttcctgtatcctttcatgggttttcttttgtttgttttggtaagaacatttaacatgagatgtatcttttagttgttgttgtggttgaacttttttagatacatagtctcactctgttacccaggctggagtgcagtggcatgatcacagctcactgcagcctcaaactcctggacccaaatgatcctcccacctcagcctcccaagtagctaggactacagatgtgcactaccatgcctaacttcttaacatattttaaggtgcacaatatcctattgttaaatagttactatgttgtacagcagatctctagaatgtattcatcttgcataacaaactttatacccattgaaaaacaattccttgtagaaatccatttttaaagtgtctttttcaatcctaaacttgctccttttaatgtgagaacaaagcattcagattgatattttctttcattaagaccaaactctccccaaaagcttaatccttgaattgtaatctaaaggtcaaataaattagtttctggtataaac

SEQ ID NO: 62420 - DNA, 356 bp, Homo sapiens
aatgagtgaggcaagacagccctgaggatggggaaggacatgatggacggagaagtcagcccagggcaggggcacagtggctcagcttctgaaaccaaagaatggaaaagagggtctctttcccatggatgaggggcccagcaccatggccagggccacagccacctcgtgccacacagcagccaaaccaggcccccccaccatcacatatccccttccaccaaggtgtccagccagcaccgatgcaaaggagctggtcccaggcctttcccagacccaccgtggtcctgccggcctcccacaggcggcctgtgagcgccaacaaggagatgttctcgttcgtggtggacgacgcc

SEQ ID NO: 62421 - DNA, 907 bp, Homo sapiens
tagactaggtactttatactatacatatattccacttactacatataataattctataaactagaccttgatatggtcattttatagataaaagactgagactctgaaagcgtaaacaatatgctcaaggttgctaagggtttcagacagatttgaaattcaagcccaggtctatctgactccaaaacctgcatacctgagcccagaaacaaacgctaatataatatttagcttactgaaaatgaagcataaaaaatcagtacagaaaagaatattcaattaatggtattgggacaactagctgtcatatctcagggtgggaaacaatcttctaaacacaaaaacaattagagacaccaagagaaaaagaaaaaccaaatattataaaaaatattcaaattctggaaaaaagcaattaatattaaaaagcaaaataacaatcagaaaaacatgtaaaaaattgaaatgaaaagctgatgtgttcaaacaaagagatcataaattcaatatgaaaaaagcaacaaccacaaaaaagggcaaaggacattaatcaaataaaatatacatgggctgggcacggtggctcatgcctgtaatcccagcatttcagaggccgaagagggtggatcacttgaggtcaggagtttgaggccagcctggccaacatggtgaaaccccctgtctctactaaaaatataaaaatgatctgggcgtggtggcacacacctgtagtccccgctcctcaggaagctgaggcaggagaatcgcttgaacccgggaggtagaggttgcagtgagccaagactgcgccactgcactccagcctgggcaacagagcaacacttcatctcaaaaaaattataataataaaataaataaataaaaataaaatgatatatgtattaga

SEQ ID NO: 62422 - DNA, 617 bp, Homo sapiens
tgtctgaaaaagtaatccatggtaaggtaaaatgactaatgaaggtaaataaagtctagggatatttcatttgcagtgctattgttctttgctaattcaaatgaatctctaatatagttcacagaatgataaaacaattgcattataaggttcatctaaagaatgctgttgcttccccagggtgaatgtagtaggtggctggacccggctcataatggcttgggaaagagggctgtgtgtagctcttccaagtccagttcagtgatgccacgcgatagcttaaaatagcccgtggtgggagaatttacaccatcaagattcagaaatgctaaaaatcgctgatttttttcctggacaattggttgataagcatttatcaggacatcactgattgaattaaataatagaatacatttttatattgttgggggagtattgtagtactggtgaagaatcagagtgtcataaaatcccaaagggaaatagctctcccacccatccaaaaacattttatttctacacaaaatttcattttaaaaaagaatcatactgccaaaaaaaatgtttaaaactactactttttaacatctctgaaaagtgattccctatccccattg

SEQ ID NO: 62423 - DNA, 255 bp, Homo sapiens
gaatgaagaactgattttatgtaaaatcagaaccagcaaagctctgcaacctgtgcaatatgcatgttttctaaaatagcctccatctccatgtgagtgagctcagcttcatagctcctcatttcttacaggacaggagctaaactaatatggcgcttagctctaggtctttccttttagcccctgtgtgtattaactttcagctgtgagtcccagctaaatgatacatgtcaatatgtagcaatcagaaaaggt

SEQ ID NO: 62424 - DNA, 206 bp, Homo sapiens
ggtggggaatgtaagagcactctttgtatttattatttctgacgactatgtgtggctacaattatctcaaagtaaaaagtgtttaagatataacaaacaaaaccacaggtcttccctaggcttagaaatacacctttctactggcatcacatctcaagacaactcaggacaatgtgattaagggctggctgcagtgcctcacgcct

SEQ ID NO: 62425 - DNA, 252 bp, Homo sapiens
cttattcaacattttttcaacagctgtagagtatcagatactgtgatatatactggtgatacataaatcaataagcctgcactagcaggactcagagtctggtggaaaaagataaatttatataaatatttataatgtaaataatgaattaaatactacctaaattgaaccatatgtaattataaatatcaaccattttttaccaaaaaatggcaatttgatatggtttaattaatatacttaatgtccttt

SEQ ID NO: 62426 - DNA, 383 bp, Homo sapiens
aaaaagattcccatcaaacattaaagaaaagcccagggctgcatggctttactgctcaattctatcaaccttataaagaagaactagcatcaattcatctcaaactattccaaaaaattaaagaagagagaattcttcctaacttattctacgaggccagcagtactctgatacaaaaccagacaagcacacaacaaaaaaagaacactacagaccaacatctctgagaaatacagacacaaaaatttttaacaaaacactagctaacaaaaatccaacaacacaacaaatatataatacaacatgatcaagtgggatttatcccagggatgcaaggatgggtcaatatatgcaaatcaattaacacgatacatcactttagt

SEQ ID NO: 62427 - DNA, 392 bp, Homo sapiens
ttaaacattgccaacaaatagcaaaaatgggccctgattctatagcaatgaaatgctctttttcttgcacaattttcagtttaatctcctgacttgactttctatttccagcttctctcctctgtctcttgtttctctcctgccacatccatcccactcactgttgtcagaaccttccatcactgtccctgtcacaaccacttttggtggctcccactgcctgtggcttaaggtctaatctccttagttcagccgtcaaggcccggaagagatgagtttcactcatcctacagccattgagcttgtaataaaatacttctttaagaaaactgcaagcagctgagcacccaaaaaattctggtgaggatcaccttatagttcagttaaaaaaa

SEQ ID NO: 62428 - DNA, 482 bp, Homo sapiens
gcgtaaaacatcaatttattggtgaataaatagaatggagcagagatttttgttcttgaggctcttgccctaattaccatcttgtgtaaaagctgttgtgatccacattctcctagaaattcaggatacttcagggtatcgtaaaaccaggacttgaaatgattgacaaaattaagaattcaaagacaggatacccctgatttgattatgtgaatgtatcaaattatcacatataacataaaaaatgtgtacagctattatggctgggctcagtggctcacacctgtaatccaaacactttgagaggccatggtgggaggatcacttgagcccaggagtttgaggctgcagcaagctgtgatcatgtcactgcactccagccttggcgatagtgccaaaccctatctcaaaaaacaaaacaaaaaaaccagaatggctaaaagataaattcaggagggtcgatggagcaagactctgtctca

SEQ ID NO: 62429 - DNA, 216 bp, Homo sapiens
ccagatgaatgaattgtcacagtggtgaggactgacttccaagggaccaccctcatttcttataagaattaagaaatataatcctagcaaagtctttttaaaatttgaggctaaagcaggtcttcagttttgtgtctttgtacctttcaaatcaatacttatttatagtacatgcaaaacagggcttgtgtgaattttttatgtggtcagaatatg

SEQ ID NO: 62430 - DNA, 195 bp, Homo sapiens
  misc_feature (1)..(1): n is a, c, g, or t
ncctcaataatcatgatttaaaacttacctaataaaagacaacttcagattcctaacgttcaagctctaagatatctggggagagggtgtccaatgttttgtgaacagctctttgagacaatgctgctggaaccatcctgaacaatgacaatggagaataatgtttttcctcttctccagcagcctgccccaagt

SEQ ID NO: 62431 - DNA, 308 bp, Homo sapiens
actatgtaaaaagtgccttttgccttccaccatgattgtgaggcctctccagatacgtcgaaccgtagaaattcagaaattcagtgtgtaaaatggtaaagcggattgaagttgaagatattagatcatttaagaagtcaataaatgaagtaataaacatgcgaatgagaagactgatgatgaagaggacctttaaaagtgtatttctgttacggttattttttttttaaagtgatttgaagccatttataatgattgctaagtggcatgctaaagttttaaaaacaaataaagcattaaaaaataag

SEQ ID NO: 62432 - DNA, 390 bp, Homo sapiens
cagggtaagactgaaaaaaggaaaagaaatgaagcaaaattgctagtaggcctttaaaaaaaaattcttttacagcacatataagtcatagtgctgacaaggaattttaaatagaggccaggtatctattttcctccttaaaagtaatccttgtctctgtaaatgcctcatttgttgagtgtactttttagatttaaataatctttagtacaatttttctcttgattgcagggtttgaagatgagaaattgagcaggtcgatgcaggtgtaacttagcagacagaccattatttccttgtataaactcatgccatcaactcttcaaccagaatgtggttgcagaggcattgaacagattttataattatgagtttatttcatggggtgta

SEQ ID NO: 62433 - DNA, 780 bp, Homo sapiens
gcgacaccatagaatggaagcttttaatcaatgtgaagagattggaaatatgaccatgaaaagacctgagatgacttggaaaaaaatactgttcaactcatgtaaattgctatacttatttttagcacaaattgttactttttcatggttgacatccttttttttttcttgttcaatctagaaggcaaaaacatgcacaaaaatataaggctgccttacctaggtccaaccaactcctcttgtcttgatcttccctgaggtctctgtagcctccttggagccctgcaaagtgcctcaaacaacagcttttcctcccattcagccaacactgatctctagatcagcacaaccattgctttccactctgcctaaggctggccacttttttcttttttccattacattctatgtgtcggaccgttctaaatacattttaggataaatggactctaatggaacaggaagcgtgcaaactcaacattagtaagaagggatatggataagagactggacccattcgaggcaatcagagagcatctcctggagaagatgcatttttcccataatcatttccttactgttctactttcttctctgtagagcatttcagcaggctcagccactccaatctagtgcatttaggaagacaccttacactggactcagctgtttaatctggatgccctcgcccatctgaagtcgggcgggggcggagggaatcttaacaacttctccataacataaatattgtatttgattaatcttgatgaaaagtttgtt

SEQ ID NO: 62434 - DNA, 417 bp, Homo sapiens
ccagtgtgatgaggctgggaaattcacgggcatggttcagaactctgcttctcagatccatttcataacaacttaatatgctcaagtattttctgaggggcaagactgtcctacagcatagattaagtggtccaatttttgcctctgggagaaggaaaaaaatatccaagtaggtagacaactattcaaaagaaacattgcatagatgcttagctttggcaatgttctgatgctaagcaggggtggagagggtggtgcagagctgcgctctgaagcctggggaagcaggctgggctgaaagctgggaagaacttagatcagatgcgatgctgcctaatcaaggttaagacttagcctgttaccagggagaagaagaaagagccagtgaatctgactacataattgctatttctttca

SEQ ID NO: 62435 - DNA, 1069 bp, Homo sapiens
gacacagcccgggtcgcaggcacctccccgccagctctcccgcttctcgcacagcttcccgacgcgtctgctgagccccatggcccacgccacgctctccgccgcccccagcaatccccggctcctgcgggtggcgctgctgctcctgctcctggtggccgccagccggcgcgcagcaggagcgtccgtggtcactgaactgcgctgccagtgcttgcagacactgcagggaattcacctcaagaacatccaaagtgtgaatgtaaggtcccccggaccccactgcgcccaaaccgaagtcatagccacactcaagaatgggaagaaagcttgtctcaaccccgcatcccccatggttcagaaaatcatcgaaaagatactgaacaaggggagcaccaactgacaggagagaagtaagaagcttatcagcgtatcattgacacttcctgcagggtggtccctgcccttaccagagctgaaaatgaaaaagagaacagcagctttctagggacagctggaaaggacttaatgtgtttgactatttcttacgagggttctacttatttatgtatttatttttgaaagcttgtattttaatattttacatgctgttatttaaagatgtgagtgtgtttcatcaaacatagctcagtcctgattatttaattggaatatgatgggttttaaatgtgtcattaaactaatatttagtgggagaccataatgtgtcagccaccttgataaatgacagggtggggaactggagggtggggggattgaaatgcaagcaattagtggatcactgttagggtaagggaatgtatgtacacatctattttttatactttttttttaaaaaaagaatgtcagttgttatttattcaaattatctcacattatgtgttcaacatttttatgctgaagtttcccttagacattttatgtcttgcttgtagggcataatgccttgtttaatgtccattctgcagcgtttctctttcccttggaaaagagaatttatcattactgttacatttgtacaaatgacatgataataaaagttttatga

SEQ ID NO: 62436 - DNA, 1885 bp, Homo sapiens
gacacagcccgggtcgcaggcacctccccgccagctctcccgcttctcgcacagcttcccgacgcgtctgctgagccccatggcccacgccacgctctccgccgcccccagcaatccccggctcctgcgggtggcgctgctgctcctgctcctggtggccgccagccggcgcgcagcaggagcgtccgtggtcactgaactgcgctgccagtgcttgcagacactgcagggaattcacctcaagaacatccaaagtgtgaatgtaaggtcccccggaccccactgcgcccaaaccgaagtcatagccacactcaagaatgggaagaaagcttgtctcaaccccgcatcccccatggttcagaaaatcatcgaaaagatactgaacaagtgagttgtaatttccatatacacaggcgactggagccgttggtcagaaatactggcatctgccccctaaaaataaaatcagggaaccccaagagttagctgaaggactagaaattgtgattattattttcacaattaaagttgccattaaggttattaatctgctctggtgccagaggatatttcagtatttcagtgtcttccatttccaggcctaacccctgggagggtaaatgtgggtttctagaatactaagtaaatttgactaacaatgccaaaatgccccctgcctgttttgggacgtttacctcagtccctaatgggcttcagacctgaaaaatgcaatgtctggtttgggcactttgggcctgtaagccttcttggtgaagagcagaaactttgcagtaacaccttcagtgagttcaaggctaggatccctgtcaacattatttaatctctttgagctttagcaaaatagggtagataatggtagttatttcatagggttgtgtgcagcttaagggagatcatgaatggacatttctaacccaatgtgacaatcagtgaccaatatgttttggctttttcaaaccaagaatctagttgagtccacagccacttctttcttgaaaaaaaaaaaaaaaagcattcaggagtgcaagttttctgctatagaaggcagtgggtacagacagaccttccctgagtggagggctgggagagagtctgcatggggacatccctccaagcaacttcagagtgacagaagagcagccttccttagcacctgcaacagtaacccttttctcatcacagggggagcaccaactgacaggagagaagtaagaagcttatcagcgtatcattgacacttcctgcagggtggtccctgcccttaccagagctgaaaatgaaaaagagaacagcagctttctagggacagctggaaaggacttaatgtgtttgactatttcttacgagggttctacttatttatgtatttatttttgaaagcttgtattttaatattttacatgctgttatttaaagatgtgagtgtgtttcatcaaacatagctcagtcctgattatttaattggaatatgatgggttttaaatgtgtcattaaactaatatttagtgggagaccataatgtgtcagccaccttgataaatgacagggtggggaactggagggtggggggattgaaatgcaagcaattagtggatcactgttagggtaagggaatgtatgtacacatctattttttatactttttttttaaaaaaagaatgtcagttgttatttattcaaattatctcacattatgtgttcaacatttttatgctgaagtttcccttagacattttatgtcttgcttgtagggcataatgccttgtttaatgtccattctgcagcgtttctctttcccttggaaaagagaatttatcattactgttacatttgtacaaatgacatgataataaaagttttatga

SEQ ID NO: 62437 - DNA, 1705 bp, Homo sapiens
cgtgttggtgaggtcgatctcgaattgcctgacctcaggtgatgcctccgcaccttggcctcccagggtgctgggattacaggcatgagccaccaccccatcttgcgcccaaaccgaagtcatagccacactcaagaatgggaagaaagcttgtctcaaccccgcatcccccatggttcagaaaatcatcgaaaagatactgaacaagtgagttgtaatttccatatacacaggcgactggagccgttggtcagaaatactggcatctgccccctaaaaataaaatcagggaaccccaagagttagctgaaggactagaaattgtgattattattttcacaattaaagttgccattaaggttattaatctgctctggtgccagaggatatttcagtatttcagtgtcttccatttccaggcctaacccctgggagggtaaatgtgggtttctagaatactaagtaaatttgactaacaatgccaaaatgccccctgcctgttttgggacgtttacctcagtccctaatgggcttcagacctgaaaaatgcaatgtctggtttgggcactttgggcctgtaagccttcttggtgaagagcagaaactttgcagtaacaccttcagtgagttcaaggctaggatccctgtcaacattatttaatctctttgagctttagcaaaatagggtagataatggtagttatttcatagggttgtgtgcagcttaagggagatcatgaatggacatttctaacccaatgtgacaatcagtgaccaatatgttttggctttttcaaaccaagaatctagttgagtccacagccacttctttcttgaaaaaaaaaaaaaaaagcattcaggagtgcaagttttctgctatagaaggcagtgggtacagacagaccttccctgagtggagggctgggagagagtctgcatggggacatccctccaagcaacttcagagtgacagaagagcagccttccttagcacctgcaacagtaacccttttctcatcacagggggagcaccaactgacaggagagaagtaagaagcttatcagcgtatcattgacacttcctgcagggtggtccctgcccttaccagagctgaaaatgaaaaagagaacagcagctttctagggacagctggaaaggacttaatgtgtttgactatttcttacgagggttctacttatttatgtatttatttttgaaagcttgtattttaatattttacatgctgttatttaaagatgtgagtgtgtttcatcaaacatagctcagtcctgattatttaattggaatatgatgggttttaaatgtgtcattaaactaatatttagtgggagaccataatgtgtcagccaccttgataaatgacagggtggggaactggagggtggggggattgaaatgcaagcaattagtggatcactgttagggtaagggaatgtatgtacacatctattttttatactttttttttaaaaaaagaatgtcagttgttatttattcaaattatctcacattatgtgttcaacatttttatgctgaagtttcccttagacattttatgtcttgcttgtagggcataatgccttgtttaatgtccattctgcagcgtttctctttcccttggaaaagagaatttatcattactgttacatttgtacaaatgacatgataataaaagttttatga

SEQ ID NO: 62438 - DNA, 229 bp, Homo sapiens
gagcgtccgtggtcactgaactgcgctgccagtgcttgcagacactgcagggaattcacctcaagaacatccaaagtgtgaatgtaaggtcccccggaccccactgcgcccaaaccgaagtcatgtaagtcccgccccgcgcttccgctgccaccgctggggtccccgactctcccgctgccccaaccctgtccccagcccgacctcctgtctcacggaattcccttct

SEQ ID NO: 62439 - DNA, 1167 bp, Homo sapiens
gacacagcccgggtcgcaggcacctccccgccagctctcccgcttctcgcacagcttcccgacgcgtctgctgagccccatggcccacgccacgctctccgccgcccccagcaatccccggctcctgcgggtggcgctgctgctcctgctcctggtggccgccagccggcgcgcagcaggtgggtcccggcgccctggggtccccgggccggacgcggctggggtgggcgccccgcgccgacagccccgctcaatcagcgagtctattcttccctaggagcgtccgtggtcactgaactgcgctgccagtgcttgcagacactgcagggaattcacctcaagaacatccaaagtgtgaatgtaaggtcccccggaccccactgcgcccaaaccgaagtcatagccacactcaagaatgggaagaaagcttgtctcaaccccgcatcccccatggttcagaaaatcatcgaaaagatactgaacaaggggagcaccaactgacaggagagaagtaagaagcttatcagcgtatcattgacacttcctgcagggtggtccctgcccttaccagagctgaaaatgaaaaagagaacagcagctttctagggacagctggaaaggacttaatgtgtttgactatttcttacgagggttctacttatttatgtatttatttttgaaagcttgtattttaatattttacatgctgttatttaaagatgtgagtgtgtttcatcaaacatagctcagtcctgattatttaattggaatatgatgggttttaaatgtgtcattaaactaatatttagtgggagaccataatgtgtcagccaccttgataaatgacagggtggggaactggagggtggggggattgaaatgcaagcaattagtggatcactgttagggtaagggaatgtatgtacacatctattttttatactttttttttaaaaaaagaatgtcagttgttatttattcaaattatctcacattatgtgttcaacatttttatgctgaagtttcccttagacattttatgtcttgcttgtagggcataatgccttgtttaatgtccattctgcagcgtttctctttcccttggaaaagagaatttatcattactgttacatttgtacaaatgacatgataataaaagttttatga

SEQ ID NO: 62440 - DNA, 170 bp, Homo sapiens
ggactggaggactagaggtcagtggtcagagagagacttctcaatccatagactcatttctatttaaatgtttaattatgtatatgcattactgtgcacaacagttgtatgcagatgcagcctaatggcatctcctcttgacaaccctgagcatctccgaaccgatgtcc

SEQ ID NO: 62441 - DNA, 373 bp, Homo sapiens
cgcaggggctgggtcgcagccaggaggaaagggctcgcccctgcccccgggggcccctctgataagcaggggtgcaggcaaggagggaggccccggcgacagggccgcccacgcggactttctgcccgcagaggagggggcacacgggatggcggctcccacgggtctcctctcatagctccgcttcccacctacccgcaccctccctcgggtctgttccccttgggtgcactccccttagcgcggcctaggcaccaaggagctgctctcggcagtgttcacgagatacaatgaattgaccagatctgtcataactgatggccgttccttcagaagctcattccagtcgccccacttcccactactgcctttg

SEQ ID NO: 62442 - DNA, 479 bp, Homo sapiens
ctaatacaacttggaaagacttacaaccagttgtcaggtttattttccatcattccgtcttctcaaaataggttggtgtgattctctgaaaacatggccattattgaataatgttactgtcttatattttgtttcttatagatagcagtatcagtatacttttccatagaaaatactgtgtgacttcatgaccttggtgacaattttatgtttgtacaataaacacatttctgctgtgagggatgatacatgcaggctgtagggcatcaggcgatcaggggatgtgaaggtaattgtaggctgatcactgtaggctgaacacctcaaatttttgagagcttgtcctattaattatccaaaatttctgagcattcttttctagcagtaggagagtaagaaattataaatttgattttgattaagaggcctttctcctttttcaacagtgttgatttttaaaaagtcttaaaaaaaaaaca

SEQ ID NO: 62443 - DNA, 883 bp, Homo sapiens
  misc_feature (555)..(555): n is a, c, g, or t
  misc_feature (803)..(803): n is a, c, g, or t
  misc_feature (825)..(825): n is a, c, g, or t
  misc_feature (833)..(833): n is a, c, g, or t
  misc_feature (841)..(841): n is a, c, g, or t
  misc_feature (854)..(854): n is a, c, g, or t
  misc_feature (856)..(856): n is a, c, g, or t
  misc_feature (859)..(859): n is a, c, g, or t
ggccgaggaggtgccgagagtgagcgagggctgccagggctgccagcgtgctgtcacctctcaacaccactgcgtggtccttgggctgggccatcccgggcaagtctctggtaaatggtgagcgtggtgtgtatcgctgtggtgcaggcagggaggtgtaggggctggatgcagagtgagcaggtgccatgaggacagcagcctgccagcctgagtgcctcagccatgggcaaggccatgtctctctttcctgaaacttgttcctgtggcgtctttcagtttatagaggtagagagtacagtcaagcggacccgcaggtgccagtcacctgcttcaacagtgaagcttttgctaaccttgttttatatctcacatgcatgtgtatccgagtaacctttaaaaatctcggacatcgggaaatttcacctgtaaatgctccagtttgtgtctaacaaacttttatttttataacaccatgctttatctcacttaaaaatatctcacttaaaaattatatagccatttcttaacatcctgtattcgttcttatccatntggccatttccccaattttcgaaacaagtctctacagatgcgtggctcacatcaggagcccacgtgccatggggctgctgtgtccctgaagccccctttcctccatccgttttgctcccaggcctttgactggtcagagaaactgatgcctttgcccacaggaggcccctcagtctagacttggctggatttttccccaagtgcaacagtctcccttgtgggaaggcttttgataatgaattcagttnctttgataaaaagctattctgnttctctgntttcttgnttctatttcatangntgnattttcttcttctctctttttttt

SEQ ID NO: 62444 - DNA, 180 bp, Homo sapiens
taattaactcaaatagcttcatgtggctagctgccgccctgtagaacagcacagttctagaactttcgagaccttctccctgttatccacacttactttacagagtagactcagcacttcgagtcccctgtccttcaggccaggccaaaccttggtccccagagcccagtgtggcagagg

SEQ ID NO: 62445 - DNA, 301 bp, Homo sapiens
ttagcctaactctaatctgattcattttataactcatataatattctaattttatagggtagaaagttgttttagttgtcatgactgcttgtagttagccacaaaggtaaacgtttaactcttaatatggaatgagatatttaccttcctctaattgtggcattcatctctttatgttagatttttaactactgttctggttcattccacatagttttcttttcattgaagagttgtcctacaaccttttgtcccaattaatatctctacttacattgtggtactttctataatttgactg

SEQ ID NO: 62446 - DNA, 427 bp, Homo sapiens
tggctttcatgtcgtcttcacagcaagagatgaggattgagggaaacacaactttgttatttctgctgcttttatgatatgtttaaagaatataggatgccctgaaaatgttaaaccattttccttattaagattactgactaagggccgggcgcgggtggctcacgcctgtaatgccagcactttgggaggccgaggcgggtggatcacgaggtcaggagatcgagaccatcctggctaacgcggtgaaatcccgtctctactaaaaatacaaaaaattatctgggcgtggtggcgggcgcctgtagtcccagctactggggaggctgaggcaggagaatggcgtgaacctgggaggcggagcttgcagcgagccgagatcgcgccactgcactccagcctgggcgacagagcgagactctgtctc

SEQ ID NO: 62447 - DNA, 406 bp, Homo sapiens
atgcagtttcaattcccagagtgtgtcagtcatcttgtgactgtgagacaaagaccaatggaatgacagagatataaattgtgccctggagaggctaaacccctgccagcagctatcaattttcatattcctcatttcctgagaaaaggaaatcctaattggtataagcaaatttttaaaggcaatgttgtgtaatggttaatgacagcagctcttgcacaagacttcccagattcaaataccaacagtaccacttactagctgggtcagttggagcaagctacttaatctacctctgccttgattttctcctgtgcaaaatgggggtctcttgggctttgagggcttttctggtaccaaagtgccacagacaacattgctccattggaaaaaaccatttcaattc

SEQ ID NO: 62448 - DNA, 1272 bp, Homo sapiens
tccgctcctcccgccgcggcgcccgcaccgcagtgacagccagccgggcccggtggcggagaggaagtgcggtccgcgccaagcccgtccccgccgacgccggctccccgcggctcgggtgacagcgtcgcggccgccggacgcagcgcggggcaggcgcgggcagagccgagcgcagcggaggctccggcggaggcgcggggaaaatggctgatgactttggcttcttctcgtcgtcggagagcggtgccccggaggcggcggaggaggacccggcggccgccttcctggcccagcaggagagcgagattgcaggcatagagaacgacgagggcttcggggcacctgccggcagccatgcggcccccgcgcagccgggccccacgagtggggctggttctgaggacatggggaccacagtcaatggagatgtgtttcaggaggccaacggtcctgctgatggctacgcagccattgcccaggctgacaggctgacccaggagcctgagagcatccgcaagtggcgagaggagcagaggaaacggctgcaagagctggatgctgcatctaaggtcacggaacaggaatggcgggagaaggccaagaaggacctggaggagtggaaccagcgccagagtgaacaagtagagaagaacaagatcaacaaccgggcatccgaggaggctttcgtgaaggaatccaaggaggagaccccaggcacagagtgggagaaggtggcccagctatgtgacttcaaccccaagagcagcaagcagtgcaaagatgtgtcccgcctgcgctcggtgctcatgtccctgaagcagacgccactgtcccgctaggtgcctgctaggtgcatggccacagagcatgggctgggcctgggcacaggaggagcagctgctttggtcggggtggagactcgcagcagctgctacccacagcctattccactcctccccatctccaggcgctgggaggggggccctcaccccatcacgcctcgctccctcctggccctctggtccagcccctcacgcctcctctcagtctactcaattgtgactgtccctcctgatgtattttttttcttggcttaaagggtgtgttgttgactctttttacacttatttattatcattctcacttctctggaagccacaactggtgtcagggctcggtttgtgcttagaactttcccagcttcatgaccttgagagaagggagaatgttcccccatttcccagccaagtgggagccccaagctctcca

SEQ ID NO: 62449 - DNA, 5932 bp, Homo sapiens
  misc_feature (2)..(2): n is a, c, g, or t
  misc_feature (6)..(6): n is a, c, g, or t
  misc_feature (958)..(958): n is a, c, g, or t
  misc_feature (1850)..(1850): n is a, c, g, or t
  misc_feature (2277)..(2277): n is a, c, g, or t
  misc_feature (2532)..(2532): n is a, c, g, or t
  misc_feature (2536)..(2536): n is a, c, g, or t
  misc_feature (2639)..(2639): n is a, c, g, or t
  misc_feature (2641)..(2641): n is a, c, g, or t
  misc_feature (2651)..(2651): n is a, c, g, or t
  misc_feature (2664)..(2664): n is a, c, g, or t
  misc_feature (2667)..(2668): n is a, c, g, or t
  misc_feature (2670)..(2670): n is a, c, g, or t
  misc_feature (2902)..(2902): n is a, c, g, or t
  misc_feature (3967)..(3967): n is a, c, g, or t
  misc_feature (3969)..(3973): n is a, c, g, or t
  misc_feature (3975)..(3976): n is a, c, g, or t
  misc_feature (3978)..(3981): n is a, c, g, or t
  misc_feature (3983)..(3991): n is a, c, g, or t
  misc_feature (3994)..(3994): n is a, c, g, or t
  misc_feature (3997)..(4002): n is a, c, g, or t
  misc_feature (4005)..(4005): n is a, c, g, or t
  misc_feature (4008)..(4009): n is a, c, g, or t
  misc_feature (4032)..(4032): n is a, c, g, or t
  misc_feature (4037)..(4037): n is a, c, g, or t
  misc_feature (4078)..(4078): n is a, c, g, or t
  misc_feature (4097)..(4097): n is a, c, g, or t
  misc_feature (4101)..(4101): n is a, c, g, or t
  misc_feature (4108)..(4108): n is a, c, g, or t
  misc_feature (4110)..(4110): n is a, c, g, or t
  misc_feature (4120)..(4121): n is a, c, g, or t
  misc_feature (4124)..(4124): n is a, c, g, or t
  misc_feature (4126)..(4126): n is a, c, g, or t
  misc_feature (4134)..(4134): n is a, c, g, or t
  misc_feature (4958)..(4958): n is a, c, g, or t
  misc_feature (5169)..(5169): n is a, c, g, or t
  misc_feature (5262)..(5262): n is a, c, g, or t
  misc_feature (5264)..(5264): n is a, c, g, or t
  misc_feature (5279)..(5279): n is a, c, g, or t
gncaangatcaggcacagagagggtgagtaacttgcccgcagtcacacaggtggcggagtgttgctggcagagggaacagcaagtgcaaagataggtgtagtcaccagagacagtgggtatgaggttgtttgaggctgagttatccagacatgagtgggtccccagcaggggcagcagagacagcggggcaggtgtgctggctggatagactgctgcgtgtttgtgttctaggaggccaacggtcctgctgatggctacgcagccattgcccaggctgacaggctgacccaggagcctgagagcatccgcaagtggcgagaggagcagaggaaacggctgcaagagctgggggtgagggcggggctgaggcggggttggctgggtgggctgtgtgtggggtggagtgtggggagtcctcggagtgcatgggatgctgcatgccttaatgtgggactgggccggtgcggccctgtggctgcctggcaggggccaggggaggagcgcggccgggcctgtgcatcccagctggaaagcagccactcattctcttgtggggtcctagatgctgcatctaaggtcacggaacaggaatggcgggagaaggccaagaaggacctggaggagtggaaccagcgccagagtgaacaagtagagaagaacaagatcaacaaccgtgagagggctgtagggacatgagggggccatggggacatgaggggggctgtggggacatgagggggccgtggggacatgagggggccatggggacatgaaggggtggggacatgagggagctgtggggacatgagggggccgtggggacatgagacgggctgtggggacatgagggagctgtggggacatgagaggggctgtggggacatgagagggagctgtggggacatgagagggagctgtggggacatgagaggggctgtggggacatgagaggggctntggggacatgagaggggctgtggggacatgactgaacactgcccagtgctccctgcctttgaggctctgtccttcacggtacaaggtcttccaggaagggaaaggcctgttctgggaagctacccttctgtctagggaactgctgcatgccaggctctggggtaggcacggaggagatggagataaggaggacccagccttatgtcctcaaagggcgcgaggagaaaaacacacatgttcaactaagctcaaatacagtagggccctctgcacgaaggccatggaagcaaggaaacaggtcagggagagacctctgtgtcttgggacttgggctttggaagatgactaggaggaaaaaagggaaaaaagggcaggaggtaggggggcattctagacctgggtacgaagaaaaaaatgtgatgtattaggcaacagggggccagggagcggtgggagagaaggcaggaacctgtggactcacactgtaagggccttggctgatgagttgggcagtgacatgggcagtggggagccactgaaggtgtttgaacaggagtaacatgatcagggatgaattttagagaaggtgctggggccagggtgaaggtcccattctcctgtttggggctgtgggtcgttgctgagccttccagaactatgcttcctaacatttctcccactggaggtactaatgctgtctctctctctctctcaaccttctgcctgcctgtctgtcttgccatctgccttcccccacctaaccccttccctcaacctttccctcaaggatcgctgacaaagcattctaccagcagccagatgctgatatcatcggctacgtgtacgtgtctgttttgcttctctgttgggggagctagagagggaatggccnccacagtttcttgagtttcctgcttgtgggatataaatgagtgtggctgggctcggagcaatggtcagaacaggaggcaaatgccctggtgggtgcaggcagcaaccacctccctccctccagtgaagtggaggctgcttggctaaatcagagccttgcaggataaaggcagagaaaggaatgtgcttgccacttattcccatgtgggaggggcaaatggcagagcaccccaactccctccctctgtgatgtctcttggtgggtgtgtggggtgaagggttttttgttttttgagatggagtttcgctcttgctgctcaggatggagtgcagtgctgcgatctcggctcactgcgacctccacctcctgggttcaagcgattctcctgcctcagcctcccgagtagctgagattataggcacatgcnaccgtgcccggctaacttttgtatttttagtagagacggggtttcaccatgtcggccaggctggtctcgaactcctgacctcaggtgatccacccacctcggcctcccaaagtgctgggattacaggcatgagccaccacacccagctgaaggggtcttttattcaacaaaacagacactgagcatgggatgctggaggcatgtaaaggacaagagctgctcctttgtgacatccatctcttcctcctgccccantgcnctgactttggccatcagcccctgcccagaccaccacaggccccctcacatgtttcaggtttggggtctacttggtgtgatgagtaatcaagaccagggttggnanacaggttatntctcgtgccgacntcnntnagttggtagagacatcctggagggtggtggtggggattgtggagctgaagagaaggtacttgctgttcttcactctaggtgtgccctggcagcccgtcatgtgtcgaggctaagcctcctctcacagggcacagagcacaccagagccttcgtctgcttccttccactctccctcatttagtactctttggcactcgccttgtgccagattggtaagacacccacaggccgnccccctcaccgtgctcatggtctggagtgtgttatgataagggccttgtggaaggacacagtgagctctggaagccactctctgcctggggagcctgggcaggcttcagagatgcaagaccttcagctgaccttaaagtgtgagaaggagtttgctggatagggagggtgggaagagaaggtgggaggagcagctggggccaaggcatccagagagaaaaggcccagctggctgcagtggctgaagctctacaggctgggatggtggggatggtggggatggtggggatgggtgggagctgaggctgggaggtggttggcttggggctggttgcaaagcgcctgttgtgccaaggctgagctcagacttgatccagaaggcagtggggagccacaggaggcttccagcaagggatggggatgtcagatgggcatgggtgctgtggaataccacagggggctcgatgcttctgttgagcctgaggaaatggcccagagagcacccaggagagccctgaagagagagtatagaccagggcttctcaaacttttttttttttttaagacggagtcttgctctgtcacccaggctggagtgcagtggcatgatctcagctcactgcaacctccgcctcctgggctcaagcaattcttctgcctcggcctcctgagtagctgggactacaggtgcccgccaccatgcccggctaattttgtgtatttttagtagagacggggtttcaccgtgttggccaggatggtctcaatctgacctcgtgatccgcccaccttggcctcccaaagtgctgggattgcaggcatgagccaccgtgcctggccacacccagctaattttttgtatttttagtagagatggggtttcaccatgttggccaggcaggtctcgaactcctgacctcaagtgaatccacccgcctctgcctcccaaagtgctgggattacaggagtgagccactgcgcccaggctcaaactttcacatgcctatgaattaccagggggtctcgtgaaaaccctgattctgattcagcaggacggtggggaggncnnnnngnntnnnntnnnnnnnnnctntgnnnnnntgngtnncattggaccatggacgctttganctgcnaggacagaggggagcctctggaccctgaagggacagctccnaggatagctcccctcatcnccanttgccancnagctccagcnncantntccttttntccagacctgcttgctacctcattgaattctcagtccagtgaaatagttggtagggcagagctatgatcctcattttacaggctaggaaatgagcatacagccagcatccctagagaggggccaggtcacctgatccggggtcagctcttccatggagcgctcctgccatcagtcatgtctggcatcggcagaactggtcctgcttgagatggagagggggcttccagggacttgtgagcgaccctcgctggccaaacaggacatagacccagctctcctcacctaagaatcccttattgtctttctgttagtgagtcccacgtgtagattttgtccactagactgtatttacttgtttccccactgtcccttagtcagtggcttctgtgactgtcaaccagaacttctgatgaaggaccgccagttttcatcctaacttgattccaaccaaaagcagactccagtggagcattcatgccccaggctgtggctcctcagagacagtggtggttctgggctacaaagggctctgtggtgaaagacgcttgggatgtggtggattccatcacatacacaccttggagggtcacgacgcacacagcacatgaaaggctttgaaagtcttgctgtaaagatcctctttagctgggttttccataggtatttgaccacagtctttctggagaatcctcacacagaacattcaggcaatgctgaactaggtgcttctgttagatggttagtcagtgtcctacttctgccaagtttttggaaatggtgaaatagctaaggtcctgcattaggtcgtcctaggacctccaanggtctttaggtgtcaggaacctcaggttgggaactcccgatggggaagtaatgaacagagggtgcctaggctgggaagactttctgaggaggtgaggcccgcactgagacctgaatgacaagaagcagcaagccaggaacaggtctgggagaagcgtgttccaggaagaggtgatagcaagtgccaaggtcctgaggcaggaccaagctangcttcctcctgcgccaaggctgccctcctctgaagtcaggggggcacaaggctggggaggacacagtgccccagagtaggctgggcaaagcancnttgctcaagggcaangctgggggaaagcagactgctataaaagcccgtcctatctccacccgcaggggcatccgaggaggctttcgtgaaggaatccaaggaggagaccccaggcacagagtgggagaaggtggcccagctatgtgacttcaaccccaagagcagcaagcagtgcaaagatgtgtcccgcctgcgctcggtgctcatgtccctgaagcagacgccactgtcccgctaggtgcctgctaggtgcatggccacagagcatgggctgggcctgggcacaggaggagcagctgctttggtcggggtggagactcgcagcagctgctacccacagcctattccactcctccccatctccaggcgctgggaggggggccctcaccccatcacgcctcgctccctcctggccctctggtccagcccctcacgcctcctctcagtctactcaattgtgactgtccctcctgatgtattttttttcttggcttaaagggtgtgttgttgactctttttacacttatttattatcattctcacttctctggaagccacaactggtgtcagggctcggtttgtgcttagaactttcccagcttcatgaccttgagagaagggagaatgttcccccatttcccagccaagtgggagccccaagctctcca

SEQ ID NO: 62450 - DNA, 647 bp, Homo sapiens
gctgcaggaattcggcacgaggatcaacattcggggcatccgaggaggctttcgtgaaggaatccaaggaggagaccccaggcacagagtgggagaaggtggcccagctatgtgacttcaaccccaagagcagcaagcagtgcaaagatgtgtcccgcctgcgctcggtgctcatgtccctgaagcagacgccactgtcccgctaggtgcctgctaggtgcatggccacagagcatgggctgggcctgggcacaggaggagcagctgctttggtcggggtggagactcgcagcagctgctacccacagcctattccactcctccccatctccaggcgctgggaggggggccctcaccccatcacgcctcgctccctcctggccctctggtccagcccctcacgcctcctctcagtctactcaattgtgactgtccctcctgatgtattttttttcttggcttaaagggtgtgttgttgactcttcctctctataccctttcccctattccacttttctttatcttcttcaacattcatcctctcctattttccacttaccctatcttccttccctctatttcacctatctaccactttctctttcctattccttaactatccccatctacttctctcctcctctcct

SEQ ID NO: 62451 - DNA, 1291 bp, Homo sapiens
cgcggggagccggcgtcggcggggacgggcttggcgcggaccgcacttcctctccgccaccgggccggctccccgcggctcgggtgacagcgtcgcggccgccggacgcagcgcggggcaggcgcgggcagagccgagcgcagcggaggctccggcggaggcgcggggaaaatggctgatgactttggcttcttctcgtcgtcggagagcggtgccccggaggcggcggaggaggacccggcggccgccttcctggcccagcaggagagcgagattgcaggcatagagaacgacgagggcttcggggcacctgccggcagccatgcggcccccgcgcagccgggccccacgagtggggctggttctgaggacatggggaccacagtcaatggagatgtgtttcaggaggccaacggtcctgctgatggctacgcagccattgcccaggctgacaggctgacccaggagcctgagagcatccgcaagtggcgagaggagcagaggaaacggctgcaagagctggatgctgcatctaaggtcacggaacaggaatggcgggagaaggccaagaaggacctggaggagtggaaccagcgccagagtgaacaagtagagaagaacaagatcaacaaccggatcgctgacaaagcattctaccagcagccagatgctgatatcatcggctacgtggcatccgaggaggctttcgtgaaggaatccaaggaggagaccccaggcacagagtgggagaaggtggcccagctatgtgacttcaaccccaagagcagcaagcagtgcaaagatgtgtcccgcctgcgctcggtgctcatgtccctgaagcagacgccactgtcccgctaggtgcctgctaggtgcatggccacagagcatgggctgggcctgggcacaggaggagcagctgctttggtcggggtggagactcgcagcagctgctacccacagcctattccactcctccccatctccaggcgctgggaggggggccctcaccccatcacgcctcgctccctcctggccctctggtccagcccctcacgcctcctctcagtctactcaattgtgactgtccctcctgatgtattttttttcttggcttaaagggtgtgttgttgactctttttacacttatttattatcattctcacttctctggaagccacaactggtgtcagggctcggtttgtgcttagaactttcccagcttcatgaccttgagagaagggagaatgttcccccatttcccagccaagtgggagccccaagctctcca

SEQ ID NO: 62452 - DNA, 1109 bp, Homo sapiens
tccgctcctcccgccgcggcgcccgcaccgcagtgacagccagccgggcccggtggcggagaggaagtgcggtccgcgccaagcccgtccccgccgacgccggctccccgcggctcgggtgacagcgtcgcggccgccggacgcagcgcggggcaggcgcgggcagagccgagcgcagcggaggctccggcggaggcgcggggaaaatggctgatgactttggcttcttctcgtcgtcggagagcggtgccccggaggcggcggaggaggacccggcggccgccttcctggcccagcaggagagcgagattgcaggcatagagaacgacgagggcttcggggcacctgccggcagccatgcggcccccgcgcagccgggccccacgagtggggctggttctgaggacatggggaccacagtcaatggagatgtgtttcaggaggccaacggtcctgctgatggctacgcagccattgcccaggctgacaggctgacccaggagcctgagagcatccgcaagtggcgagaggagcagaggaaacggctgcaagagctggatgctgcatctaaggtcacggaacaggaatggcgggagaaggccaagaaggacctggaggagtggaaccagcgccagagtgaacaagtagagaagaacaagatcaacaaccgggcatccgaggaggctttcgtgaaggaatccaaggaggagaccccaggcacagagtgggagaaggtggcccagctatgtgacttcaaccccaagagcagcaagcagtgcaaagatgtgtcccgcctgcgctcggtgctcatgtccctgaagcagacgccactgtcccgctaggtgcctgctaggtgcatggccacagcccctcacgcctcctctcagtctactcaattgtgactgtccctcctgatgtattttttttcttggcttaaagggtgtgttgttgactctttttacacttatttattatcattctcacttctctggaagccacaactggtgtcagggctcggtttgtgcttagaactttcccagcttcatgaccttgagagaagggagaatgttcccccatttcccagccaagtgggagccccaagctctcca

SEQ ID NO: 62453 - DNA, 647 bp, Homo sapiens
gggtctacttgtgtgtgagtaatcaagaccaggttggcaaacaggggcatccgaggaggctttcgtgaaggaatccaaggaggagaccccaggcacagagtgggagaaggtggcccagctatgtgacttcaaccccaagagcagcaagcagtgcaaagatgtgtcccgcctgcgctcggtgctcatgtccctgaagcagacgccactgtcccgctaggtgcctgctaggtgcatggccacagagcatgggctgggcctgggcacaggaggagcagctgctttggtcggggtggagactcgcagcagctgctacccacagcctattccactcctccccatctccaggcgctgggaggggggccctcaccccatcacgcctcgctccctcctggccctctggtccagcccctcacgcctcctctcagtctactcaattgtgactgtccctcctgatgtattttttttcttggcttaaagggtgtgttgttgactctttttacacttatttattatcattctcacttctctggaagccacaactggtgtcagggctcggtttgtgcttagaactttcccagcttcatgaccttgagagaagggagaatgttcccccatttcccagccaagtgggagccccaagctctcca

SEQ ID NO: 62454 - DNA, 573 bp, Homo sapiens
gctcggtacccgctgatccgcttaagtgggagaaggtggcccagctatgtgacttcaaccccaagagcagcaagcagtgcaaagatgtgtcccgcctgcgctcggtgctcatgtccctgaagcagacgccactgtcccgctaggtgcctgctaggtgcatggccacagagcatgggctgggcctgggcacaggaggagcagctgctttggtcggggtggagactcgcagcagctgctacccacagcctattccactcctccccatctccaggcgctgggaggggggccctcaccccatcacgcctcgctccctcctggccctctggtccagcccctcacgcctcctctcagtctactcaattgtgactgtccctcctgatgtattttttttcttggcttaaagggtgtgttgttgactctttttacacttatttattatcattctcacttctctggaagccacaactggtgtcagggctcggtttgtgcttagaactttcccagcttcatgaccttgagagaagggagaatgttcccccatttcccagccaagtgggagccccaagctctcca

SEQ ID NO: 62455 - DNA, 1245 bp, Homo sapiens
tccgctcctcccgccgcggcgcccgcaccgcagtgacagccagccgggcccggtggcggagaggaagtgcggtccgcgccaagcccgtccccgccgacgccggctccccgcggctcgggtgacagcgtcgcggccgccggacgcagcgcggggcaggcgcgggcagagccgagcgcagcggaggctccggcggaggcgcggggaaaatggctgatgactttggcttcttctcgtcgtcggagagcggtgccccggaggcggcggaggaggacccggcggccgccttcctggcccagcaggagagcgagattgcaggcatagagaacgacgagggcttcggggcacctgccggcagccatgcggcccccgcgcagccgggccccacgagtggggctggttctgaggacatggggaccacagtcaatggagatgtgtttcagcccgtgcaccaccagcgggtccagctacaaacccagttgccaatacagcctaaggacgagcctgcccacaactattccagttccatttggcacagccaggggcagggacagaagggccctgcaggactccgcctccccacctctgcacagatcctctctcctttcccctaatactcccatcatcctccttttagcttcttagaggaatcagcagctcagcttagcttagatttagctgatcaatcccaaagaaggatgtggctcatcctcttggccatccctggagtcgcagcacacgcttggctggtgtgggtccacagaggttctcatgggtgggcccagcagaggggcccctcaggagagggattctagggagctagactgagacaagcctggccctgactgtcgcctcctgccttctggtcctggccattcctgcccctttctctctccagagcttgggaggagtcagaacattgctctagccgctggtgatctctcctggttgccaaccctcctggccatgactgatctccccactgagatgctcaggtttgaaagccaagctgcccagggaagggacttctcaaaggtcgcgagtccagtgagtggcagaagggggatgtaaagccccagcccctctgatggagtgtccagcgctcgtcccgtgccctccacgcccctgtgtacccagctacttgtttattcatttggtttatacgtttggtcgttcattcatttggtcagtgcacattcttttatggccacacacctgctagggcagtgaataaacggatatggaggc

SEQ ID NO: 62456 - DNA, 920 bp, Homo sapiens
  misc_feature (9)..(9): n is a, c, g, or t
  misc_feature (40)..(40): n is a, c, g, or t
aggcgcggngcagagcgagcgagccgtgccccacgagtgngctggttctgaggacatggggaccacagtcaatggagatgtgtttcaggaggccaacggtcctgctgatggctacgcagccattgcccaggctgacaggctgacccaggagcctgagagcatccgcaagtggcgagaggagcagaggaaacggctgcaagagctggatgctgcatctaaggtcacggaacaggaatggcgggagaaggccaagaaggacctggaggagtggaaccagcgccagagtgaacaagtagagaagaacaagatcaacaaccgggcatccgaggaggctttcgtgaaggaatccaaggaggagaccccaggcacagagtgggagaaggtggcccagctatgtgacttcaaccccaagagcagcaagcagtgcaaagatgtgtcccgcctgcgctcggtgctcatgtccctgaagcagacgccactgtcccgctaggtgcctgctaggtgcatggccacagagcatgggctgggcctgggcacaggaggagcagctgctttggtcggggtggagactcgcagcagctgctacccacagcctattccactcctccccatctccaggcgctgggaggggggccctcaccccatcacgcctcgctccctcctggccctctggtccagcccctcacgcctcctctcagtctactcaattgtgactgtccctcctgatgtattttttttcttggcttaaagggtgtgttgttgactctttttacacttatttattatcattctcacttctctggaagccacaactggtgtcagggctcggtttgtgcttagaactttcccagcttcatgaccttgagagaagggagaatgttcccccatttcccagccaagtgggagccccaagctctcca

SEQ ID NO: 62457 - DNA, 1173 bp, Homo sapiens
tccgctcctcccgccgcggcgcccgcaccgcagtgacagccagccgggcccggtggcggagaggaagtgcggtccgcgccaagcccgtccccgccgacgccggctccccgcggctcgggtgacagcgtcgcggccgccggacgcagcgcggggcaggcgcgggcagagccgagcgcagcggaggctccggcggaggcgcggggaaaatggctgatgactttggcttcttctcgtcgtcggagagcggtgccccggaggcggcggaggaggacccggcggccgccttcctggcccagcaggagagcgagattgcaggcatagagaacgacgagggcttcggggcacctgccggcagccatgcggcccccgcgcagccgggccccacgagtggggctggttctgaggacatggggaccacagtcaatggagatgtgtttcaggaggccaacggtcctgctgatggctacgcagccattgcccaggctgacaggctgacccaggagcctgagagcatccgcaagtggcgagaggagcagaggaaacggctgcaagagctggatgctgcatctaaggtcacggaacaggaatggcgggagaaggccaagaaggacctggaggagtggaaccagcgccagagtgaacaagtagagaagaacaagatcaacaaccgggcatccgaggaggctttcgtgaaggaatccaaggaggagaccccaggcacagagtgggagaaggtggcccagctatgtgacttcaaccccaagagcagcaagcagtgcaaagatgtgtcccgcctgcgctcggtgctcatgtccctgaagcagacgccactgtcccgctaggtgcctgctaggtgcatggccacagagcatgggctgggcctgggcacaggaggagcagctgctttggtcggggtggagactcgcagcagctgctacccacagcctattccactcctccccatctccaggcgctgggaggggggccctcaccccatcacgcctcgctccctcctggccctctggtccagcccctcacgcctcctctcagtctactcaattgtgactgtccctcctgatgtatttttttttcctccaactcaaaaggcaaaaataatcctatttttattatcttgctacaactgcaactttctgccctataaatttacattcc

SEQ ID NO: 62458 - DNA, 1326 bp, Homo sapiens
tccgctcctcccgccgcggcgcccgcaccgcagtgacagccagccgggcccggtggcggagaggaagtgcggtccgcgccaagcccgtccccgccgacgccggctccccgcggctcgggtgacagcgtcgcggccgccggacgcagcgcggggcaggcgcgggcagagccgagcgcagcggaggctccggcggaggcgcggggaaaatggctgatgactttggcttcttctcgtcgtcggagagcggtgccccggaggcggcggaggaggacccggcggccgccttcctggcccagcaggagagcgagattgcaggcatagagaacgacgagggcttcggggcacctgccggcagccatgcggcccccgcgcagccgggccccacgagtggggctggttctgaggacatggggaccacagtcaatggagatgtgtttcaggaggccaacggtcctgctgatggctacgcagccattgcccaggctgacaggctgacccaggagcctgagagcatccgcaagtggcgagaggagcagaggaaacggctgcaagagctggatgctgcatctaaggtcacggaacaggaatggcgggagaaggccaagaaggacctggaggagtggaaccagcgccagagtgaacaagtagagaagaacaagatcaacaaccggatcgctgacaaagcattctaccagcagccagatgctgatatcatcggctacgtggcatccgaggaggctttcgtgaaggaatccaaggaggagaccccaggcacagagtgggagaaggtggcccagctatgtgacttcaaccccaagagcagcaagcagtgcaaagatgtgtcccgcctgcgctcggtgctcatgtccctgaagcagacgccactgtcccgctaggtgcctgctaggtgcatggccacagagcatgggctgggcctgggcacaggaggagcagctgctttggtcggggtggagactcgcagcagctgctacccacagcctattccactcctccccatctccaggcgctgggaggggggccctcaccccatcacgcctcgctccctcctggccctctggtccagcccctcacgcctcctctcagtctactcaattgtgactgtccctcctgatgtattttttttcttggcttaaagggtgtgttgttgactctttttacacttatttattatcattctcacttctctggaagccacaactggtgtcagggctcggtttgtgcttagaactttcccagcttcatgaccttgagagaagggagaatgttcccccatttcccagccaagtgggagccccaagctctcca

SEQ ID NO: 62459 - DNA, 1824 bp, Homo sapiens
tccgctcctcccgccgcggcgcccgcaccgcagtgacagccagccgggcccggtggcggagaggaagtgcggtccgcgccaagcccgtccccgccgacgccggctccccgcggctcgggtgacagcgtcgcggccgccggacgcagcgcggggcaggcgcgggcagagccgagcgcagcggaggctccggcggaggcgcggggaaaatggctgatgactttggcttcttctcgtcgtcggagagcggtgccccggaggcggcggaggaggacccggcggccgccttcctggcccagcaggagagcgagattgcaggcatagagaacgacgagggcttcggggcacctgccggcagccatgcggcccccgcgcagccgggccccacgagtggggctggttctgaggacatggggaccacagtcaatggagatgtgtttcagcccgtgcaccaccagcgggtccagctacaaacccagttgccaatacagcctaaggacgagcctgcccacaactattccagttccatttggcacagccaggggcagggacagaagggccctgcaggactccgcctccccacctctgcacagatcctctctcctttcccctaatactcccatcatcctccttttagcttcttagaggaatcagcagctcagcttagcttagatttagctgatcaatcccaaagaaggatgtggctcatcctcttggccatccctggagtcgcagcacacgcttggctggtgtgggtccacagaggttctcatgggtgggcccagcagaggggcccctcaggagagggattctagggagctagactgagacaagcctggccctgactgtcgcctcctgccttctggtcctggccattcctgcccctttctctctccagagcttgggaggagtcagaacattgctctagccgctggtgatctctcctggttgccaaccctcctggccatgactgatctccccactgagatgctcaggaggccaacggtcctgctgatggctacgcagccattgcccaggctgacaggctgacccaggagcctgagagcatccgcaagtggcgagaggagcagaggaaacggctgcaagagctggatgctgcatctaaggtcacggaacaggaatggcgggagaaggccaagaaggacctggaggagtggaaccagcgccagagtgaacaagtagagaagaacaagatcaacaaccgggcatccgaggaggctttcgtgaaggaatccaaggaggagaccccaggcacagagtgggagaaggtggcccagctatgtgacttcaaccccaagagcagcaagcagtgcaaagatgtgtcccgcctgcgctcggtgctcatgtccctgaagcagacgccactgtcccgctaggtgcctgctaggtgcatggccacagagcatgggctgggcctgggcacaggaggagcagctgctttggtcggggtggagactcgcagcagctgctacccacagcctattccactcctccccatctccaggcgctgggaggggggccctcaccccatcacgcctcgctccctcctggccctctggtccagcccctcacgcctcctctcagtctactcaattgtgactgtccctcctgatgtattttttttcttggcttaaagggtgtgttgttgactctttttacacttatttattatcattctcacttctctggaagccacaactggtgtcagggctcggtttgtgcttagaactttcccagcttcatgaccttgagagaagggagaatgttcccccatttcccagccaagtgggagccccaagctctcca

SEQ ID NO: 62460 - DNA, 1160 bp, Homo sapiens
tccgctcctcccgccgcggcgcccgcaccgcagtgacagccagccgggcccggtggcggagaggaagtgcggtccgcgccaagcccgtccccgccgacgccggctccccgcggctcgggtgacagcgtcgcggccgccggacgcagcgcggggcaggcgcgggcagagccgagcgcagcggaggctccggcggaggcgcggggaaaatggctgatgactttggcttcttctcgtcgtcggagagcggtgccccggaggcggcggaggaggacccggcggccgccttcctggcccagcaggagagcgagattgcaggcatagagaacgacgagggcttcggggcacctgccggcagccatgcggcccccgcgcagccgggccccacgagtggggctggttctgaggacatggggaccacagtcaatggagatgtgtttcaggaggccaacggtcctgctgatggctacgcagccattgcccaggctgacaggctgacccaggagcctgagagcatccgcaagtggcgagaggagcagaggaaacggctgcaagagctggggcatccgaggaggctttcgtgaaggaatccaaggaggagaccccaggcacagagtgggagaaggtggcccagctatgtgacttcaaccccaagagcagcaagcagtgcaaagatgtgtcccgcctgcgctcggtgctcatgtccctgaagcagacgccactgtcccgctaggtgcctgctaggtgcatggccacagagcatgggctgggcctgggcacaggaggagcagctgctttggtcggggtggagactcgcagcagctgctacccacagcctattccactcctccccatctccaggcgctgggaggggggccctcaccccatcacgcctcgctccctcctggccctctggtccagcccctcacgcctcctctcagtctactcaattgtgactgtccctcctgatgtattttttttcttggcttaaagggtgtgttgttgactctttttacacttatttattatcattctcacttctctggaagccacaactggtgtcagggctcggtttgtgcttagaactttcccagcttcatgaccttgagagaagggagaatgttcccccatttcccagccaagtgggagccccaagctctcca

SEQ ID NO: 62461 - DNA, 883 bp, Homo sapiens
tccgctcctcccgccgcggcgcccgcaccgcagtgacagccagccgggcccggtggcggagaggaagtgcggtccgcgccaagcccgtccccgccgacgccggctccccgcggctcgggtgacagcgtcgcggccgccggacgcagcgcggggcaggcgcgggcagagccgagcgcagcggaggctccggcggaggcgcggggaaaatggctgatgactttggcttcttctcgtcgtcggagagcggtgccccggaggcggcggaggaggacccggcggccgccttcctggcccagcaggagagcgagattgcaggcatagagaacgacgagggcttcggggcacctgccggcagccatgcggcccccgcgcagccgggccccacgagtggggctggttctgaggacatggggaccacagtcaatggagatgtgtttcaggaggccaacggtcctgctgatggctacgcagccattgcccaggctgacaggctgacccaggagcctgagagcatccgcaagtggcgagaggagcagaggaaacggctgcaagagctggatgctgcatctaaggtcacggaacaggaatggcgggagaaggccaagaaggacctggaggagtggaaccagcgccagagtgaacaagtagagaagaacaagatcaacaaccgttgtgactgtccctcctgatgtattttttttcttggcttaaagggtgtgttgttgactctttttacacttatttattatcattctcacttctctggaagccacaactggtgtcagggctcggtttgtgcttagaactttcccagcttcatgaccttgagagaagggagaatgttcccccatttcccagccaagtgggagccccaagctctcca

SEQ ID NO: 62462 - DNA, 1030 bp, Homo sapiens
  misc_feature (1022)..(1023): n is a, c, g, or t
tccgctcctcccgccgcggcgcccgcaccgcagtgacagccagccgggcccggtggcggagaggaagtgcggtccgcgccaagcccgtccccgccgacgccggctccccgcggctcgggtgacagcgtcgcggccgccggacgcagcgcggggcaggcgcgggcagagccgagcgcagcggaggctccggcggaggcgcggggaaaatggctgatgactttggcttcttctcgtcgtcggagagcggtgccccggaggcggcggaggaggacccggcggccgccttcctggcccagcaggagagcgagattgcaggcatagagaacgacgagggcttcggggcacctgccggcagccatgcggcccccgcgcagccgggccccacgagtggggctggttctgaggacatggggaccacagtcaatggagatgtgtttcagcccgtgcaccaccagcgggtccagctacaaacccagttgccaatacagcctaaggacgagcctgcccacaactattccagttccatttggcacagccaggggcagggacagaagggccctgcaggactccgcctccccacctctgcacagatcctctctcctttcccctaatactcccatcatcctccttttagcttcttagaggaatcagcagctcagcttagcttagatttagctgatcaatcccaaagaaggatgtggctcatcctcttggccatccctggagtcgcagcacacgcttggctggtgtgggtccacagaggttctcatgggtgggcccagcagaggggcccctcaggagagggattctagggagctagactgagacaagcctggccctgactgtcgcctcctgccttctggtcctggccattcctgcccctttctctctccagagcttgggaggagtcagaacattgctctagccgctggtgatctctcctggttgccaaccctcctggccatgactgatctccccactgagatgctcaggtgattaaacgagagcccagttgtggcccnngtgacac

SEQ ID NO: 62463 - DNA, 502 bp, Homo sapiens
tccgctcctcccgccgcggcgcccgcaccgcagtgacagccagccgggcccggtggcggagaggaagtgcggtccgcgccaagcccgtccccgccgacgccggctccccgcggctcgggtgacagcgtcgcggccgccggacgcagcgcggggcaggcgcgggcagagccgagcgcagcggaggctccggcggaggcgcggggaaaatggctgatgactttggcttcttctcgtcgtcggagagcggtgccccggaggcggcggaggaggacccggcggccgccttcctggcccagcaggagagcgagattgcaggcatagagaacgacgagggcttcggggcacctgccggcagccatgcggcccccgcgcagccgggccccacgagtggggctggttctgaggacatggggaccacagtcaatggagatgtgtttcaggaggccaacggtcctgctgatggctacgcagccaattgccccgctgtcgggctaggtcgggg

SEQ ID NO: 62464 - DNA, 877 bp, Homo sapiens
ttaatgggggaattgcgctgtgaatgaaccacaatactataggttccttagggccaggcacacagcacaggctcagtaaatgttttctgaatgaatgaatgaatgaatgaatggtcctcttcatagacttacagtgtaacactgggatttggagaactgctttaaaatctctattcatatctagggattaataaactagattttgggaaagtcagtactgaatataatgtaggtgtttctgtttgttaattaattaaaatgaccacagtcattattcttacccttaatttctcagtctgaaaagttaatcaactgtatctgttccatgaataattgagttgaacttgaaagagaactcgctattccaaaagcctcccacaccaccagttaactgtgatttatccttttacttctaaagaattttaagcatcttccatctaacttgactgacaaccaatctgtgcttcctctgtctttattccgtcaggaagaagacgttactcgtgaaagtcgttttaattttagcggttatgggatgggtcactgcctccaagtgaaagatggaacagctgtcaaggccacacctgccaacccactcccacaaccgccaaaagatggagatgctatcaagaagaagtttgtggaccgggcaaaaaggattgacacgatatctcgagctgccttcccattggccttcctcattttcaacatcttttactggatcacatacaagatcattcggcatgaagatgtccacaagaaatagatgtgccctacagaccctgggaccttcttgcctcagtgttgtgcttgtaaatacacagtgaaattgtctttatatcactttgacagaggagaagattgagggaggggggag

SEQ ID NO: 62465 - DNA, 1435 bp, Homo sapiens
cttgattaatcagatgaatctgcatatgagaatgacggctttctgcaaagaccatgactccaggtctggaaaacaaccttcacagaccctatctccttcagatttcttggacaagttaatgggaaggacatcaggatatgatgcaagaatcaggccaaattttaaaggtcctccagtaaacgttacttgcaatatttttatcaacagttttggatcagtcacagaaacgaccatggactaccgagtgaatatttttctgagacaacagtggaatgattcacggctggcgtacagtgagtacccagatgactccctggacttggacccatccatgctagactccatttggaaaccagatttgttctttgccaatgagaagggtgccaacttccacgatgtcaccactgacaacaaattgctacggatttcgaaaaatggcaaagtgctctacagtatcagactcaccttgaccttatcctgtcccatggacttgaagaactttccgatggatgtccagacctgtacaatgcagctggagagttttgggtacacgatgaatgacctgatatttgagtggttaagtgatggtccagtgcaagttgctgaaggattgaccctgccccagtttattttgaaagaagagaaggaacttggctactgtacaaagcactacaacactggaaagtttacctgcattgaggtcaagtttcacctggaacgccaaatgggatattatttgatccagatgtacatcccaagcctgcttatagtaattttgtcctgggtttccttttggataaatatggatgcagcccctgccagggtcgcactgggcatcaccacagtcttaacgatgaccacccagagttcaggctccagggcatctctgccaaaggtctcctatgtaaaagcgattgacatctggatggcggtgtgccttctgtttgtgtttgctgccttactggaatacgcagcggtgaacttcgtctccaggcaacacaaggagttcctgcgcctccgaagaagacagaagaggcagaataaggaagaagacgttactcgtgaaagtcgttttaattttagcggttatgggatgggtcactgcctccaagtgaaagatggaacagctgtcaaggccacacctgccaacccactcccacaaccgccaaaagatggagatgctatcaagaagaagtttgtggaccgggcaaaaaggattgacacgatatctcgagctgccttcccattggccttcctcattttcaacatcttttactggatcacatacaagatcattcggcatgaagatgtccacaagaaatagatgtgccctacagaccctgggaccttcttgcctcagtgttgtgcttgtaaatacacagtgaaattgtctttatatcactttgacagaggagaagattgagggaggggggag

SEQ ID NO: 62466 - DNA, 504 bp, Homo sapiens
actcaccttgaccttatcctgtcccatggacttgaagaactttccgatggatgtccagacctgtacaatgcagctggagagttgtaagtcaccactgttgaaatgactccctgcttgttttaaccaatgacctggttcttttagtatgtcattaaagagaaaggacccttacaactcattccctatatactgaccaacccccaacatcctaatggaaagacaaaccaaagtgtgtgtgtgtgtgtgtgtgtgtgtgtgtgtgtgtgtgtgtgtgtgtgtcatacaaaatctcattatcaatacagcataggcaacctttcaaagtaaaatgccaaataacttgcctttctccccccgcccaaaaaatagcctgatttggtaagcttttcattgaaatgaaaatgtctcctgagaaaattaaaattattagtcattaaatctttatagtgaatcactctttaatcagaaaattgaatttctttccatcttatgcccatgtagacc

SEQ ID NO: 62467 - DNA, 2015 bp, Homo sapiens
aggctgggtaagatcacgtctccgtctcattctatagccctcattccagcacaggatctcagcaatttttccctcttccccccacccactccagcgcgcagagtcctttcttctctctcatttacaacttctttttaaaagaaaacattttctagaaaaagggctttgctaaacagaaaagatataaaacaaaagccacagctatctagcatggcattgtcaccaactccctttgcatggtgatgcgattaaggtagcagcatttttattattcaggaaaagcagctgggggattcatcagttctgaggctttgtctttctgggttaactgatggtcccaagcctcggtttgacctgaccatgatgcccaggactggcactttttcttttttctcagcaaactgtacaaaaccaaatctctttttgattttcaaggaaactaggttcctgccaaattttgaatctggacaataaacagacactttgtcctagcatctttctggaatcatttcgggatattttccacaagcaacacagaaacaggaatgaaccggcagctagtgaacattttgacagccttgtttgcatttttcttagagacaaaccacttcaggacggctttctgcaaagaccatgactccaggtctggaaaacaaccttcacagaccctatctccttcagatttcttggacaagttaatgggaaggacatcaggatatgatgcaagaatcaggccaaattttaaaggtcctccagtaaacgttacttgcaatatttttatcaacagttttggatcagtcacagaaacgaccatggactaccgagtgaatatttttctgagacaacagtggaatgattcacggctggcgtacagtgagtacccagatgactccctggacttggacccatccatgctagactccatttggaaaccagatttgttctttgccaatgagaagggtgccaacttccacgatgtcaccactgacaacaaattgctacggatttcgaaaaatggcaaagtgctctacagtatcagactcaccttgaccttatcctgtcccatggacttgaagaactttccgatggatgtccagacctgtacaatgcagctggagagttttgggtacacgatgaatgacctgatatttgagtggttaagtgatggtccagtgcaagttgctgaaggattgaccctgccccagtttattttgaaagaagagaaggaacttggctactgtacaaagcactacaacactggaaagtttacctgcattgaggtcaagtttcacctggaacgccaaatgggatattatttgatccagatgtacatcccaagcctgcttatagtaattttgtcctgggtttccttttggataaatatggatgcagcccctgccagggtcgcactgggcatcaccacagtcttaacgatgaccacccagagttcaggctccagggcatctctgccaaaggtctcctatgtaaaagcgattgacatctggatggcggtgtgccttctgtttgtgtttgctgccttactggaatacgcagcggtgaacttcgtctccaggcaacacaaggagttcctgcgcctccgaagaagacagaagaggcagaataaggaagaagacgttactcgtgaaagtcgttttaattttagcggttatgggatgggtcactgcctccaagtgaaagatggaacagctgtcaaggccacacctgccaacccactcccacaaccgccaaaagatggagatgctatcaagaagaagtttgtggaccgggcaaaaaggattgacacgatatctcgagctgccttcccattggccttcctcattttcaacatcttttactggatcacatacaagatcattcggcatgaagatgtccacaagaaatagatgtgccctacagaccctgggaccttcttgcctcagtgttgtgcttgtaaatacacagtgaaattgtctttatatcactttgacagaggagaagattgagggaggggggag

SEQ ID NO: 62468 - DNA, 1096 bp, Homo sapiens
cacaaaaccaaacccatcagaagtttgcaggacgtccttgtttagagctgggaaataaaccacgaaacagcgcaaaggagagtccaggcctgccaatgcttccgcgaactcctcgccccgacctcatccttctccagctcctacctgcaggcctcaggcctcctgacctccaggctccttaccctcccgctggcctctgctctacactcatctttgtgccctgcttccaatcatgccaggcctcggggtccctgtctctaacttcaccatgagactcaggtgcttctctacactccaccctctccaacactgtttggaatctcaggcttggtcccaatcctatgggctaactttgaaaagaccgctgttcataaggagagagaaaggaggaagagatgagaaaggaagacagagaaagaaactctatgatcacggtttttccaaaattcatggttaaattagaacttactatgtgcaaatatagaagcacgggtccacagagttccagagaatgaatgctgacgactaagcaccagcctccactccctgccccatagtgagtatccctcctctgtgtgctcatgctgtgaatcccccccattctaccacttctcccctcatcactggcttgctgtaggatcagaagttccttaagaacaagaaccttctcccagtgtatccccagcacctaatacagaaggtaataaggaggaggcatctgctaaacgcttgttgaaggagtgaaattgagagaccaggaagggcctgcaggcactgtggtgagcctgcctgttgtccacgtggctgcagcaagcaaacatgggttttccttggaaggactgtgggccatcaacccattaattgccgagttgcttctatcagggcaaggctgtggaatcctgttatcctagacaatgaggtacagggtgcaagcagatctgtgtgctgctgtcttccggtaaacggaccaagttctcacttcccatcctcctccccagtctcacccacccgtgctcccaagagagcaattcatcatgtcagtgtctggtgttttcttgaaggcctgtgctaaataaagtggattgtttataaagtg

SEQ ID NO: 62469 - DNA, 368 bp, Homo sapiens
cacactcagcagcagccagatgaaaattatattaatcagcaataagaataaagccctttaatgggatttccaggtcttggctttggggtagcagtatagtctagtggataaatccatggtctatattgaaatacatactgtaacattggccaagttaattcaaagattgcttcctcatttgaaaaatgggagcaaaaataactacattgatttttataaaaataaggatgcatgctgtgtctgcatatcacttattaccactgtggtagcaattagcaacaatccataatttacagttgttattatgtgttaattttctttggctcttctccctgcctaaacaacaaataagaaaagaatgtaaatat

SEQ ID NO: 62470 - DNA, 1008 bp, Homo sapiens
tggcagtccagggagtgaaaaggttaatggaaacatgcaagggcagaccggaaagaaaatacatccaccaaagaggtggctgttgggggatatgagtgagtgaggtaagattcatctctgagttacaggtgaaggaagcccaggcaaacaggaaggcagaaatgagtccatggcatccaaagaatatgtggcagtccacatgtcatagctgtctgtaaaagtgagatgagccgcagcccgttcatctctccagtctccctggcaaccctgagtctccatggaattttggggacacagcttgaaaattgctttttatagaggcaaaataatggccttgcagccagctgggtttctattctaattctgatactattaaatgaccttaggcattttaacctctctgtatctagtttcttcatctgtgaaaaaggttgtgtaataatacctacctcatactgttgtgaggtttaagtgcaataacatataccaaacatatggcacatactaaatctttaggatgaggaaagatgtagggcaagaaagcaaaagcagaagttagaactggggaataaggtagagtcttacttgttttgttttgtttttttgagacagagtctcgttctgtcgcctaggctggggtgcagtggcgccatcatggctcactgcagccttgagcctcagtgagctatgagcttgaggctgcagtgagctatgatggtactactgccctccagcctgggcaacagagtaaggccctttatctaaaaacaaaaacaaaaaacttcttaaatctctcctgatgaaggacaggattggtttggggatgaggttgagcctgtagtataagtcagatggtcttgggtgtaaagattaaaaggcctggagggatggatgaccgaaggcagatttttgtcacaatgtttaggcccattttataatcttaattatggtagatataattgctgtatgacttttatcacctgagactttccacaacactgaaataaa

SEQ ID NO: 62471 - DNA, 629 bp, Homo sapiens
  misc_feature (566)..(566): n is a, c, g, or t
  misc_feature (584)..(584): n is a, c, g, or t
  misc_feature (589)..(591): n is a, c, g, or t
gatttagaatagtaattctatggttagattaattcaagccatattaattatttgaagattgtaatgcatgattctaatatgatgctcattcgattcacatttcccattacctctgaagagtacatatctccaaacggagttatttggaataagtcttttactgtgcacaagtttagaaaaaatttccaggaatttatcccaaaggaaaacccaatagaaacaaaaacaatttgtatttgcccacactagtgcatttctctgccttctgccagacattttttagatattctcaaatcaagttctcatttctgcctctggcatctcactgcaacagtaccagacattgatatagtctcgataactttcaaaagctttctttgtacatcgtcgggtcggatctgtgcaattattttgtgggtttaaaaatgcttctctacctaaatgtaagctcctagagggaagaactttgtctatcttgcctacttttgtatcttcagaattcagaaacgtgtctggtacgtagaaaatgtcattaaccatttgttgaattctgtagatgaggccgnctgttagcgcataagggnttttnnntttttgtctccctaatttgccgctctccccttcccccc

SEQ ID NO: 62472 - DNA, 322 bp, Homo sapiens
ggaataaaatgcctacacagaagcctctatctaacagtcctgctgggtggggcattacaaagagaggccacaggaaaacctttgagagtttggagcctgctgcgtgagagagataaaagtagaaacagcaaattggctgcaatacgaatggcaggtgcatttgttcactggaggcaagtttggcaatttagttttcaatgaccagcttgtctctttaaggttcacctttcaaagtcctcctttttgccctcaacatacatcgctaaagccctgtctcatcttgagtccccacgctccaggtaacagcagctctttactctgc

SEQ ID NO: 62473 - DNA, 451 bp, Homo sapiens
attgataaggttttagctgtaaaaaaacttggatgctgtcattccaggccttagaacaataaagagccgaacaaaatatcagtgacttttcatggacccatcagataactgaagatacaagaaaaactgccacaatgaaatctggagactcaggcacatccagagagatacagacagcatccgcttacctggagcagcagctgttagagccacacaaaggaatatttacattgaaattttggtgatttgctgaaggctgagagtgagagtgagaaactcttggaggctatagttcaaaagtctccccctacattcttatattttagttcataaacccaccgatctgattgacaagaaaaatccccataggcttctggcagggaaaggggaaaagtaaccattctgaaatatacccagatttttctccacaaggaagccctatttgtcaaag

SEQ ID NO: 62474 - DNA, 882 bp, Homo sapiens
gcttgtcttaggacctcatggatcccagggggaccaagagaggagctgagaagacagaggtagctgagcctcggaacaaactacctcgtccagcaccttctctgcccacagaccctgccctctactctgggccctttcctttctaccggcgcccttcggaactgggctgcttctccctggatgctcaacgccagtaccatggagatgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggggtccaggctggctggcagaggccatagtgacgtggcgggggcacctgacaaaactgctgacgacaccgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcaggtgagttgcccctgcttcatagcccccttccccttcccagaggttgagagccccccacgcctgctgctgcttctctccttgtgcagacaaacctggaagctccccagacccctctggggaggttaacaccaacgtggccttctgctctgtgctacgcagccgcctgggaagccaccctctgctcttctcaggggaggtagactgcacagacccccaagccccatccacacagcccccaacctgctatgtggagctcaagacctccaaggagat

SEQ ID NO: 62475 - DNA, 475 bp, Homo sapiens
tgaaaaattaagtcacacataaatttctattatagcttctggtaactccttcctaaaagtcttctcagctaatgtggaaaattctagcttctcttttcattttttgagacagggactggctcagtcacccagactggagtgctgcggcatgatcatggctcactgcaggcttgacctcccaggctccagcaatcctctcatgtcagcctcccaggtagctgggaccaacaggctcgcaataccgcatgtgactaatttttgtattttttgtagagacggggtttcaccatgcagcacaggctggtcttgaactcctgggctccagcaatcctcccacctcggtctcccaaagtgctggagccactgcccccagcctgatttctcttttctatctttactccatttatccacttacatacctttacctttcaccaataaaatgtactaatctttgatatggatatgttacataaag

SEQ ID NO: 62476 - DNA, 226 bp, Homo sapiens
gatctgcctgcctcagcctcccaaagttctaggattacaagcatgagccaccgtgcccagctggggatcacaggcgtgagtcaccatacctggcccaccccacttttgttttgtttttcttgttttaaattggtttgtttatttatttatttatttatttttcgagacggagtctcgctgtgttgcccaggctggagtgcaatggtgccatctccgctcactgcaa

SEQ ID NO: 62477 - DNA, 536 bp, Homo sapiens
  misc_feature (302)..(302): n is a, c, g, or t
  misc_feature (416)..(416): n is a, c, g, or t
caaagccctcacacagcaatagttagggatctcggggtaattcaccaggttgttcttacagtgcctcttccataatgggaaagcagcaagcctttgggaaattttagcttctcctgtgaagaaaaactgtgcatcagcttttgtgacctgttacaggctaaggagaaaccttcattcgcccataccagaagcttccctgtgccctgtttgcattttccagaatgcagaatgaagatattggagcgaactgttctgcttgccaactagtgagaaggtgttaaaaaaaaaaaaaaaaaactcgnactctgccgaattcggcacgagcggcacgagcgatggagcagcagtacccacccatgaaaaccatgaaggggccttttggctgaaattccccacctgcctttggatgaaagacnccgttgggaataaatggccaaagcttataggactctgtgacaggttgtgaatgttttttttgttgttgttgttgtttttaattgctgttaatattttttaaataataaagaaacaaaact

SEQ ID NO: 62478 - DNA, 254 bp, Homo sapiens
gcagacagctgcgtaaaacagattatcagtggaaggtatggcagttccaaggcctgacctgcaaagtcagtcgggaaaagggtgcggtcagaaccagcacagctggaaggtcacccacagaataaaagttgccaactggatgtgttcctctaagacaactttgcaatgacacagaagcacagccatggtcaagagatggccagaaggaggtggtgaggagctgagagaggtccttggtgatcctcaacctacaa

SEQ ID NO: 62479 - DNA, 394 bp, Homo sapiens
ctccacatgttatgtcatttcttctgtttgaaatgactctccatctattcagttcaaatctgaatctgccttattttgaggcctggcccaaatgccaccttcttcagtgagcctatgtttagagtcctttccacactatacttgtggtataatgactcatgtgtttatcgtcccttttataataatagtaacttaagggaaagaaatcattttttgctctggctacatgcaaatagaacaactaattgttattggggtgggggaggaatttaggtgagaggaaggtgaacataaaaatacatgctgaaggaataaatgccatctcacaagccattgctaagcagaatggtgaatggtacgtaacaggacccttggaaaacagggtgtgataaaa

SEQ ID NO: 62480 - DNA, 373 bp, Homo sapiens
cattctttattcaattgccttagcaacaatttttacagagcttctctgaacttggagtaacgaatctggagcgaaattttcctcattataattattctacaatctttccctccaagtggttttaagtggctagggctgaagaagagagcccaggcatgtacacagcatgatgctgagctcctgcaggagagaagggcagcctgtctttccatcacactacccttccccaggagggaagagcgggctctgctcctccccaagggcagctggttaatgaggccggacgctgggccccgtggagctcactgctggtgcccgccctgctgtattcacacagctactgatctcagcctctcgagcatcttacatttca

SEQ ID NO: 62481 - DNA, 268 bp, Homo sapiens
gaagtataaacttttcttttgccacaaaattaatttgaaacatatcctaagctttttggtaagtcattggacttcatatttgaactggtgatagggttgtatgtaaccaaaccttgagatcatacagtgagctgtgtttaattataactcattattgtaattaatcttacattgtagaacttgacgtctcgtttttctttttaaaaattgggcaagtagctgtgcagtggctcatgactgtcatcccagctacttgggagactgagca

SEQ ID NO: 62482 - DNA, 423 bp, Homo sapiens
gtctttgagttcagccaccttggctctgcagcggcccccatggtgctcatctcagacatcttcatgcccacatctggaagtccagtttggattttaagaaaaatcttctttatctctgtttaccacgtctcatgtttcttctggctttctggatgggtgggatacaggtagcctgacttaaaatgtcatctactaattctgccattcggccatttatgggacttttcctgtggatcgatttgactcctaggaagggattattttcctttcttccttgaacacgtggtgatctttgattacaagcaaaacactgtgacctcttggctttgtgctgatgcacacacaggcacacgtgcacatgcatacacacacacatgcacacatgcacatgagttttgtgagccagcagtgctgtgcatgcac

SEQ ID NO: 62483 - DNA, 140 bp, Homo sapiens
ctttcgactgcttttgttctttatagaaatggagttgtgcagtatgtgctcctttttaatctagcatctttcttttgaattgtttatgacatttatctgtatattttgagtggtcataattcatttgcattattgattaa

SEQ ID NO: 62484 - DNA, 318 bp, Homo sapiens
ctccacagttcattgttcagggcaggtgacaaggccagccccaggggaacggaaatagactctcgccgttcattggaagcactgtctgcatgtacagtgatgggaggaaactctggcagtcctatttctggccaactatccaaacatattttccattatctgtatgcatttctgacgggaaaaaagaaaaatatatctttaggcaaaaatatagcatattggaagagaaccaggaggagtgaaaacatttggactttaatgatgtctttgatactcagtatttgaatgatcttgttggaataaatgatttcatttggc

SEQ ID NO: 62485 - DNA, 1194 bp, Homo sapiens
actcttttcagattcacgttctctaacaaagagtctcatgttcaagatcaatatgtctaataagtgctggtgtccttttaaagtatttaaatatatatgttgctgttgctgaatacaggagaccaggttaggaatatagtttcataataatagtacatacaatactaattgtatataaggtagcaaccaaaagaggttgttaattagcacatattccttttagaaaaatgtttcagaaacctcagtcttgatatctgagctatctgggctcccttacttgtgagtaagggatcatgctcaccactggagaagcttacaccgggactttttttcttttttcttttttttttgctatgacagagtaatgctaacgtaaggacaactgagtttgatcagtgtttaatcgcagtgggtaatcttatctgattgtctttaaaagtgaaaaggattaagattttattctttcttgtaaacattacttgattttttaaagaagttttgggctcactgctaaaatagagtatacaactgaatgtttttaagtcaagatactgttttaggagtttaccctctcatttataaccaaagttgctctaaaacactttccaaatatctgcacttctgatgtcagaatcaaaccagataattctctaattcttctttaatctaaagtagatagcttcccactggaaagtaaacaaaaccatccctcccaacctcaaagctaggccacactctatttcaaggcattttctttcagctgataaggtgtcctcctgaagccaagtaggtggttctggtctccaagtatcgttaagcacaggtgctatgacagaaaaagttctggggtggaagttttaagatgaggagttctgatcttaggcatcttaacagtcacaaggtgaaaagtcaaatgaaacagtacaattcttgatgagtgaggtgtcatcttccaaccacacagaggacgttttggctatgatcatctgatggcaagtgaaggagaaatgagtgatagggctttgcgttttcatccagatgctgtggccctgtgtttcacagcattaagagccataatttccaacctgcacagatcctgaacaacaaatgaataacgatgaatgtctttttggttgtaatttaacaagtcaaataaaataatcattgctgagcacaatcacatgttgaaacaag

SEQ ID NO: 62486 - DNA, 2006 bp, Homo sapiens
ggcggcatggggtctgtagacatccaggtagctgtggctgaggagaaagggcctctccaacatgacatcctcctgctgtgtcaccaacaacttgcaagcctctctcaagagctgcccccggcctgcctcggtctgttccagcggcgtgaactgccggcctgagctgtgcctgggctatgtctgccagcccatggcatgcctgccttcggtctgcctgcccaccaccttccggccagccagctgcctctccaaaacctatctatccagttcctgccaggcagccagtggcatctccggctccatgggccccggcagctggtacagcgaaggggccttcaatggcaatgagaaggaaaccatgcagttccttaacgaccgcctggccagctacctgacgagggtgcggcagctggagcaggagaatgcggagctggagagcaggatccaagaggcctctcactcccaggtgctcaccatgactcctgactaccagtctcatttcaggaccattgaggagctccagcagaagattctgtgtaccaaggcagagaatgccaggatggttgtgaacattgataatgccaaactggctgccgatgacttcagggccaagtacgaggcagagctggccatgcggcagctggtggaggccgacatcaatggcctgcgcaggatcctggatgatctcactctgtgcaaggctgacctggaggcccaggttgagtccctgaaggaggagctgatgtgcctcaaaaagaaccatgaggaggaagtcggttcccttcgatgccagcttggggaccgccttaacatcgaggtggacgctgcacccccggtggacctgaccagggtgctggaggagatgcggtgtcagtacgaggccatggtggaggccaaccgcagggacgtggaggaatggttcaatatgcagatggaggagcttaaccaacaggtggccacaagctctgagcagcttcagaactaccagtcagacatcattgacctgagacgcacggtcaacacgctggagatcgagctgcaggcccagcacagcctgagggactccctggaaaacacgctgacggagagtgaggcccgctacagctcccagctggcccagatgcagtgcatgatcaccaacgttgaggcccagctggctgagatccgggctgacctggagcggcagaaccaggagtaccaggtgctgctggacgtccgggcccggctggagggcgagatcaacacgtaccggagcctgctggagagcgaggactgcaagctgccctgtaacccatgctccactccttcctgcaccacctgtgtgccctccacatgcatgcacccgcaccgtctgtgtgccacgcactgttggcatgccttgctcaccctgcccccagggccgctactgaagtccctttgtgccagtggatcctggagggcctggggctgggcagcctggtattcagtggccaccagaagagcagggccagccccggtcagcaaggaagaccctgagcaggaccgtggatcacctgcaacaagctctgatactccaggggatacttaagccctcatcacttcaaaactgcctcttttttccatgggtgaactgttctctttggtgatgtttctggttgtctgtgctgcctcaaagagcgtgtgttcttagttaactggcaaatagagctgtactcagtggccttgcaaacatgtctgtctctgtttgtcacttacgctgctgcatccacaagccaatcctactcaattgggcttaagaggaacgtgggcaaattctgtatttatttttatgctccttctgcttccatagaggcttgagaggtgttcactaaaagggcccgcatgccataaaccagttaaaactaatcaattactctagagccaagtaataaaagaataaagagaggagggagataattatgccagaaacctaggccaaattactgtaattgagaatcatatcataataaacccacccctaaatctca

SEQ ID NO: 62487 - DNA, 1358 bp, Homo sapiens
ttattttactttaacttctgggatacatgtgcagaacgtgcaggtttgttacataggtgtacatgtgccatggtggtggtttgttgcctatcaacccgtcatctaggttttaagccctgcatgcattagatatttgttttaattttctccctccctgctcccctcacctctcgacaggccccagtatatgatgttcccctccctgtgtccatgtgttctcattgttcaactctcacttatgagtgagaacatgtagtgtttggttttctgttcctgtgttagtttgctgagaatgatggcttccagaggaagctgcttttcatcctgagctcaaatggaagccactgaaggttttagggaggggagggacataattggatttgtgactgtagaagattgctctggctactaagtggacagtggttaggaggggcccaagtggggttggggagatcagttaggaggccatgaggtgactcaggcaaagatggcggaggttgggaccagggaggctgggcagagaaagcacggaagatggggttgagaggcatccgaggggagaattggcaggacctgtggccgagtgggccttctctactaatcctgtttctctttgactttctcctgcaggctgccctgtaacccatgctccactccttcctgcaccacctgtgtgccctccacatgcatgcacccgcaccgtctgtgtgccacgcactgttggcatgccttgctcaccctgcccccagggccgctactgaagtccctttgtgccagtggatcctggagggcctggggctgggcagcctggtattcagtggccaccagaagagcagggccagccccggtcagcaaggaagaccctgagcaggaccgtggatcacctgcaacaagctctgatactccaggggatacttaagccctcatcacttcaaaactgcctcttttttccatgggtgaactgttctctttggtgatgtttctggttgtctgtgctgcctcaaagagcgtgtgttcttagttaactggcaaatagagctgtactcagtggccttgcaaacatgtctgtctctgtttgtcacttacgctgctgcatccacaagccaatcctactcaattgggcttaagaggaacgtgggcaaattctgtatttatttttatgctccttctgcttccatagaggcttgagaggtgttcactaaaagggcccgcatgccataaaccagttaaaactaatcaattactctagagccaagtaataaaagaataaagagaggagggagataattatgccagaaacctaggccaaattactgtaattgagaatcatatcataataaacccacccctaaatctca

SEQ ID NO: 62488 - DNA, 955 bp, Homo sapiens
gataaatcgagctcgtgacccggccccatgcacagttcggtccatgcacagttttcagtaaatgtcaaagacccttctaactgtcacatgagtgacttcagacatgagattcttcccttccacattgcttggcacatccaaaatggggaatttgaatttacgaagcttcaggttcttaaaaaatacatctcaagttctccaaggactagcaattcgctaaatatctcccagagttccagggaagaggaccttctgcagggatggctgcagggctgctggatcctacctttgctgctgtcttctcttcatttgggttcttcttgcttcgtctcatcctgaactaaccctctccatgtgccttggcctacagattctgtgtaccaaggcagagaatgccaggatggttgtgaacattgataatgccaaactggctgccgatgacttcagggccaagtgagttcagtcggggggctggagctggggaggacctgtcctcataggctctggggcaactttccattagtttcacggagggttggaaagtgccggcagtttaaggccttccctgagttctgcattctgtttcacccttggttgctgaccctgtccttgtgcaggtacgaggcagagctggccatgcggcagctggtggaggccgacatcaatggcctgcgcaggatcctggatgatctcactctgtgcaaggctgacctggaggcccaggttgagtccctgaaggaggagctgatgtgcctcaaaaagaaccatgaggaggtgaggctggaagtcccgctgaagtggccccgggaagcagagggggaggaacgtggggtatggggttggataggcgtgggttgaaattcccaagcctgccacatgttgttttagtgactttgcccaatttatggaatcttcctgagcctcctcttctgtaaaatggggacaacatgatcac

SEQ ID NO: 62489 - DNA, 1392 bp, Homo sapiens
gataaatcgagctcgtgacccggccccatgcacagttcggtccatgcacagttttcagtaaatgtcaaagacccttctaactgtcacatgagtgacttcagacatgagattcttcccttccacattgcttggcacatccaaaatggggaatttgaatttacgaagcttcaggttcttaaaaaatacatctcaagttctccaaggactagcaattcgctaaatatctcccagagttccagggaagaggaccttctgcagggatggctgcagggctgctggatcctacctttgctgctgtcttctcttcatttgggttcttcttgcttcgtctcatcctgaactaaccctctccatgtgccttggcctacagattctgtgtaccaaggcagagaatgccaggatggttgtgaacattgataatgccaaactggctgccgatgacttcagggccaagtgagttcagtcggggggctggagctggggaggacctgtcctcataggctctggggcaactttccattagtttcacggagggttggaaagtgccggcagtttaaggccttccctgagttctgcattctgtttcacccttggttgctgaccctgtccttgtgcaggtacgaggcagagctggccatgcggcagctggtggaggccgacatcaatggcctgcgcaggatcctggatgatctcactctgtgcaaggctgacctggaggcccaggttgagtccctgaaggaggagctgatgtgcctcaaaaagaaccatgaggaggaagtcggttcccttcgatgccagcttggggaccgccttaacatcgaggtggacgctgcacccccggtggacctgaccagggtgctggaggagatgcggtgtcagtacgaggccatggtggaggccaaccgcagggacgtggaggaatggttcaatatgcaggtgggcctctcacggtggggatggcctcctcgatatccctaagactagggactctagccttctccttcccccaactgcagatggaggagcttaaccaacaggtggccacaagctctgagcagcttcagaactaccagtcagacatcattgacctgagacgcacggtcaacacgctggagatcgagctgcaggcccagcacagcctgagggactccctggaaaacacgctgacggagagtgaggcccgctacagctcccagctggcccagatgcagtgcatgatcaccaacgttgaggcccagctggctgagatccgggctgacctggagcggcagaaccaggagtaccaggtgctgctggacgtccgggcccggctggagggcgagatcaacacgtaccggagcctgctggagagcgaggactgcaagtacgcaggcccagctgaggcttagagag

SEQ ID NO: 62490 - DNA, 1401 bp, Homo sapiens
gttgcatcttttcatgtctccctggggaggtgagccaggatcctatcattgtcacatttttctggaggtcttgtgccttttcaggaagtcggttcccttcgatgccagcttggggaccgccttaacatcgaggtggacgctgcacccccggtggacctgaccagggtgctggaggagatgcggtgtcagtacgaggccatggtggaggccaaccgcagggacgtggaggaatggttcaatatgcaggtgggcctctcacggtggggatggcctcctcgatatccctaagactagggactctagccttctccttcccccaactgcagatggaggagcttaaccaacaggtggccacaagctctgagcagcttcagaactaccagtcagacatcattgacctgagacgcacggtcaacacgctggagatcgagctgcaggcccagcacagcctgagggactccctggaaaacacgctgacggagagtgaggcccgctacagctcccagctggcccagatgcagtgcatgatcaccaacgttgaggcccagctggctgagatccgggctgacctggagcggcagaaccaggagtaccaggtgctgctggacgtccgggcccggctggagggcgagatcaacacgtaccggagcctgctggagagcgaggactgcaagctgccctgtaacccatgctccactccttcctgcaccacctgtgtgccctccacatgcatgcacccgcaccgtctgtgtgccacgcactgttggcatgccttgctcaccctgcccccagggccgctactgaagtccctttgtgccagtggatcctggagggcctggggctgggcagcctggtattcagtggccaccagaagagcagggccagccccggtcagcaaggaagaccctgagcaggaccgtggatcacctgcaacaagctctgatactccaggggatacttaagccctcatcacttcaaaactgcctcttttttccatgggtgaactgttctctttggtgatgtttctggttgtctgtgctgcctcaaagagcgtgtgttcttagttaactggcaaatagagctgtactcagtggccttgcaaacatgtctgtctctgtttgtcacttacgctgctgcatccacaagccaatcctactcaattgggcttaagaggaacgtgggcaaattctgtatttatttttatgctccttctgcttccatagaggcttgagaggtgttcactaaaagggcccgcatgccataaaccagttaaaactaatcaattactctagagccaagtaataaaagaataaagagaggagggagataattatgccagaaacctaggccaaattactgtaattgagaatcatatcataataaacccacccctaaatctca

SEQ ID NO: 62491 - DNA, 1046 bp, Homo sapiens
  misc_feature (1)..(1): n is a, c, g, or t
ntagaaggatccccctgggtgtatgtgcaccactgaaggttttagggaggggagggacataattggatttgtgactgtagaagattgctctggctactaagtggacagtggttaggaggggcccaagtggggttggggagatcagttaggaggccatgaggtgactcaggcaaagatggcggaggttgggaccagggaggctgggcagagaaagcacggaagatggggttgagaggcatccgaggggagaattggcaggacctgtggccgagtgggccttctctactaatcctgtttctctttgactttctcctgcaggctgccctgtaacccatgctccactccttcctgcaccacctgtgtgccctccacatgcatgcacccgcaccgtctgtgtgccacgcactgttggcatgccttgctcaccctgcccccagggccgctactgaagtccctttgtgccagtggatcctggagggcctggggctgggcagcctggtattcagtggccaccagaagagcagggccagccccggtcagcaaggaagaccctgagcaggaccgtggatcacctgcaacaagctctgatactccaggggatacttaagccctcatcacttcaaaactgcctcttttttccatgggtgaactgttctctttggtgatgtttctggttgtctgtgctgcctcaaagagcgtgtgttcttagttaactggcaaatagagctgtactcagtggccttgcaaacatgtctgtctctgtttgtcacttacgctgctgcatccacaagccaatcctactcaattgggcttaagaggaacgtgggcaaattctgtatttatttttatgctccttctgcttccatagaggcttgagaggtgttcactaaaagggcccgcatgccataaaccagttaaaactaatcaattactctagagccaagtaataaaagaataaagagaggagggagataattatgccagaaacctaggccaaattactgtaattgagaatcatatcataataaacccacccctaaatctca

SEQ ID NO: 62492 - DNA, 2091 bp, Homo sapiens
gataaatcgagctcgtgacccggccccatgcacagttcggtccatgcacagttttcagtaaatgtcaaagacccttctaactgtcacatgagtgacttcagacatgagattcttcccttccacattgcttggcacatccaaaatggggaatttgaatttacgaagcttcaggttcttaaaaaatacatctcaagttctccaaggactagcaattcgctaaatatctcccagagttccagggaagaggaccttctgcagggatggctgcagggctgctggatcctacctttgctgctgtcttctcttcatttgggttcttcttgcttcgtctcatcctgaactaaccctctccatgtgccttggcctacagattctgtgtaccaaggcagagaatgccaggatggttgtgaacattgataatgccaaactggctgccgatgacttcagggccaagtgagttcagtcggggggctggagctggggaggacctgtcctcataggctctggggcaactttccattagtttcacggagggttggaaagtgccggcagtttaaggccttccctgagttctgcattctgtttcacccttggttgctgaccctgtccttgtgcaggtacgaggcagagctggccatgcggcagctggtggaggccgacatcaatggcctgcgcaggatcctggatgatctcactctgtgcaaggctgacctggaggcccaggttgagtccctgaaggaggagctgatgtgcctcaaaaagaaccatgaggaggaagtcggttcccttcgatgccagcttggggaccgccttaacatcgaggtggacgctgcacccccggtggacctgaccagggtgctggaggagatgcggtgtcagtacgaggccatggtggaggccaaccgcagggacgtggaggaatggttcaatatgcaggtgggcctctcacggtggggatggcctcctcgatatccctaagactagggactctagccttctccttcccccaactgcagatggaggagcttaaccaacaggtggccacaagctctgagcagcttcagaactaccagtcagacatcattgacctgagacgcacggtcaacacgctggagatcgagctgcaggcccagcacagcctgagggactccctggaaaacacgctgacggagagtgaggcccgctacagctcccagctggcccagatgcagtgcatgatcaccaacgttgaggcccagctggctgagatccgggctgacctggagcggcagaaccaggagtaccaggtgctgctggacgtccgggcccggctggagggcgagatcaacacgtaccggagcctgctggagagcgaggactgcaagctgccctgtaacccatgctccactccttcctgcaccacctgtgtgccctccacatgcatgcacccgcaccgtctgtgtgccacgcactgttggcatgccttgctcaccctgcccccagggccgctactgaagtccctttgtgccagtggatcctggagggcctggggctgggcagcctggtattcagtggccaccagaagagcagggccagccccggtcagcaaggaagaccctgagcaggaccgtggatcacctgcaacaagctctgatactccaggggatacttaagccctcatcacttcaaaactgcctcttttttccatgggtgaactgttctctttggtgatgtttctggttgtctgtgctgcctcaaagagcgtgtgttcttagttaactggcaaatagagctgtactcagtggccttgcaaacatgtctgtctctgtttgtcacttacgctgctgcatccacaagccaatcctactcaattgggcttaagaggaacgtgggcaaattctgtatttatttttatgctccttctgcttccatagaggcttgagaggtgttcactaaaagggcccgcatgccataaaccagttaaaactaatcaattactctagagccaagtaataaaagaataaagagaggagggagataattatgccagaaacctaggccaaattactgtaattgagaatcatatcataataaacccacccctaaatctca

SEQ ID NO: 62493 - DNA, 2301 bp, Homo sapiens
aaagagacttccctagggcatagggttattttataatttgagcactcagcctgaggctttcatgtggagagatctgggatctagtctcagttctaccattgcctcattgcatgactttgggggtcccatcccttccccaggcctcagttttctcatctgtaaaacagggataataatggtcgttatctaatggggttgtcaaaaggatttgatgagatgatgcaggtcaagtgcttggaacagcccctggtccacggtaagttttcagtaaatgtcaaagacccttctaactgtcacatgagtgacttcagacatgagattcttcccttccacattgcttggcacatccaaaatggggaatttgaatttacgaagcttcaggttcttaaaaaatacatctcaagttctccaaggactagcaattcgctaaatatctcccagagttccagggaagaggaccttctgcagggatggctgcagggctgctggatcctacctttgctgctgtcttctcttcatttgggttcttcttgcttcgtctcatcctgaactaaccctctccatgtgccttggcctacagattctgtgtaccaaggcagagaatgccaggatggttgtgaacattgataatgccaaactggctgccgatgacttcagggccaagtgagttcagtcggggggctggagctggggaggacctgtcctcataggctctggggcaactttccattagtttcacggagggttggaaagtgccggcagtttaaggccttccctgagttctgcattctgtttcacccttggttgctgaccctgtccttgtgcaggtacgaggcagagctggccatgcggcagctggtggaggccgacatcaatggcctgcgcaggatcctggatgatctcactctgtgcaaggctgacctggaggcccaggttgagtccctgaaggaggagctgatgtgcctcaaaaagaaccatgaggaggaagtcggttcccttcgatgccagcttggggaccgccttaacatcgaggtggacgctgcacccccggtggacctgaccagggtgctggaggagatgcggtgtcagtacgaggccatggtggaggccaaccgcagggacgtggaggaatggttcaatatgcaggtgggcctctcacggtggggatggcctcctcgatatccctaagactagggactctagccttctccttcccccaactgcagatggaggagcttaaccaacaggtggccacaagctctgagcagcttcagaactaccagtcagacatcattgacctgagacgcacggtcaacacgctggagatcgagctgcaggcccagcacagcctgagggactccctggaaaacacgctgacggagagtgaggcccgctacagctcccagctggcccagatgcagtgcatgatcaccaacgttgaggcccagctggctgagatccgggctgacctggagcggcagaaccaggagtaccaggtgctgctggacgtccgggcccggctggagggcgagatcaacacgtaccggagcctgctggagagcgaggactgcaagctgccctgtaacccatgctccactccttcctgcaccacctgtgtgccctccacatgcatgcacccgcaccgtctgtgtgccacgcactgttggcatgccttgctcaccctgcccccagggccgctactgaagtccctttgtgccagtggatcctggagggcctggggctgggcagcctggtattcagtggccaccagaagagcagggccagccccggtcagcaaggaagaccctgagcaggaccgtggatcacctgcaacaagctctgatactccaggggatacttaagccctcatcacttcaaaactgcctcttttttccatgggtgaactgttctctttggtgatgtttctggttgtctgtgctgcctcaaagagcgtgtgttcttagttaactggcaaatagagctgtactcagtggccttgcaaacatgtctgtctctgtttgtcacttacgctgctgcatccacaagccaatcctactcaattgggcttaagaggaacgtgggcaaattctgtatttatttttatgctccttctgcttccatagaggcttgagaggtgttcactaaaagggcccgcatgccataaaccagttaaaactaatcaattactctagagccaagtaataaaagaataaagagaggagggagataattatgccagaaacctaggccaaattactgtaattgagaatcatatcataataaacccacccctaaatctca

SEQ ID NO: 62494 - DNA, 626 bp, Homo sapiens
gaccccgaccagaagatagagattgaaacgatgaggaaaacgaagtgcctaatccccgctggacgctaactgcaggcacccagaaatactctccacaccatgctgcactgctgcggatgagggaaggatggtgtcggggcttcaagactgtttttcctacctcttcagtgcctctttcagtgatatgaagttaaaaccaggaacatggaggagacatatttccacctatttctctccataagtataaaagaccataaaagaccatctagggacttcagaacccaaataatgacacaatgttaatttgcaggttctccctctgcctgccaccccacccagcaaggaggagaggaagtgttgagaagggaagagatgagtcctggccctgtcacttcttaggggtgtgcttttgaacaacctgctcaccatgtatgaacttcactcttcttgtttataaaatgaggacaatgacacctgcaagactgtgaggtttaaaaacaaaatctgtgttgagaggtaacttgcctcttttacttaccaatgatttcctcaatgcctggtgactggggctggttcatactagacgatcaataaatgctccttgacctcaaaaacccccccctctc

SEQ ID NO: 62495 - DNA, 841 bp, Homo sapiens
gaccccgaccagaagatagagattgaaacgatgaggaaaacgaagtgcctaatccccgctggacgctaactgcagggcaagctccccagtgttgtagttgtgtttcggaggccgagaaccgctatcgggcttcctcggactctggccctggaggggggaaacggcgagggagaaggcgaaacgagtctccagtgtgttcttggggcctggtgcgaggcccagagaattctctgcaggcctttgcccgggcactgattaaggctgcgaagagacgcaccgggctgcgggcttagtagcttcaggcttctgaagtcagagggagggctgagagcttacacttctggagctccccgggagacggcaactacccaaccgtgtgggtgtgtttgtcacccagaaatactctccacaccatgctgcactgctgcggatgagggaaggatggtgtcggggcttcaagactgtttttcctacctcttcagtgcctctttcagtgatatgaagttaaaaccagttaatttgcaggttctccctctgcctgccaccccacccagcaaggaggagaggaagtgttgagaagggaagagatgagtcctggccctgtcacttcttaggggtgtgcttttgaacaacctgctcaccatgtatgaacttcactcttcttgtttataaaatgaggacaatgacacctgcaagactgtgaggtttaaaaacaaaatctgtgttgagaggtaacttgcctcttttacttaccaatgatttcctcaatgcctggtgactggggctggttcatactagacgatcaataaatgctccttgacctcaaaaacccccccctctc

SEQ ID NO: 62496 - DNA, 438 bp, Homo sapiens
ccaaggaatgacaaatcctggaaagcagcatggaacaggttttccctcacagcgcttagaaggaaccaatcctgccaacaacttgatcttggacttctatcttctagaactttaatttgcaggttctccctctgcctgccaccccacccagcaaggaggagaggaagtgttgagaagggaagagatgagtcctggccctgtcacttcttaggggtgtgcttttgaacaacctgctcaccatgtatgaacttcactcttcttgtttataaaatgaggacaatgacacctgcaagactgtgaggtttaaaaacaaaatctgtgttgagaggtaacttgcctcttttacttaccaatgatttcctcaatgcctggtgactggggctggttcatactagacgatcaataaatgctccttgacctcaaaaacccccccctctc

SEQ ID NO: 62497 - DNA, 1036 bp, Homo sapiens
cgccccttccaaacgcccccgtctccggggacatcccgacgcgcccaccatgggaaaagacaggccaaacggcgcccgcggatcccgaacgtaacacggccgcttgagctggcccgccgaggaagagttgaagatgagaaccgaaggccaatcccgctgacgctaactgcaggcaagctccccagtgttgtagttgtgtttcggaggccgagaaccgctatcgggcttcctcggactctggccctggaggggggaaacggcgagggagaaggcgaaacgagtctccagtgtgttcttggggcctggtgcgaggcccagagaattctctgcaggcctttgcccgggcactgattaaggctgcgaagagacgcaccgggctgcgggcttagtagcttcaggcttctgaagtcagagggagggctgagagcttacacttctggagctccccgggagacggcaactacccaaccgtgtgggtgtgtttgtcacccagaaatactctccacaccatgctgcactgctgcggatgagggaaggatggtgtcggggcttcaagactgtttttcctacctcttcagtgcctctttcagtgatatgaagttaaaaccaggaacatggaggagacatatttccacctatttctctccataagtataaaagaccataaaagaccatctagggacttcagaacccaaataatgacacaatgttaatttgcaggttctccctctgcctgccaccccacccagcaaggaggagaggaagtgttgagaagggaagagatgagtcctggccctgtcacttcttaggggtgtgcttttgaacaacctgctcaccatgtatgaacttcactcttcttgtttataaaatgaggacaatgacacctgcaagactgtgaggtttaaaaacaaaatctgtgttgagaggtaacttgcctcttttacttaccaatgatttcctcaatgcctggtgactggggctggttcatactagacgatcaataaatgctccttgacctcaaaaacccccccctctc

SEQ ID NO: 62498 - DNA, 1101 bp, Homo sapiens
cttttcaggatgctgcaaagattaagtgaggaacatcacgtggtttctcgttggcatgaagcaaacattagttccctttgctgttctcatttgaacatgcatattttgggggattctagccagggtggcattgaggactcacaccatggtccacttgttacttgacccctgcaagtgcccagcgagaggctcaacaaacaacaaacagtgcatcccttagaaaaagagcagggtgggtgcgggaatcctaaacgtcccaacctgaccactcaggcacgcctgcccagagcctcctgggttcccaagtctctgacctaagggcagaagtcacagatctgccaaaccacacagaagaaagccagtgagaaacatttagaggtgtcaccaggcgccagggtcttattggtgtgtgaccgccgggcaccacccatgcacagaggtcactagcgttcagtgagcgcctcgttcacacctaccttgagtctggcattttaccagcatagtaggaacttggtatggttacctcctagaaacttcacttccaccctccaaggtggggctgttctgaccctgatctgttggaagaggaaccctggcaggggagtagcagatgcacaattcaaacccaggtctcctgatccaatgcccagggtttttcatttgttttcattttaccgtgctacaggaaggagcaagaacaagagcccaggtaaaggaatttgcaagtctggccggcatggaaagcaaactcctttcttcattttgcccccacttgttcagtttgcccctatttgttcagtttgccccgggttaaaggtcaagttcatttggggatgaggaaagtcttcactgatctccagctgtctagtgtgggacactcagggaaagggctgggtaaaagaaatacaaccaagctagagaaagtttcagaaggaaaaaatatcacatattcctacctcctcgagagccaggaaaagaagccttatcatcacctgattgctttttccatgtgataggaatgaccggactttctttggaccacccctttattaatcttgattatgtacaataaagataaaaactttgtagccaaccaccaag

SEQ ID NO: 62499 - DNA, 659 bp, Homo sapiens
gttagaggatcccgcttgctgggaagaggggagggtggtcaggaacagcacagtgctcagccagagcttcggccttggttgcgccagcctggtggccagtggtggtggagactgaggaagaggaagaggaagacgctcaccagttctgctgtccggcctccgagtgcagtagtccctcctctcggtaactgagaggacaagggccattttctatgcagaagcaaaagccttaaccagcccctccttccccagccgatgtggtgaggaccaggtgtcaaacctggagcagggacagggcagcaaggatgggagggcgaggaggctctggtgtagggcagtgagaagagtggggcaggccaggccctcagcagtggccgggtttggtgcggggccttgggggagtctgctccagatctgtccccagcacagcagtgaccagaatctcataaaagcaagagggcccggaccccgcctcgggcttgaaaggggcatctgagccccggagcaatcgaaggcaggatctgggggctctcaagctctgaggggtgtggcgggagatgggattgggaggcgggcaggcctcccagagaggagggggccaggtcagggccttgagagctgagtgcctttcctctctagtccctcttcccagccagggt

SEQ ID NO: 62500 - DNA, 196 bp, Homo sapiens
gaggagggggtggtgacacggtggagacaccggctaggccagggggcctgcccttgggacaggtccagacccatggagccccccgggaggagcagcaggtccacagcgtctcatactctacaccagtattgctgtcctctcagagtgcgtgttgctgtgtacaaaggaatttccatcaataaaagctgatctcttc

SEQ ID NO: 62501 - DNA, 754 bp, Homo sapiens
ggggggctcatgggtctggactgtccaaggcaggcctggctagccggtgtctccaccgtgtcaccaccccgtcgggtggagcagcaggtccacagcgtctcatactctacaccagtattgctgtcctactcaggtccttgactccatgaagcttaccccctcaggcaggctggcagagagcagggaagaggaggaggaggaggagactgaggaagaggaagaggaagacgctcaccagttctgctgtccggcctccgagtgcagtagtccctcctctcggtaactgagaggacaagggccattttctatgcagaagcaaaagccttaaccagcccctccttccccagccgatgtggtgaggaccaggtgtcaaacctggagcagggacagggcagcaaggatgggagggcgaggaggctctggtgtagggcagtgagaagagtggggcaggccaggccctcagcagtggccgggtttggtgcggggccttgggggagtctgctccagatctgtccccagcacagcagtgaccagaatctcataaaagcaagagggcccggaccccgcctcgggcttgaaaggggcatctgagccccggagcaatcgaaggcaggatctgggggctctcaagctctgaggggtgtggcgggagatgggattgggaggcgggcaggcctcccagagaggagggggccaggtcagggccttgagagctgagtgcctttcctctctagtccctcttcccagccagggt

SEQ ID NO: 62502 - DNA, 669 bp, Homo sapiens
gaggagggggtggtgacacggtggagacaccggctaggccagggggcctgcccttgggacaggtccagacccatggagccccccgggaggagcagcagggaagaggaggaggaggaggagactgaggaagaggaagaggaagacgctcaccagttctgctgtccggcctccgagtgcagtagtccctcctctcggtaactgagaggacaagggccattttctatgcagaagcaaaagccttaaccagcccctccttccccagccgatgtggtgaggaccaggtgtcaaacctggagcagggacagggcagcaaggatgggagggcgaggaggctctggtgtagggcagtgagaagagtggggcaggccaggccctcagcagtggccgggtttggtgcggggccttgggggagtctgctccagatctgtccccagcacagcagtgaccagaatctcataaaagcaagagggcccggaccccgcctcgggcttgaaaggggcatctgagccccggagcaatcgaaggcaggatctgggggctctcaagctctgaggggtgtggcgggagatgggattgggaggcgggcaggcctcccagagaggagggggccaggtcagggccttgagagctgagtgcctttcctctctagtccctcttcccagccagggt

SEQ ID NO: 62503 - DNA, 751 bp, Homo sapiens
gaggagggggtggtgacacggtggagacaccggctaggccagggggcctgcccttgggacaggtccagacccatggagccccccgggaggagcagcaggtccacagcgtctcatactctacaccagtattgctgtcctactcaggtccttgactccatgaagcttaccccctcaggcaggctggcagagagcagattcccccatgggaccctgtcccctgcttcaggaaccagatgggcaagcatcgtgccccttcctccccccaccttcttcttggaattcccatccccactgctgtctcctctggactccagcccctgaattaaagagagctggagccctaggtccgactaaaatgtgggagaagcagagcttggagcttggagcttggaacctggatcctcccgtacccgcactcccacttcccaggcaccctggagcctgccactactggagaggtctccaaatgacatcccaaggacctacctctgtcctctgtgagcacaaacagagatgcagggtgcctagggctcagaggaccagacgggggcaggacccagcctgcctagttccctgtcgtttgttcccttgctgtggccattgctgccatctcctccactgcttgaaggcctcaccccatgccctctgccactcccatagtgctctgtaaatattatcaggaggaaaaggcctctcagagtgcgtgttgctgtgtacaaaggaatttccatcaataaaagctgatctcttc

SEQ ID NO: 62504 - DNA, 185 bp, Homo sapiens
ttctctctggaggagtggcagtgcctggacacagcacagcagaatttatataggaatgtcatgttagagaattatagaaacctggtattcctgggtattgctgtgtctaatttagacctgatcacctgtctggagcaaggaaaagagccctggaatatgaagagacacgagatggtagccaaacc

SEQ ID NO: 62505 - DNA, 441 bp, Homo sapiens
gtaaccaacccatgttccacctagaaatgcctctcctgctacaggccagtgtggcacctggggcagcaccctgttaatccatagaaagggttcagcacaaccccaggccggcgagtgctcacaagggtgagctgtgatttcagtgactcctatggctcgttggacgccactgtggacacagtgaggcagcggaggctatcttcccagacaaagcagtggcaggtccctgcaggacctcccaaggcatctgacccaggagataaattgcatttggcaagagacctcatatcttcaaagggctccctgtcaccagggccactcacagcacctcagtcgaccagagaccctgcagccctgggccgtcccagagcaccccacttaggacttgcttgcacgtggctctctgcaaatgtcagactcctgacaaaatgatagacaaag

SEQ ID NO: 62506 - DNA, 148 bp, Homo sapiens
agtagtatgtttgtaatttcagtgtttattactaatattatacatccctcaattggcataattataatattttaactaaaatatacttgtgctgggcttctggcaaaattataaagttgctttattaaattcatacatgcggaaatct

SEQ ID NO: 62507 - DNA, 394 bp, Homo sapiens
cttatttgtggctcctaaattttcaaatcaaatgaaaattctcagtcagaattaagtctattctttacttctaataactagtaatttttaaagaccctgactctcttatgtcttgagaatattcagtaataaaatgctagtatacagtttttaccagactccattgcaatgctccctgtgtggaacaatggaattttttcaaggctagtagtttgtgtgtttgtttgccaaagtggaggctgtgagattggtttatagagctgcccttgggaccacattgttctcacacgtgtagggtctctttcatctattctagctgtcaattgtaacatacaggagtaactcactagctttttcactcctgggagactccttctctccttttctattctgg

SEQ ID NO: 62508 - DNA, 571 bp, Homo sapiens
tcctggccctcccccatgcacacgtcctccatgaacccaagccagaggtggcagctggtcatgtaacctttatgtaatacccaccctgttccatccagggctgtgtgctggccccacacaggacaatggctcccgcacagaacaatggctctccgcaactttggtcccctggtccacttctgctcgagagcctcaggacaaacctctctctttcacttgacagcccattacacatttgattacagccatgcgtgtggcccttgtccctatcttctgcaggctaaatatctccagtcccttcaacctcccctgatgaaactatttccactcaccacattgtcctgcttcctctgagatggacaaacttcactgggtcagagattctcctagagtgtaaggctcagctctcctaccctcctggaggaggcgtcccctgataacagccttcccagaagggagtttggaaaaacatgaaaacatcttaaaaatgtttatacccttcattgcataaattccatttctgggaatggatcttaaataatcaaagataattaaaatatttaagtcacac

SEQ ID NO: 62509 - DNA, 945 bp, Homo sapiens
cccaaggaagagatcagccttttgcattgcaaactttccccccacactagtaaaggtgaaaggcctacgtatcccaatgactaaaaggccaaattagagctagctttttggcttatgacttaattgttgttggttttagttgtagtttataaagaatttttcatggaccttcttttctcttaatgctaccagtaggccttatcagtcctttataccaactgttcccaaccttttagcaccagggaccacctgtaccagtccgtggcccatgtgttggggacccgtaatttataccatggtgttagattagtttgagatgctccccataagagcagtttttgaaaggagggaaaaaaaatagaaccagactcccaaggttggcggaaaaaaaacaatctcacatatttgaaagactgagtcctttatatcctctgccatcttttcgatgttccccttccctttgccttatcaatgtacaaagctttttactagaaaatacaaggcaaaatgcacattctctaataaagcagaaaattactttggataaactttcagcaaaaccatgtagatttcttggtttaaaaaaattgtgtttgtgcaggaactttttgtttatacatccccacaagctccaacaaaactgaagatgataatcaaggttgcagattttattagggttcactttagaaaataaatgtatagtataaatggaaattaaatatttcaggaaatgactggctttatccagaacatacaagttttaatttttcaacagacaatatcaagatgttctttatttagcccctaccttgcatagtggggaagacacaaggccagttgaacagtgaactgctgaaagcaaatttcactttcaacacagaaagcacgggattatgaaacaggttcttcttaagaaatacagagggttttaaactttttggttgc

SEQ ID NO: 62510 - DNA, 1086 bp, Homo sapiens
cttcctgaagtcgtgtttttccacaggcttaagaaaattattcaccactcataagtcatggagacatcctcaaaaggtctgcttacccaagttactcagttttggaacctcctagatgatctagctcagagtgaccctgagggctatgagaagtttattcagcagcagctgaaagaagggaaacagctctgtgctgccccagaaccacagctttgtctacagaccaggattctgaaaccaaaagaaaaaatactttttatcaacctgtgtcagtggacaaggatcccagctccccaatcaaccactcatccagtacctctaactgttggcaaaccagaagatacaactgagatatcagatgcttacacagtcattgatgttgcctacaatcctgatgttcttcatgcagcagaaaaggaccaagtgaaaaaaaatcagttaattcagatggccatgaaatgcattgaggagaaattccagttcaccctctcacactcttaccatattaccaaatttagaataaaaggaagcattcaaagaatgaaacaaaatctgatgggaatccaaactgattccatagatttaagagaaaaaatgagaagggaactaactcttggacagatacgaagcagtactatgagcaatccagatcactttcctcaactgttactgccaaaagaccaagtttcaggcaaagcagtgtgtctgatagaagagatttccagtactgaaatccaggtggagatgaagatgccagcctatgaactaaaaattgtgcatgatcacagtgagaaacctctgaaaattgagttgaaagttgaattacctggtattaattctgtctctctctgtgaccttagtgtttctgaggatgatttattgattgaagtatctgagaagtacagattacatctgaatcttccaaaacttattgatactgaaatgaccacagcaaaatttatcaaagaaaaatccacgctaatcatcacaatgcctttggtgtgaaagaagagcatcatatgttttgggttttcagtgctaaagtcatgtgaattaaaggaccttcattttggctaaaaaaaaaaa

SEQ ID NO: 62511 - DNA, 1172 bp, Homo sapiens
aagtcgtgctcctgagaaatcgtcccaccaacaggcagcccagagactcccacaagggagggttttcaggacactccagaggttgacgggtgcagaaagaaggcgggcgctttcctggaagagaagtgggtcaggcccaactgaaaagcaagcctggcaccagaagggggacattccggaactagatatgaagagacttttctccctgaagttccccggacccaattagatgttgtacccaggctggttaccctggtaacaggcgtcgcggtttgtcaaggaactgagagaagaggcttaagaaaattattcaccactcataagtcatggagacatcctcaaaaggtctgcttacccaagttactcagttttggaacctcctagatgatctagctcagagtgaccctgagggctatgagaagtttattcagcagcagctgaaagaagggaaacagctctgtgctgccccagaaccacagctttgtctacagaccaggattctgaaaccaaaagaaaaaatactttttatcaacctgtgtcagtggacaaggatcccagctccccaatcaaccactcatccagtacctctaactgttggcaaaccagaagatacaactgagatatcagatgcttacacagtcattgatgttgcctacaatcctgatgttcttcatgcagcagaaaaggaccaagtgaaaaaaaatcagttaattcagatggccatgaaatgcattgaggagaaattccagttcaccctctcacactcttaccatattaccaaatttagaataaaaggaagcattcaaagaatgaaacaaaatctgatgggaatccaaactgattccatagatttaagagaaaaaatgagaagggaactaactcttggacagatacgaagcagtactatgagcaatccagatcactttcctcaactgttactgccaaaagaccaagtttcaggcaaagcagtgtgtctgatagaagagatttccagtactgaaatccaggtggagatgaagatgccagcctatgaactaaaaattgtgcatgatcacagtgagaaacctctgaaaattgagttgaaagttgaattacctggtattaattctgtctctctctgtgaccttagtgtttctgaggtaagttgaatagataacactgtaaatttgtat

SEQ ID NO: 62512 - DNA, 1476 bp, Homo sapiens
aagtcgtgctcctgagaaatcgtcccaccaacaggcagcccagagactcccacaagggagggttttcaggacactccagaggttgacgggtgcagaaagaaggcgggcgctttcctggaagagaagtgggtcaggcccaactgaaaagcaagcctggcaccagaagggggacattccggaactagatatgaagagacttttctccctgaagttccccggacccaattagatgttgtacccaggctggttaccctggtaacaggcgtcgcggtttgtcaaggaactgagagaagaggcttaagaaaattattcaccactcataagtcatggagacatcctcaaaaggtctgcttacccaagttactcagttttggaacctcctagatgatctagctcagagtgaccctgagggctatgagaagtttattcagcagcagctgaaagaagggaaacagctctgtgctgccccagaaccacagctttgtctacagaccaggattctgacagagtcttactttgtcaccaggctggagtgcaatggtgtggtcttggctcgctgcaacctctgcctcccgggtttaagcgattctcctgcctcagcctcccaagtagctgggattacagaaaccaaaagaaaaaatactttttatcaacctgtgtcagtggacaaggatcccagctccccaatcaaccactcatccagtacctctaactgttggcaaaccagaagatacaactgagatatcagatgcttacacagtcattgatgttgcctacaatcctgatgttcttcatgcagcagaaaaggaccaagtgaaaaaaaatcagttaattcagatggccatgaaatgcattgaggagaaattccagttcaccctctcacactcttaccatattaccaaatttagaataaaaggaagcattcaaagaatgaaacaaaatctgatgggaatccaaactgattccatagatttaagagaaaaaatgagaagggaactaactcttggacagatacgaagcagtactatgagcaatccagatcactttcctcaactgttactgccaaaagaccaagtttcaggcaaagcagtgtgtctgatagaagagatttccagtactgaaatccaggtggagatgaagatgccagcctatgaactaaaaattgtgcatgatcacagtgagaaacctctgaaaattgagttgaaagttgaattacctggtattaattctgtctctctctgtgaccttagtgtttctgaggatgatttattgattgaagtatctgagaagtacagattacatctgaatcttccaaaacttattgatactgaaatgaccacagcaaaatttatcaaagaaaaatccacgctaatcatcacaatgcctttggtgtgaaagaagagcatcatatgttttgggttttcagtgctaaagtcatgtgaattaaaggaccttcattttggctaaaaaaaaaaa

SEQ ID NO: 62513 - DNA, 1355 bp, Homo sapiens
aagtcgtgctcctgagaaatcgtcccaccaacaggcagcccagagactcccacaagggagggttttcaggacactccagaggttgacgggtgcagaaagaaggcgggcgctttcctggaagagaagtgggtcaggcccaactgaaaagcaagcctggcaccagaagggggacattccggaactagatatgaagagacttttctccctgaagttccccggacccaattagatgttgtacccaggctggttaccctggtaacaggcgtcgcggtttgtcaaggaactgagagaagaggcttaagaaaattattcaccactcataagtcatggagacatcctcaaaaggtctgcttacccaagttactcagttttggaacctcctagatgatctagctcagagtgaccctgagggctatgagaagtttattcagcagcagctgaaagaagggaaacagctctgtgctgccccagaaccacagctttgtctacagaccaggattctgaaaccaaaagaaaaaatactttttatcaacctgtgtcagtggacaaggatcccagctccccaatcaaccactcatccagtacctctaactgttggcaaaccagaagatacaactgagatatcagatgcttacacagtcattgatgttgcctacaatcctgatgttcttcatgcagcagaaaaggaccaagtgaaaaaaaatcagttaattcagatggccatgaaatgcattgaggagaaattccagttcaccctctcacactcttaccatattaccaaatttagaataaaaggaagcattcaaagaatgaaacaaaatctgatgggaatccaaactgattccatagatttaagagaaaaaatgagaagggaactaactcttggacagatacgaagcagtactatgagcaatccagatcactttcctcaactgttactgccaaaagaccaagtttcaggcaaagcagtgtgtctgatagaagagatttccagtactgaaatccaggtggagatgaagatgccagcctatgaactaaaaattgtgcatgatcacagtgagaaacctctgaaaattgagttgaaagttgaattacctggtattaattctgtctctctctgtgaccttagtgtttctgaggatgatttattgattgaagtatctgagaagtacagattacatctgaatcttccaaaacttattgatactgaaatgaccacagcaaaatttatcaaagaaaaatccacgctaatcatcacaatgcctttggtgtgaaagaagagcatcatatgttttgggttttcagtgctaaagtcatgtgaattaaaggaccttcattttggctaaaaaaaaaaa

SEQ ID NO: 62514 - DNA, 1041 bp, Homo sapiens
aagtcgtgctcctgagaaatcgtcccaccaacaggcagcccagagactcccacaagggagggttttcaggacactccagaggttgacgggtgcagaaagaaggcgggcgctttcctggaagagaagtgggtcaggcccaactgaaaagcaagcctggcaccagaagggggacattccggaactagatatgaagagacttttctccctgaagttccccggacccaattagatgttgtacccaggctggttaccctggtaacaggcgtcgcggtttgtcaaggaactgagagaagaggcttaagaaaattattcaccactcataagtcatggagacatcctcaaaaggtctgcttacccaagttactcagttttggaacctcctagatgatctagctcagagtgaccctgagggctatgagaagtttattcagcagcagctgaaagaagggaaacagctctgtgctgccccagaaccacagctttgtctacagaccaggattctgacagagtcttactttgtcaccaggctggagtgcaatggtgtggtcttggctcgctgcaacctctgcctcccgggtttaagcgattctcctgcctcagcctcccaagtagctgggattacagaaaccaaaagaaaaaatactttttatcaacctgtgtcagtggacaaggatcccagctccccaatcaaccactcatccagtacctctaactgttggcaaaccagaagatacaactgagatatcagatgcttacacagtcattgatgttgcctacaatcctgatgttcttcatgcagcagaaaaggaccaagtgaaaaaaaatcagttaattcagatggccatgaaatgcattgaggagaaattccagttcaccctctcacactcttaccatattaccaaatttagaataaaaggaagcattcaaagaatgaaacaaaatctgatgggaatccaaactgattccatagatttaagagaaaaaatgagaaggggtaagttgatgattgtaaatggaaaattaaactgctttaagatgttt

SEQ ID NO: 62515 - DNA, 1014 bp, Homo sapiens
  misc_feature (933)..(933): n is a, c, g, or t
  misc_feature (1011)..(1011): n is a, c, g, or t
ccgagaagctcttgcacaggacagcctctggaaccccgcgccattagcgcctgcgccgtctctaggccccgccccctcacccctccggtcctggagctcccacagctaacatggcggcgccctgtgtgtcctacggcggagcagtttcgtaccggcttcttctctggggtaggggtagcctcgcccggaagcaaggcctctggaaaaccgcggcccctgagttgcaaacaaatgtcagatcccagatattaaggctaagacatactgcatttgtaataccaaagaaaaacgttcctacctcaaaacgtgaaacttacacagaggattttattaaaaagcagattgaagagttcaacataggaaagagacatttagccaacatgatgggagaagatccagaaactttcactcaagaagatattgacagagctattgcttaccttttcccaagtggtttgtttgagaaacgagccaggccagtaatgaagcatcctgaacagatttttccaagacaaagagcaatccagtggggagaagatggccgtccatttcactatctcttctatactggcaaacagtcatactattcattaatgcatgatgtatatggaatgttactcaatttagaaaaacatcaaagtcacttgcaagccaaaagtctgctcccagaaaaaactgtaaccagagacgtgattggcagcagatggctgattaaggaggaactagaagaaatgttagtggaaaaactgtcagatctagattatatgcagttcattcggctgctagaaaagttattgacatcgcagtgtggtgctgctgaggaagaatttgtgcagaggtttcgaagaagtgtaactcttgaatcaaaaaacaggtgattgaacctgtacagtatgatgaggcaaggaatggcctttagcaaaagcgaaggtnaaagaaagactgcaaaagcagaagcaattgtttataaacatggaagtggaagattaaaagtaaatggaattgattacnagc

SEQ ID NO: 62516 - DNA, 659 bp, Homo sapiens
ccgagaagctcttgcacaggacagcctctggaaccccgcgccattagcgcctgcgccgtctctaggccccgccccctcacccctccggtcctggagctcccacagctaacatggcggcgccctgtgtgtcctacggcggagcagtttcgtaccggcttcttctctggggtaggggtagcctcgcccggaagcaaggcctctggaaaaccgcggcccctgagttgcaaacaaatgtcagatcccagatattaaggctaagacatactgcatttgtaataccaaagaaaaacgttcctacctcaaaacgtgaaacttacacagaggattttattaaaaagcagattgaagagttcaacataggaaagagacatttagccaacatgatgggagaagatccagaaactttcactcaagaagatattgacagagctattgcttaccttttcccaagtggtttgtttgagaaacgagccaggccagtaatgaagcatcctgaacagatttttccaagacaaagagcaatccagtggggagaagatggccgtccatttcactatctcttctatactggcaaacagtcatactattcattaatgcatgatgtatatggaatggtactcaattagaaaaacaatggcttgcaggccgtctgcttcagg

SEQ ID NO: 62517 - DNA, 937 bp, Homo sapiens
  misc_feature (856)..(856): n is a, c, g, or t
  misc_feature (934)..(934): n is a, c, g, or t
ccgagaagctcttgcacaggacagcctctggaaccccgcgccattagcgcctgcgccgtctctaggccccgccccctcacccctccggtcctggagctcccacagctaacatggcggcgccctgtgtgtcctacggcggagcagtttcgtaccggcttcttctctggggtaggggtagcctcgcccggaagcaaggcctctggaaaaccgcggcccctgagttgcaaacaaatgtcagatcccagatattaaggctaagacatactgcatttgtaataccaaagaaaaacgttcctacctcaaaacgtgaaacttacacagaggattttattaaaaagcagattgaagagttcaacataggaaagagacatttagccaacatgatgggagaagatccagaaactttcactcaagaagatattgacagagctattgcttaccttttcccaagtggtttgtttgagaaacgagccaggccagtaatgaagcatcctgaacagatttttccaagacaaagagcatgatgtatatggaatgttactcaatttagaaaaacatcaaagtcacttgcaagccaaaagtctgctcccagaaaaaactgtaaccagagacgtgattggcagcagatggctgattaaggaggaactagaagaaatgttagtggaaaaactgtcagatctagattatatgcagttcattcggctgctagaaaagttattgacatcgcagtgtggtgctgctgaggaagaatttgtgcagaggtttcgaagaagtgtaactcttgaatcaaaaaacaggtgattgaacctgtacagtatgatgaggcaaggaatggcctttagcaaaagcgaaggtnaaagaaagactgcaaaagcagaagcaattgtttataaacatggaagtggaagattaaaagtaaatggaattgattacnagc

SEQ ID NO: 62518 - DNA, 1063 bp, Homo sapiens
ccgagaagctcttgcacaggacagcctctggaaccccgcgccattagcgcctgcgccgtctctaggccccgccccctcacccctccggtcctggagctcccacagctaacatggcggcgccctgtgtgtcctacggcggagcagtttcgtaccggcttcttctctggggtaggggtagcctcgcccggaagcaaggcctctggaaaaccgcggcccctgagttgcaaacaaatgtcagatcccagatattaaggctaagacatactgcatttgtaataccaaagaaaaacgttcctacctcaaaacgtgaaacttacacagaggattttattaaaaagcagattgaagagttcaacataggaaagagacatttagccaacatgatgggagaagatccagaaactttcactcaagaagatattgacagagctattgcttaccttttcccaagtggtttgtttgagaaacgagccaggccagtaatgaagcatcctgaacagatttttccaagacaaagagcaatccagtggggagaagatggccgtccatttcactatctcttctatactggcaaacagtcatactattcattaatgattaccagctttacttcccgatcacacaggacagagaacagctgatgttccctttccactttgttgaccggctgggaaagcacgacgtgacctgcacagtctcagggggcgggaggtcagcgcaggctggagcaatacgactggcaatggcaaaagccttgtgcagctttgtcaccgaggacgaggtcgagtggatgagacaagctggactacttactactgatccacgtgtgagggaacggaagaagccaggccaagagggagcccgcagaaagtttacgtggaagaaacgctaagggtttgctcccaggaaaggagaggaagagctatatatatgtgccgacatgtggcagacacacagtaaataatggctgaccagcatgagggcagtactgtcagaaatttctttgagctgtgagatggatttatttttaaatgctactttgtaaaggtgacctttaaaaaat

SEQ ID NO: 62519 - DNA, 2957 bp, Homo sapiens
tcctccccgccctctgagaacccttgactcgacataggggcgctaagatgtcagggagttggctccccaggctcagcccgcgtttccctgggcagcggtctcgcaggagcccttctgggcggacctgcagcctcgcgtggcgttcgtggagcgcgggggctcgctgtggctgaattgcagcaccaactgccctcggccggagcgcggtggcctggagacctcgctgcgccgaaacgggacccagaggggtttgcgttggttggcgcggcagctggtggacattcgcgagccggagactcagcccgtctgcttcttccgctgcgcgcggcgcacactacaggcgcgtgggctcattcgcactttccagcgaccagatcgcgtagagctgatgccgctgcctccctggcagccggtgggcgagaacttcaccctgagctgtagggtccccggcgccgggccccgtgcgagcctcacgctgaccctgctgcggggcgcccaggagctgatccgccgcagcttcgccggtgaaccaccccgagcgcggggcgcggtgctcacagccacggtactggctcggagggaggaccatggagccaatttctcgtgtcgcgccgagctggacctgcggccgcacggactgggactgtttgaaaacagctcggcccccagagagctccgaaccttctccctgtctccggatgccccgcgcctcgctgctccccggctcttggaagttggctcggaaaggcccgtgagctgcactctggacggactgtttccagcctcagaggccagggtctacctcgcactgggggaccagaatctgagtcctgatgtcaccctcgaaggggacgcattcgtggccactgccacagccacagctagcgcagagcaggagggtgccaggcagctgatctgcaacgtcaccctggggggcgaaaaccgggagacccgggagaacgtgaccatctacagcttcccggcaccactcctgaccctgagcgaacccagcgtctccgaggggcagatggtgacagtaacctgcgcagctgggacccaagctctggtcacactggagggagttccagccgcggtcccggggcagcccgcccagcttcagctaaatgccaccgagaacgacgacagacgcagcttcttctgcgacgccaccctcgatgtggacggggagaccctgatcaagaacaggagcgcagagcttcgtgtcctatacgctccccggctagacgattcggactgccccaggagttggacgtggcccgagggcccagagcagacgctgcgctgcgaggcccgcgggaacccagaaccctcagtgcactgtgcgcgctccgacggcggggccgtgctggctctgggcctgctgggtccagtcactcgggcgctctcaggcacttaccgctgcaaggcggccaatgatcaaggcgaggcggtcaaggacgtaacgctaacggtggagtacgcaccagcgctggacagcgtgggctgcccagaacgcattacttggctggagggaacagaagcctcgctgagctgtgtggcgcacggggtaccgccgcctgatgtgatctgcgtgcgctctggagaactcggggccgtcatcgaggggctgttgcgtgtggcccgggagcatgcgggcacttaccgctgcgaagccaccaaccctcggggctctgcggccaaaaatgtggccgtcacggtggaatatggccccaggtttgaggagccgagctgccccagcaattggacatgggtggaaggatctgggcgcctgttttcctgtgaggtcgatgggaagccacagccaagcgtgaagtgcgtgggctccgggggcgccactgagggggtgctgctgccgctggcacccccagaccctagtcccagagctcccagaatccctagagtcctggcacccggtatctacgtctgcaacgccaccaaccgccacggctccgtggccaaaacagtcgtcgtgagcgcggagtcgccaccggagatggatgaatctacctgcccaagtcaccagacgtggctggaaggggctgaggcttccgcgctggcctgcgccgcccggggtcgcccttccccaggagtgcgctgctctcgggaaggcatcccatggcctgagcagcagcgcgtgtcccgagaggacgcgggcacttaccactgtgtggccaccaatgcgcatggcacggactcccggaccgtcactgtgggcgtggaataccggccagtggtggccgaacttgctgcctcgccccctggaggcgtgcgcccaggaggaaacttcacgttgacctgccgcgcggaggcctggcctccagcccagatcagctggcgcgcgcccccgggggccctcaacatcggcctgtcgagcaacaacagcacactgagcgtggcaggcgccatgggaagccacggcggcgagtacgagtgcgcacgcaccaacgcgcacgggcgccacgcgcggcgcatcacggtgcgcgtggccggtccgtggctatgggtcgccgtgggcggcgcggcggggggcgcggcgctgctggccgcgggggccggcctggccttctacgtgcagtccaccgcctgcaagaagggcgagtacaacgtgcaggaggccgagagctcaggcgaggccgtgtgtctcaacggagcgggcggcggcgctggcggggcggcaggcgcggagggcggacccgaggcggcggggggcgcggccgagtcgccggcggagggcgaggtcttcgccatacagctgacatcggcgtgagcccgctcccctctccccgcgggccgggggacgccccccagactcacacgggggcttatttattgctttatttatttacttattcatttatttatgtattcaactccaagggcgtcacccccattttctacccatcccctcaataaagtttttataaaggaaaaacctg

SEQ ID NO: 62520 - DNA, 3011 bp, Homo sapiens
agccgtcctctagcccagctcctcggctcgcgctctcctcgcctcctgtgctttccccgccgcggcgatgccagggccttcgccagggctgcgccgggcgctactcggcctctgggctgctctgggcctggggctcttcggcctctcagcggtctcgcaggagcccttctgggcggacctgcagcctcgcgtggcgttcgtggagcgcgggggctcgctgtggctgaattgcagcaccaactgccctcggccggagcgcggtggcctggagacctcgctgcgccgaaacgggacccagaggggtttgcgttggttggcgcggcagctggtggacattcgcgagccggagactcagcccgtctgcttcttccgctgcgcgcggcgcacactacaggcgcgtgggctcattcgcactttccagcgaccagatcgcgtagagctgatgccgctgcctccctggcagccggtgggcgagaacttcaccctgagctgtagggtccccggcgccgggccccgtgcgagcctcacgctgaccctgctgcggggcgcccaggagctgatccgccgcagcttcgccggtgaaccaccccgagcgcggggcgcggtgctcacagccacggtactggctcggagggaggaccatggagccaatttctcgtgtcgcgccgagctggacctgcggccgcacggactgggactgtttgaaaacagctcggcccccagagagctccgaaccttctccctgtctccggatgccccgcgcctcgctgctccccggctcttggaagttggctcggaaaggcccgtgagctgcactctggacggactgtttccagcctcagaggccagggtctacctcgcactgggggaccagaatctgagtcctgatgtcaccctcgaaggggacgcattcgtggccactgccacagccacagctagcgcagagcaggagggtgccaggcagctgatctgcaacgtcaccctggggggcgaaaaccgggagacccgggagaacgtgaccatctacagcttcccggcaccactcctgaccctgagcgaacccagcgtctccgaggggcagatggtgacagtaacctgcgcagctgggacccaagctctggtcacactggagggagttccagccgcggtcccggggcagcccgcccagcttcagctaaatgccaccgagaacgacgacagacgcagcttcttctgcgacgccaccctcgatgtggacggggagaccctgatcaagaacaggagcgcagagcttcgtgtcctatacgctccccggctagacgattcggactgccccaggagttggacgtggcccgagggcccagagcagacgctgcgctgcgaggcccgcgggaacccagaaccctcagtgcactgtgcgcgctccgacggcggggccgtgctggctctgggcctgctgggtccagtcactcgggcgctctcaggcacttaccgctgcaaggcggccaatgatcaaggcgaggcggtcaaggacgtaacgctaacggtggagtacgcaccagcgctggacagcgtgggctgcccagaacgcattacttggctggagggaacagaagcctcgctgagctgtgtggcgcacggggtaccgccgcctgatgtgatctgcgtgcgctctggagaactcggggccgtcatcgaggggctgttgcgtgtggcccgggagcatgcgggcacttaccgctgcgaagccaccaaccctcggggctctgcggccaaaaatgtggccgtcacggtggaatatggccccaggtttgaggagccgagctgccccagcaattggacatgggtggaaggatctgggcgcctgttttcctgtgaggtcgatgggaagccacagccaagcgtgaagtgcgtgggctccgggggcgccactgagggggtgctgctgccgctggcacccccagaccctagtcccagagctcccagaatccctagagtcctggcacccggtatctacgtctgcaacgccaccaaccgccacggctccgtggccaaaacagtcgtcgtgagcgcggagtcgccaccggagatggatgaatctacctgcccaagtcaccagacgtggctggaaggggctgaggcttccgcgctggcctgcgccgcccggggtcgcccttccccaggagtgcgctgctctcgggaaggcatcccatggcctgagcagcagcgcgtgtcccgagaggacgcgggcacttaccactgtgtggccaccaatgcgcatggcacggactcccggaccgtcactgtgggcgtggaataccggccagtggtggccgaacttgctgcctcgccccctggaggcgtgcgcccaggaggaaacttcacgttgacctgccgcgcggaggcctggcctccagcccagatcagctggcgcgcgcccccgggggccctcaacatcggcctgtcgagcaacaacagcacactgagcgtggcaggcgccatgggaagccacggcggcgagtacgagtgcgcacgcaccaacgcgcacgggcgccacgcgcggcgcatcacggtgcgcgtggccggtccgtggctatgggtcgccgtgggcggcgcggcggggggcgcggcgctgctggccgcgggggccggcctggccttctacgtgcagtccaccgcctgcaagaagggcgagtacaacgtgcaggaggccgagagctcaggcgaggccgtgtgtctcaacggagcgggcggcggcgctggcggggcggcaggcgcggagggcggacccgaggcggcggggggcgcggccgagtcgccggcggagggcgaggtcttcgccatacagctgacatcggcgtgagcccgctcccctctccccgcgggccgggggacgccccccagactcacacgggggcttatttattgctttatttatttacttattcatttatttatgtattcaactccaagggcgtcacccccattttctacccatcccctcaataaagtttttataaaggaaaaacctg

SEQ ID NO: 62521 - DNA, 388 bp, Homo sapiens
actccactactctccctccctcccaggccccgccccctgggtcccagggtcctccccttcaggccccaccttctgttccaagtcccggtgttcaaagagctgcggactcttcccccttgcagagcgaccagatcgcgtagagctgatgccgctgcctccctggcagccggtgggcgagaacttcaccctgagctgtagggtccccggcgccgggccccgtgcgagcctcacgctgaccctgctgcggggcgcccaggagctgatccgccgcagcttcgccggtgaaccaccccgagcgcggggcgcggtgctcacagccacggtactggctcggagggaggaccatggagccaatttctcgtgtcgcgccgagctggacctgcggccg

SEQ ID NO: 62522 - DNA, 704 bp, Homo sapiens
aggtcccttttgtgttgtttttgccaacacagcagcttccctgctatatataccagttgcccctttgtccctatcatactagatgctaatcaccctctgtcaacaaccatggggaagatcaccttctacgaggaccgagactttcagggtcgctgctacaattgcatcagtgactgccccaacctgcgggtctacttcagccgctgcaactccatccgagtagacagcggctgctggatgctctatgagcgtcccaattaccagggccaccagtacttcctgcgccgaggcaagtaccccgactatcagcactggatgggcctcagcgactcggtccaatcctgccgtataattcctcataccagctcgcacaagttaaggctgtacgagagagatgactaccgaggccttatgtctgagctcactgatgactgcgcctgtgttccagaactgttccgtctccctgagatctattccctccacgtactggagggctgctgggtcctctatgaaatgcccaactaccgggggcggcagtatctgctgaggcctggggactacagaaggtaccacgactgggggggtgcagatgccaaagtcggctctttgagacgggtcaccgatttgtactaagctgtgcctgccttgttgtgatccccatagaaacataataaatatacaagttgtgttccctgcaaaaaatg

SEQ ID NO: 62523 - DNA, 195 bp, Homo sapiens
cacagagattattaagtgagaagaccactgggagtcaaatatagttgtggttataatccacaatataattagcaatagtcagtaaaaggaataattgcgtgagtaaagattccttagaagtcaatcattggagcaaagccaaagattatggcccaatatcatagtacctatatctaaaacaacaacaaaaaaacc

SEQ ID NO: 62524 - DNA, 275 bp, Homo sapiens
gaagactcattccaatgagttttggttgagtagtaaaacttactttttaccacggttgtcattatcacagtcagtcctttgaatataccaagacccaaacatttccagaaatttgtctttagagaagagaggctcccattaatataaaaagaacaacaatgaaaaaaatctttatattccttagtaaatgtgactacttagtgaattttgtagtatatctcttagtatattttagatcacagatgtttttgcaaaaacaattttaataggttaca

SEQ ID NO: 62525 - DNA, 339 bp, Homo sapiens
caacaatgaaagaagaaatgatgagaacctaaactaaggcaatactaatagaagcaaagagaagggaagagatttcacaagtttataagaagaaagtggtaggacttgaaagttaattggatgtaaagaccaaagcaaggggcagtcaaggatggctcctggatttctggcttgagagactaggtggatgaaagagcagatgagaacaccaaagacagaatatatggttcttctagaagatccactttcaattttactaaagtgaatgacccactttgatgaaaagaataatgacttctaaggtctcttacaactctaatgttacaattctattgttcc

SEQ ID NO: 62526 - DNA, 123 bp, Homo sapiens
gggagttggagggctgaggtcgggagggtggtgtgtacagagctctaggactcacgcaccaggccagtcgcgggttttgggccgaggcctgggttacaagcagcaagtgcgcggttggggcca

SEQ ID NO: 62527 - DNA, 432 bp, Homo sapiens
tcggcacagggagtgggagggggccttcctccagggaatgtgactctcgcaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatgccgtggccgtcagcgtgggcctcctgctcctcgtcgttgctgtcttctactgcgtgagac

SEQ ID NO: 62528 - DNA, 633 bp, Homo sapiens
cttacctctaaacagcagagcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggttcaggaggcagggagggggtgggcttggatggggacagtgtggggtgtgggacctggacaaacaggacgagttcctgagtccctggctggggactccatcttctgctcgatgcctctcttctctctctctctcctctcccttcactttcttcccatccccaccacccacaggctcgccagagctaaagacagcggaaatagagcccaaggcagatggcagctggagggaaggagacgaagtcacactcatctgctctgcccgcggccatccagaccccaaactcagctggagccaattggggggcagcgtaagggaccttcctctccaccctgagccccctctcactcatccaagtatcacaccccatcatctgtggacactggagtctggaataaatgctgtttgtcacatc

SEQ ID NO: 62529 - DNA, 620 bp, Homo sapiens
ctaggaatctaagccagcagatagaaattcaacctctagaaagggaagtaggtgtctgtcctgccttcatgctcaagcaaagggtcccataaagagaactttgtgaggttattttcctccatcaacctatctttaaggaggaccatcctaaacccttccagcaactgccaactctctcacttacattaaggctctggataagctacataagttctctgaacttcagaaatattgtattaaacttgatatacaaatgtctaccttgtagtttgctgtgaggtatagttatagcacatttgagtagtgctctgttgttttaaaaatgcttttgtttatgtattaattcatctggaaggtcaagattcaagttgccctcagtaattttatcatatcttgaatgaatactgctagtccttttcattttccaaataacatctctttattcctatacttttaaaaaatgcatcatgaattcatactgattttttcaattcaaatgtaagagagttcaataattctaagggattctttataaatttgaggtaaattttacatgcaattaagtgcacaaatatcaagtgctctatctgatgatgagtttgacaaatgcatacacccac

SEQ ID NO: 62530 - DNA, 165 bp, Homo sapiens
agcgtagcaccaaggctaacgtcttggtgttcataacgttcgtgttcatgaaaaatgtaaactgaaggaggaggaagctgcagggggcgtctgtgctgtttctgttgctcctttgtaagtctgaattatctgaacatttaaaaagaatacaaacggtctagccca

SEQ ID NO: 62531 - DNA, 618 bp, Homo sapiens
ttttatctaattttaattgactgtaagtaattaaatgtgttaaaatattgtaagccttccatatcttccctggtttgaagtagaaagatatctaaatgcaaaaaactcaattttggattgctttcactaaaatagttttatggtttaagttgccatgttcttataaaattgggtattgtgcaaattatttcacaatctaatctggatgatggcattttgtgcttctcaaataatccaaaagacaaatggatatattgtactataggtttgaggaaacttgatgtggggctggacgtgggtgggctaatgcctgtcatcccagtactttggggaggtaggagtcgggagggattgcttgagcccaggagtttgagaccagcctgggcccaaataggggagacccccatcacttaaaaaaaaaaaaaaagaaaaaaagaaacttgatgtgatggaaatgttttataagtcctcttctagttatctatttaatgtgcaagaatttccactatgtagatttgtgaataaaagaatagattgagaacccaaatttgatatttctgactattcatctgtttcggggtaagtagacagatcagaagaaactgtttattattgtaa

SEQ ID NO: 62532 - DNA, 209 bp, Homo sapiens
gaagatcccataaagtcaacagtggtagctttttgaaggaaggaaggtgagtaggatgagctacgcctttaaaattaacttcatatttttccattccattagatatcttttgttagcttaatcatgtacttactgaaaactaagtatgtaaaaaatgagacaccatttagctgctgaaagatcagggaccatttggcaggaatactgga

SEQ ID NO: 62533 - DNA, 351 bp, Homo sapiens
ttggacatcagggaagtgggtggacagtgacagagggagtctgacagagggagtcaaaaatggctccaaagtctctgacctgggtgaaatcatggaacttctgcctgtaccattaataactcctttctctgagagctgtctcctcactcacagggaaggtcctctgtcctgttcgtactgggtccccattgtttttgcagcctggccctccctccctttctgggaatggacccttccctcctgggaagcatccattgctccctcatctctccacggctgttgtggaggtcactgtgtaaactgcacagcctttgtctagggacgccggacccaagatgggtcaatcggaac

SEQ ID NO: 62534 - DNA, 333 bp, Homo sapiens
cttaggtcccattctacgtatatttgtgtgttgtgtgaggagtaaatgagatgatcagggccaggcacacatcacagtgcccatgataaagatccaacagccattgtctgctgtgtgcttgtgtgtgtgtgtgttcatctttgtgtctccctgcatctattggtgagggggtctagtgtctctgtgcgtatgtttctgtacatgtcagcggtgtgtgtgacaggcacaagatccacccctgctccctctctctggcctaggggtgagtggatggggctgtcagggaggggtgttggggtgttgctgccctcagttctcaggcttagggatctc

SEQ ID NO: 62535 - DNA, 204 bp, Homo sapiens
aatattcagctttcacaggaattcagtacaatgaatcaaaagccagaaataatgctgagaggctgcaattgctcccaagaaaaaacatcttttatcatttcccagtttctatcaagtcatttttttaaataaaagatttcatttttttaaataaagagtgacagcgaaattagagaacataaaattattgggctataataattt

SEQ ID NO: 62536 - DNA, 756 bp, Homo sapiens
ggagtgcaatggtacaatcacacctcatagcagcctccatctcccgggcttaagtgatcctcccgagcagctgggatcacaggcactcaccaccacagttggctaattttttgtagaagagggggtttcaccatgttgcccaaactggtgtcaaactcctgggctcaagcaatctgcctgcctcagcctcccaaagtgctgggattcaggcatgagccactgctcccagcctacaacccaactttcttttttttgagacagagttcgctctgttgcctaggctggagtggaatggcgtgatttcggctcactgcaacctctgcctcccaggttcaagtgattctcctgcctcagcctcccgagtagctgagattacaggcgcgtgccaccacgccaggttaatttttgtatttttagtagtgatagggtttcgccatgttggccaggttgatctcgaactcctggcctcaggtgatctacctgccttggcctcccaaagtgctgggattacaggcgtgagccactgcgcccggccgacacccaactttcagagcatctttggttcctggggtgagagaagccagaccccagcaccagtcctatcccacagggagctcggtgctgccacctctgcagctgcagaacccggcaggctctggagagctgccccccggtgggaggtagcagaatggagccagcgcacccctttcccgatgtctcgaggcccttctgctcaaaattcttttgtaggcaccg

SEQ ID NO: 62537 - DNA, 311 bp, Homo sapiens
cttcctcccaggctatcagatccactcacttccgtggagacacctttatggattccctcaaggagaattcatcaatgcctcttctgttctccctgaacaatctgttcataatggaagtcacagtttgctttgttcttgacatatctgttttgctccttagagcctgatgttccctaaagctcaggatcagatcttatttcatctatttaccacagtgtcagcacttccacagtgtctggcagattgtaggcacacaataattgttttaggaataaacacgtctggatctctgggaccctaatccatctggg

SEQ ID NO: 62538 - DNA, 203 bp, Homo sapiens
cggtgtgataaccaaataaattgatcttacactaatgatgtaagctaaagtattacatcatgaagaattacccattagaatgccatgtaatggaacagaacttggtgtgtttccaagtgcttaaaaagataagaagcacttttctgaataaatattgatgttagttgcagatactccgttccttctcatccactggcaaaaaa

SEQ ID NO: 62539 - DNA, 798 bp, Homo sapiens
ccaagactgcaagtgatacagcctaggcatgtgtaaaagaaacagctttgacctctacaacatccagaaccaatgattcctcctcatggaaccaagaagatgggacatgaccagaacctgctgcaatatgaccgccggcactctttcaaagcaaggggtctgttggccaggaagatctgggactaaaatctgcgtcaacatgccttactgtaaatggtcaaatttgaagacctccaactggaccttgccaagccaacatttgtgaatcctttctcttgtcatccaaccccttaatacttgccccaggccccaagtgagggagactgatttgagtccttctcctgtctcctcgctggccagccttgtaacaaagcctttcttttctcaaaagctggtgccatagtattagtttctatgtgtgtggggcagggagtccatttgctgtataacagtcgctcaatatccaccaccagcatgaacaaacactaatgttttccatacttgcttctgaatcctttaaatgaaaaaaatagatgatgaaactgagctcccttttaggtctgtctccaattttattcccttttctcccaaagtcatgaatgtgtattttttctcatccatgttgttatgtacatgtgttacctatatttttcaataaatagcatgcagcaatattttgcacttttattccatagatgttatcataatgaacaatcgatctgcaatgtgtttttctagacattagatttttaagatctatgttgatatataaagaccactttattcatttttaactcc

SEQ ID NO: 62540 - DNA, 646 bp, Homo sapiens
  misc_feature (646)..(646): n is a, c, g, or t
ccaagactgcaagtgatacagcctaggcatgtgtaaaagaaacagctttgacctctacaacatccagaaccaatgattcctcctcatggaaccaagaagatgggacatgaccagaacctgctgcaatatgaccgccggcactctttcaaagcaaggggtctgttggccaggaagatctgggactaaaatctgcgtcaacatgccttactgtaaatggtcaaatttgaagacctccaactggaccttgccaagccaacatttgtgaatcctttctcttgtcatccaaccccttaatacttgccccaggccccaagtgagggagactgatttgagtccttctcctgtctcctcgctggccagccttgtaacaaagcctttcttttctcaaaagctggtgccatagtattagtttctatgtgtgtggggcagggagtccatttgctgtataacagtcgctcaatatccaccaccagcatgaacaaacactaatgttttccatacttgcttctgaatcctttaaatgaaaaaaatagatgatgaaactgagctcccttttaggtctgtctccaattttattcccttttctcccaaagtcattagctgtttctgggggaaccgaagccgaattcgtatcatgcattagtan

SEQ ID NO: 62541 - DNA, 2253 bp, Homo sapiens
tgacgtcacggtcactgacagcgtgagcccgcggcggctgctgccatggtggctggcggccgggtaagggtctgagtggatctcctgccaggccagagcgccttcgggggccgcggcggaaggccaggagtttgcagccagggcgccgggtttgtggtctgcagtgtcgtgaggctgaggtgcagcatgtctagactgggagccctgggtggtgcccgtgccgggctgggactgttgctgggtaccgccgccggccttggattcctgtgcctcctttacagccagcgatggaaacggacccagcgtcatggccgcagccagagcctgcccaactccctggactatacgcagacttcagatcccggacgccacgtgatgctcctgcgggctgtcccaggtggggctggagatgcctcagtgctgcccagccttccacgggaaggacaggagaaggtgctggaccgcctggactttgtgctgaccagccttgtggcgctgcggcgggaggtggaggagctgagaagcagcctgcgagggcttgcgggggagattgttggggaggtccgatgccacatggaagagaaccagagagtggctcggcggcgaaggtttccgtttgtccgggagaggagtgactccactggctccagctctgtctacttcacggcctcctcgggagccacgttcacagatgctgagagtgaagggggttacacaacagccaatgcggagtctgacaatgagcgggactctgacaaagaaagtgaggacggggaagatgaagtgagctgtgagactgtgaagatggggagaaaggattctcttgacttggaggaagaggcagcttcaggtgcctccagtgccctggaggctggaggttcctcaggcttggaggatgtgctgcccctcctgcagcaggccgacgagctgcacaggggtgatgagcaaggcaagcgggagggcttccagctgctgctcaacaacaagctggtgtatggaagccggcaggactttctctggcgcctggcccgagcctacagtgacatgtgtgagctcactgaggaggtgagcgagaagaagtcatatgccctagatggaaaagaagaagcagaggctgctctggagaagggggatgagagtgctgactgtcacctgtggtatgcggtgctttgtggtcagctggctgagcatgagagcatccagaggcgcatccagagtggctttagcttcaaggagcatgtggacaaagccattgctctccagccagaaaaccccatggctcactttcttcttggcaggtggtgctatcaggtctctcacctgagctggctagaaaaaaaaactgctacagccttgcttgaaagccctctcagtgccactgtggaagatgccctccagagcttcctaaaggctgaagaactacagccaggattttccaaagcaggaagggtatatatttccaagtgctacagagaactagggaaaaactctgaagctagatggtggatgaagttggccctggagctgccagatgtcacgaaggaggatttggctatccagaaggacctggaagaactggaagtcattttacgagactaaccacgtttcactggccttcatgacttgatgccactatttaaggtgggggggcggggaggcttttttccttagaccttgctgagatcaggaaaccacacaaatctgtctcctgggtctgactgctacccactaccactccccattagttaatttattctaacctctaacctaatctagaattggggcagtactcatggcttccgtttctgttgttctctcccttgagtaatctcttaaaaaaatcaagattcacacctgccccaggattacacatgggtagagcctgcaagacctgagaccttccaattgctggtgaggtggatgaacttcaaagctataggaacaaagcacataacttgtcactttaatctttttcactgactaataggactcagtacatatagtcttaagatcataccttacctaccaaggtaaaaagagggatcagagtggcccacagacattgctttcttatcacctatcatgtgaattctacctgtattcctgggctggaccacttgataacttccagtgtcctggcagcttttggaatgacagcagtggtatggggtttatgatgctataaaacaatgtctgaaaagttgcctagaatatattttgttacaaacttgaaataaaccaaatttgatgtta

SEQ ID NO: 62542 - DNA, 2880 bp, Homo sapiens
tgacgtcacggtcactgacagcgtgagcccgcggcggctgctgccatggtggctggcggccgggtaagggtctgagtggatctcctgccaggccagagcgccttcgggggccgcggcggaaggccaggagtttgcagccagggcgccgggtttgtggtctgcagtgtcgtgaggctgaggtgcagcatgtctagactgggagccctgggtggtgcccgtgccgggctgggactgttgctgggtaccgccgccggccttggattcctgtgcctcctttacagccagcgatggaaacggacccagcgtcatggccgcagccagagcctgcccaactccctggactatacgcagacttcagatcccggacgccacgtgatgctcctgcgggctgtcccaggtggggctggagatgcctcagtgctgcccagccttccacgggaaggacaggagaaggtgctggaccgcctggactttgtgctgaccagccttgtggcgctgcggcgggaggtggaggagctgagaagcagcctgcgagggcttgcgggggagattgttggggaggtccgatgccacatggaagagaaccagagagtggctcggcggcgaaggtttccgtttgtccgggagaggagtgactccactggctccagctctgtctacttcacggcctcctcgggagccacgttcacagatgctgagagtgaagggggttacacaacagccaatgcggagtctgacaatgagcgggactctgacaaagaaagtgaggacggggaagatgaagtgagctgtgagactgtgaagatggggagaaaggattctcttgacttggaggaagaggcagcttcaggtgcctccagtgccctggaggctggaggttcctcaggcttggaggatgtgctgcccctcctgcagcaggccgacgagctgcacaggggtgatgagcaaggcaagcgggagggcttccagctgctgctcaacaacaagctggtgtatggaagccggcaggactttctctggcgcctggcccgagcctacagtgacatgtgtgagctcactgaggaggtgagcgagaagaagtcatatgccctagatggaaaagaagaagcagaggctgctctggagaagggggatgagagtgctgactgtcacctgtggtatgcggtgctttgtggtcagctggctgagcatgagagcatccagaggcgcatccagagtggctttagcttcaaggagcatgtggacaaagccattgctctccagccagaaaaccccatggctcactttcttcttggcaggtggtgctatcaggtctctcacctgagctggctagaaaaaaaaactgctacagccttgcttgaaagccctctcagtgccactgtggaagatgccctccagagcttcctaaaggctgaagaactacagccaggattttccaaagcaggaagggtatatatttccaagtgctacagagaactagggaaaaactctgaagctagatggtggatgaagttggccctggagctgccagatgtcacgaaggaggatttggctatccagaaggacctggaagaactggaagtcattttacgagactaaccacgtttcactggccttcatgacttgatgccactatttaaggtgggggggcggggaggcttttttccttagaccttgctgagatcaggaaaccacacaaatctgtctcctgggtctgactgctacccactaccactccccattagttaatttattctaacctctaacctaatctagaattggggcagtactcatggcttccgtttctgttgttctctcccttgagtaatctcttaaaaaaatcaagattcacacctgccccaggattacacatgggtagagcctgcaagacctgagaccttccaattgctggtgaggtggatgaacttcaaagctataggaacaaagcacataacttgtcactttaatctttttcactgactaataggactcagtacatatagtcttaagatcataccttacctaccaaggtaaaaagagggatcagagtggcccacagacattgctttcttatcacctatcatgtgaattctacctgtattcctgggctggaccacttgataacttccagtgtcctggcagcttttggaatgacagcagtggtatggggtttatgatgctataaaacaatgtctgaaaagttgcctagaatatattttgttacaaacttgaaataaaccaaatttgatgttaaaaaaaaaaaaaaaaaaaaaaaaaaaaaatttggggggggcgggccggaaaaggtttaaaaccttcggtggggggcgcgcggggccccataaggttaggtgggacacggttggccaaaagcgggtaccaagaggagaacgcgggaccaggaacagagggcgctgggcatcctcacacccaattaaaacggcccgggggggacacccgagggtccttgaaacacatcccagaagggggtcggcagcccataccggggctctaacaccgggaggtccagcggagccgaatatcaaatacgcccgcccgtggaaaacaacacaccgcaaggaaaaaagagaaacagcacgagaaaggggacaaaatcgacaagcagagcaaggaggacaccggatcacgccaagcacaaaagagagaagccacacgcgacagcacgacaacagagaagacagaacagatcagaccgcaacccacaacaagaaaaagacaaaaccgaaagacagaaagcaacaaagcgacacaaccaacaacaccacaagaacactcgaaccacaaagcacagagaccgaaacgacagcacactcagcaaacgccaagaagtcacacagaaacaagaaaagacaaacacgc

SEQ ID NO: 62543 - DNA, 2808 bp, Homo sapiens
tgacgtcacggtcactgacagcgtgagcccgcggcggctgctgccatggtggctggcggccgggtaagggtctgagtggatctcctgccaggccagagcgccttcgggggccgcggcggaaggccaggagtttgcagccagggcgccgggtttgtggtctgcagtgtcgtgaggctgaggtgcagcatgtctagactgggagccctgggtggtgcccgtgccgggctgggactgttgctgggtaccgccgccggccttggattcctgtgcctcctttacagccagcgatggaaacggacccagcgtcatggccgcagccagagcctgcccaactccctggactatacgcagacttcagatcccggacgccacgtgatgctcctgcgggctgtcccaggtggggctggagatgcctcagtgctgcccagccttccacgggaaggacaggagaaggtgctggaccgcctggactttgtgctgaccagccttgtggcgctgcggcgggaggtggaggagctgagaagcagcctgcgagggcttgcgggggagattgttggggaggtccgatgccacatggaagagaaccagagagtggctcggcggcgaaggtttccgtttgtccgggagaggagtgactccactggctccagctctgtctacttcacggcctcctcgggagccacgttcacagatgctgagagtgaagggggttacacaacagccaatgcggagtctgacaatgagcgggactctgacaaagaaagtgaggacggggaagatgaagtgagctgtgagactgtgaagatggggagaaaggattctcttgacttggaggaagaggcagcttcaggtgcctccagtgccctggaggctggaggttcctcaggcttggaggatgtgctgcccctcctgcagcaggccgacgagctgcacaggggtgatgagcaaggcaagcgggagggcttccagctgctgctcaacaacaagctggtgtatggaagccggcaggactttctctggcgcctggcccgagcctacagtgacatgtgtgagctcactgaggaggtgagcgagaagaagtcatatgccctagatggaaaagaagaagcagaggctgctctggagaagggggatgagagtgctgactgtcacctgtggtatgcggtgctttgtggtcagctggctgagcatgagagcatccagaggcgcatccagagtggctttagcttcaaggagcatgtggacaaagccattgctctccagccagaaaaccccatggctcactttcttcttggcaggtggtgctatcaggtaagctgcgtttcagtgcttgacataatggtcctaaatgcaacaagatcctcagccttctctggctcaggtgcccttggtggttcgacccagccccgtttgaccctattttcaatatatccccaaagatttaaagaaaaaaaaccttttaaaacctcttatacacaccttgatctttttgtggcagtctctcacctgagctggctagaaaaaaaaactgctacagccttgcttgaaagccctctcagtgccactgtggaagatgccctccagagcttcctaaaggtatgagaggggcaggtggcaggcaaaaacaccagggtaaccttgttttttcctaaggacattattgagacccttaatgggaggggttttcctagtcgggggcaattttgtgtttgcctgttctatgggaaaaccagaatcacttgcacagcttatcaaaaatataggtttcttcagacccactgaatcagccacatggttggggactagaaatctagtttaataaacttcagcctgattagaatataggaacctcttactgaaatatctttgtcccttttcccaggctgaagaactacagccaggattttccaaagcaggaagggtatatatttccaaggtaaactcatttgtctacttcaacatagatctgggaactcctgaaagtacacagtatcaggtttcactgttgtctcttttcagtgctacagagaactagggaaaaactctgaagctagatggtggatgaagttggccctggagctgccagatgtcacgaaggaggatttggctatccagaaggacctggaagaactggaagtcattttacgagactaaccacgtttcactggccttcatgacttgatgccactatttaaggtgggggggcggggaggcttttttccttagaccttgctgagatcaggaaaccacacaaatctgtctcctgggtctgactgctacccactaccactccccattagttaatttattctaacctctaacctaatctagaattggggcagtactcatggcttccgtttctgttgttctctcccttgagtaatctcttaaaaaaatcaagattcacacctgccccaggattacacatgggtagagcctgcaagacctgagaccttccaattgctggtgaggtggatgaacttcaaagctataggaacaaagcacataacttgtcactttaatctttttcactgactaataggactcagtacatatagtcttaagatcataccttacctaccaaggtaaaaagagggatcagagtggcccacagacattgctttcttatcacctatcatgtgaattctacctgtattcctgggctggaccacttgataacttccagtgtcctggcagcttttggaatgacagcagtggtatggggtttatgatgctataaaacaatgtctgaaaagttgcctagaatatattttgttacaaacttgaaataaaccaaatttgatgtta

SEQ ID NO: 62544 - DNA, 1968 bp, Homo sapiens
tgacgtcacggtcactgacagcgtgagcccgcggcggctgctgccatggtggctggcggccgggtaagggtctgagtggatctcctgccaggccagagcgccttcgggggccgcggcggaaggccaggagtttgcagccagggcgccgggtttgtggtctgcagtgtcgtgaggctgaggtgcagcatgtctagactgggagccctgggtggtgcccgtgccgggctgggactgttgctgggtaccgccgccggccttggattcctgtgcctcctttacagccagcgatggaaacggacccagcgtcatggccgcagccagagcctgcccaactccctggactatacgcagacttcagatcccggacgccacgtgatgctcctgcgggctgtcccaggtggggctggagatgcctcagtgctgcccagccttccacgggaaggacaggagaaggtgctggaccgcctggactttgtgctgaccagccttgtggcgctgcggcgggaggtggaggagctgagaagcagcctgcgagggcttgcgggggagattgttggggaggtccgccctttaatgaggagcagtagtaagaggcaccccatggtgagcagaaagacaagctggatgggacctaatggtacccttcgggatggggcctgctttccagatgccacatggaagagaaccagagagtggctcggcggcgaaggtttccgtttgtccgggagaggagtgactccactggctccagctctgtctacttcacggcctcctcgggagccacgttcacagatgctgagagtgaaggggggaaaagaagaagcagaggctgctctggagaagggggatgagagtgctgactgtcacctgtggtatgcggtgctttgtggtcagctggctgagcatgagagcatccagaggcgcatccagagtggctttagcttcaaggagcatgtggacaaagccattgctctccagccagaaaaccccatggctcactttcttcttggcaggtggtgctatcaggtctctcacctgagctggctagaaaaaaaaactgctacagccttgcttgaaagccctctcagtgccactgtggaagatgccctccagagcttcctaaaggctgaagaactacagccaggattttccaaagcaggaagggtatatatttccaagtgctacagagaactagggaaaaactctgaagctagatggtggatgaagttggccctggagctgccagatgtcacgaaggaggatttggctatccagaaggacctggaagaactggaagtcattttacgagactaaccacgtttcactggccttcatgacttgatgccactatttaaggtgggggggcggggaggcttttttccttagaccttgctgagatcaggaaaccacacaaatctgtctcctgggtctgactgctacccactaccactccccattagttaatttattctaacctctaacctaatctagaattggggcagtactcatggcttccgtttctgttgttctctcccttgagtaatctcttaaaaaaatcaagattcacacctgccccaggattacacatgggtagagcctgcaagacctgagaccttccaattgctggtgaggtggatgaacttcaaagctataggaacaaagcacataacttgtcactttaatctttttcactgactaataggactcagtacatatagtcttaagatcataccttacctaccaaggtaaaaagagggatcagagtggcccacagacattgctttcttatcacctatcatgtgaattctacctgtattcctgggctggaccacttgataacttccagtgtcctggcagcttttggaatgacagcagtggtatggggtttatgatgctataaaacaatgtctgaaaagttgcctagaatatattttgttacaaacttgaaataaaccaaatttgatgtta

SEQ ID NO: 62545 - DNA, 1127 bp, Homo sapiens
actttcacatgtatctagtgtggttcatcccacagaacttcattgagggtagtgttttccatatctggtctcccgtctgcttcctaatgctgggagagtatctttttagtctttgttggtctatcaagcctgcaagacctgagaccttccaattgctggtgaggtggatgaacttcaaagctataggaacaaagcacataacttgtcactttaatctttttcactgactaataggactcagtacatatagtcttaagatcataccttacctaccaaggtaaaaagagggatcagagtggcccacagacattgctttcttatcacctatcatgtgaattctacctgtattcctgggctggaccacttgataacttccagtgtcctggcagcttttggaatgacagcagtggtatggggtttatgatgctataaaacaatgtctgaaaagttgcctagaatatattttgttacaaacttgaaataaaccaaatttgatgttaaaaaaaaaaaaaaaaaaaaaaaaaaaaaatttggggggggcgggccggaaaaggtttaaaaccttcggtggggggcgcgcggggccccataaggttaggtgggacacggttggccaaaagcgggtaccaagaggagaacgcgggaccaggaacagagggcgctgggcatcctcacacccaattaaaacggcccgggggggacacccgagggtccttgaaacacatcccagaagggggtcggcagcccataccggggctctaacaccgggaggtccagcggagccgaatatcaaatacgcccgcccgtggaaaacaacacaccgcaaggaaaaaagagaaacagcacgagaaaggggacaaaatcgacaagcagagcaaggaggacaccggatcacgccaagcacaaaagagagaagccacacgcgacagcacgacaacagagaagacagaacagatcagaccgcaacccacaacaagaaaaagacaaaaccgaaagacagaaagcaacaaagcgacacaaccaacaacaccacaagaacactcgaaccacaaagcacagagaccgaaacgacagcacactcagcaaacgccaagaagtcacacagaaacaagaaaagacaaacacgc

SEQ ID NO: 62546 - DNA, 2137 bp, Homo sapiens
tgacgtcacggtcactgacagcgtgagcccgcggcggctgctgccatggtggctggcggccgggtgcagcatgtctagactgggagccctgggtggtgcccgtgccgggctgggactgttgctgggtaccgccgccggccttggattcctgtgcctcctttacagccagcgatggaaacggacccagcgtcatggccgcagccagagcctgcccaactccctggactatacgcagacttcagatcccggacgccacgtgatgctcctgcgggctgtcccaggtggggctggagatgcctcagtgctgcccagccttccacgggaaggacaggagaaggtgctggaccgcctggactttgtgctgaccagccttgtggcgctgcggcgggaggtggaggagctgagaagcagcctgcgagggcttgcgggggagattgttggggaggtccgatgccacatggaagagaaccagagagtggctcggcggcgaaggtttccgtttgtccgggagaggagtgactccactggctccagctctgtctacttcacggcctcctcgggagccacgttcacagatgctgagagtgaagggggttacacaacagccaatgcggagtctgacaatgagcgggactctgacaaagaaagtgaggacggggaagatgaagtgagctgtgagactgtgaagatggggagaaaggattctcttgacttggaggaagaggcagcttcaggtgcctccagtgccctggaggctggaggttcctcaggcttggaggatgtgctgcccctcctgcagcaggccgacgagctgcacaggggtgatgagcaaggcaagcgggagggcttccagctgctgctcaacaacaagctggtgtatggaagccggcaggactttctctggcgcctggcccgagcctacagtgacatgtgtgagctcactgaggaggtgagcgagaagaagtcatatgccctagatggaaaagaagaagcagaggctgctctggagaagggggatgagagtgctgactgtcacctgtggtatgcggtgctttgtggtcagctggctgagcatgagagcatccagaggcgcatccagagtggctttagcttcaaggagcatgtggacaaagccattgctctccagccagaaaaccccatggctcactttcttcttggcaggtggtgctatcaggtctctcacctgagctggctagaaaaaaaaactgctacagccttgcttgaaagccctctcagtgccactgtggaagatgccctccagagcttcctaaaggctgaagaactacagccaggattttccaaagcaggaagggtatatatttccaagtgctacagagaactagggaaaaactctgaagctagatggtggatgaagttggccctggagctgccagatgtcacgaaggaggatttggctatccagaaggacctggaagaactggaagtcattttacgagactaaccacgtttcactggccttcatgacttgatgccactatttaaggtgggggggcggggaggcttttttccttagaccttgctgagatcaggaaaccacacaaatctgtctcctgggtctgactgctacccactaccactccccattagttaatttattctaacctctaacctaatctagaattggggcagtactcatggcttccgtttctgttgttctctcccttgagtaatctcttaaaaaaatcaagattcacacctgccccaggattacacatgggtagagcctgcaagacctgagaccttccaattgctggtgaggtggatgaacttcaaagctataggaacaaagcacataacttgtcactttaatctttttcactgactaataggactcagtacatatagtcttaagatcataccttacctaccaaggtaaaaagagggatcagagtggcccacagacattgctttcttatcacctatcatgtgaattctacctgtattcctgggctggaccacttgataacttccagtgtcctggcagcttttggaatgacagcagtggtatggggtttatgatgctataaaacaatgtctgaaaagttgcctagaatatattttgttacaaacttgaaataaaccaaatttgatgtta

SEQ ID NO: 62547 - DNA, 2354 bp, Homo sapiens
tgacgtcacggtcactgacagcgtgagcccgcggcggctgctgccatggtggctggcggccgggtaagggtctgagtggatctcctgccaggccagagcgccttcgggggccgcggcggaaggccaggagtttgcagccagggcgccgggtttgtggtctgcagtgtcgtgaggctgaggtgcagcatgtctagactgggagccctgggtggtgcccgtgccgggctgggactgttgctgggtaccgccgccggccttggattcctgtgcctcctttacagccagcgatggaaacggacccagcgtcatggccgcagccagagcctgcccaactccctggactatacgcagacttcagatcccggacgccacgtgatgctcctgcgggctgtcccaggtggggctggagatgcctcagtgctgcccagccttccacgggaaggacaggagaaggtgctggaccgcctggactttgtgctgaccagccttgtggcgctgcggcgggaggtggaggagctgagaagcagcctgcgagggcttgcgggggagattgttggggaggtccgccctttaatgaggagcagtagtaagaggcaccccatggtgagcagaaagacaagctggatgggacctaatggtacccttcgggatggggcctgctttccagatgccacatggaagagaaccagagagtggctcggcggcgaaggtttccgtttgtccgggagaggagtgactccactggctccagctctgtctacttcacggcctcctcgggagccacgttcacagatgctgagagtgaagggggttacacaacagccaatgcggagtctgacaatgagcgggactctgacaaagaaagtgaggacggggaagatgaagtgagctgtgagactgtgaagatggggagaaaggattctcttgacttggaggaagaggcagcttcaggtgcctccagtgccctggaggctggaggttcctcaggcttggaggatgtgctgcccctcctgcagcaggccgacgagctgcacaggggtgatgagcaaggcaagcgggagggcttccagctgctgctcaacaacaagctggtgtatggaagccggcaggactttctctggcgcctggcccgagcctacagtgacatgtgtgagctcactgaggaggtgagcgagaagaagtcatatgccctagatggaaaagaagaagcagaggctgctctggagaagggggatgagagtgctgactgtcacctgtggtatgcggtgctttgtggtcagctggctgagcatgagagcatccagaggcgcatccagagtggctttagcttcaaggagcatgtggacaaagccattgctctccagccagaaaaccccatggctcactttcttcttggcaggtggtgctatcaggtctctcacctgagctggctagaaaaaaaaactgctacagccttgcttgaaagccctctcagtgccactgtggaagatgccctccagagcttcctaaaggctgaagaactacagccaggattttccaaagcaggaagggtatatatttccaagtgctacagagaactagggaaaaactctgaagctagatggtggatgaagttggccctggagctgccagatgtcacgaaggaggatttggctatccagaaggacctggaagaactggaagtcattttacgagactaaccacgtttcactggccttcatgacttgatgccactatttaaggtgggggggcggggaggcttttttccttagaccttgctgagatcaggaaaccacacaaatctgtctcctgggtctgactgctacccactaccactccccattagttaatttattctaacctctaacctaatctagaattggggcagtactcatggcttccgtttctgttgttctctcccttgagtaatctcttaaaaaaatcaagattcacacctgccccaggattacacatgggtagagcctgcaagacctgagaccttccaattgctggtgaggtggatgaacttcaaagctataggaacaaagcacataacttgtcactttaatctttttcactgactaataggactcagtacatatagtcttaagatcataccttacctaccaaggtaaaaagagggatcagagtggcccacagacattgctttcttatcacctatcatgtgaattctacctgtattcctgggctggaccacttgataacttccagtgtcctggcagcttttggaatgacagcagtggtatggggtttatgatgctataaaacaatgtctgaaaagttgcctagaatatattttgttacaaacttgaaataaaccaaatttgatgtta

SEQ ID NO: 62548 - DNA, 1729 bp, Homo sapiens
gcgggaccctgtctcaaaaaaaaaaaaaaaaaagaaaaaaagtctgcccttaagaggtatgaatgattgtgatttggtgctttggacaatgccatgtagagtgcttctttgggggtgagggatagacagaccctaggggctctgagctgaataatcctcttgttgtcccttacatttctctgccagttacacaacagccaatgcggagtctgacaatgagcgggactctgacaaagaaagtgaggacggggaagatgaagtgagctgtgagactgtgaagatggggagaaaggattctcttgacttggaggaagaggcagcttcaggtgcctccagtgccctggaggctggaggttcctcaggcttggaggatgtgctgcccctcctgcagcaggccgacgagctgcacaggggtgatgagcaaggcaagcgggagggcttccagctgctgctcaacaacaagctggtgtatggaagccggcaggactttctctggcgcctggcccgagcctacagtgacatgtgtgagctcactgaggaggtgagcgagaagaagtcatatgccctagatggaaaagaagaagcagaggctgctctggagaagggggatgagagtgctgactgtcacctgtggtatgcggtgctttgtggtcagctggctgagcatgagagcatccagaggcgcatccagagtggctttagcttcaaggagcatgtggacaaagccattgctctccagccagaaaaccccatggctcactttcttcttggcaggtggtgctatcaggtctctcacctgagctggctagaaaaaaaaactgctacagccttgcttgaaagccctctcagtgccactgtggaagatgccctccagagcttcctaaaggctgaagaactacagccaggattttccaaagcaggaagggtatatatttccaagtgctacagagaactagggaaaaactctgaagctagatggtggatgaagttggccctggagctgccagatgtcacgaaggaggatttggctatccagaaggacctggaagaactggaagtcattttacgagactaaccacgtttcactggccttcatgacttgatgccactatttaaggtgggggggcggggaggcttttttccttagaccttgctgagatcaggaaaccacacaaatctgtctcctgggtctgactgctacccactaccactccccattagttaatttattctaacctctaacctaatctagaattggggcagtactcatggcttccgtttctgttgttctctcccttgagtaatctcttaaaaaaatcaagattcacacctgccccaggattacacatgggtagagcctgcaagacctgagaccttccaattgctggtgaggtggatgaacttcaaagctataggaacaaagcacataacttgtcactttaatctttttcactgactaataggactcagtacatatagtcttaagatcataccttacctaccaaggtaaaaagagggatcagagtggcccacagacattgctttcttatcacctatcatgtgaattctacctgtattcctgggctggaccacttgataacttccagtgtcctggcagcttttggaatgacagcagtggtatggggtttatgatgctataaaacaatgtctgaaaagttgcctagaatatattttgttacaaacttgaaataaaccaaatttgatgtta

SEQ ID NO: 62549 - DNA, 2099 bp, Homo sapiens
tgacgtcacggtcactgacagcgtgagcccgcggcggctgctgccatggtggctggcggccgggtaagggtctgagtggatctcctgccaggccagagcgccttcgggggccgcggcggaaggccaggagtttgcagccagggcgccgggtttgtggtctgcagtgtcgtgaggctgaggtgcagcatgtctagactgggagccctgggtggtgcccgtgccgggctgggactgttgctgggtaccgccgccggccttggattcctgtgcctcctttacagccagcgatggaaacggacccagcgtcatggccgcagccagagcctgcccaactccctggactatacgcagacttcagatcccggacgccacgtgatgctcctgcgggctgtcccaggtggggctggagatgcctcagtgctgcccagccttccacgggaaggacaggagaaggtgctggaccgcctggactttgtgctgaccagccttgtggcgctgcggcgggaggtggaggagctgagaagcagcctgcgagggcttgcgggggagattgttggggaggtccgatgccacatggaagagaaccagagagtggctcggcggcgaaggtttccgtttgtccgggagaggagtgactccactggctccagctctgtctacttcacggcctcctcgggagccacgttcacagatgctgagagtgaagggggttacacaacagccaatgcggagtctgacaatgagcgggactctgacaaagaaagtgaggacggggaagatgaagtgagctgtgagactgtgaagatggggagaaaggattctcttgacttggaggaagaggcagcttcaggtgcctccagtgccctggaggctggaggttcctcaggcttggaggatgtgctgcccctcctgcagcaggccgacgagctgcacaggggtgatgagcaaggcaagcgggagggcttccagctgctgctcaacaacaagctggtgtatggaagccggcaggactttctctggcgcctggcccgagcctacagtgacatgtgtgagctcactgaggaggtgagcgagaagaagtcatatgccctagatggaaaagaagaagcagaggctgctctggagaagggggatgagagtgctgactgtcacctgtggtctctcacctgagctggctagaaaaaaaaactgctacagccttgcttgaaagccctctcagtgccactgtggaagatgccctccagagcttcctaaaggctgaagaactacagccaggattttccaaagcaggaagggtatatatttccaagtgctacagagaactagggaaaaactctgaagctagatggtggatgaagttggccctggagctgccagatgtcacgaaggaggatttggctatccagaaggacctggaagaactggaagtcattttacgagactaaccacgtttcactggccttcatgacttgatgccactatttaaggtgggggggcggggaggcttttttccttagaccttgctgagatcaggaaaccacacaaatctgtctcctgggtctgactgctacccactaccactccccattagttaatttattctaacctctaacctaatctagaattggggcagtactcatggcttccgtttctgttgttctctcccttgagtaatctcttaaaaaaatcaagattcacacctgccccaggattacacatgggtagagcctgcaagacctgagaccttccaattgctggtgaggtggatgaacttcaaagctataggaacaaagcacataacttgtcactttaatctttttcactgactaataggactcagtacatatagtcttaagatcataccttacctaccaaggtaaaaagagggatcagagtggcccacagacattgctttcttatcacctatcatgtgaattctacctgtattcctgggctggaccacttgataacttccagtgtcctggcagcttttggaatgacagcagtggtatggggtttatgatgctataaaacaatgtctgaaaagttgcctagaatatattttgttacaaacttgaaataaaccaaatttgatgtta

SEQ ID NO: 62550 - DNA, 1240 bp, Homo sapiens
ctgatgttagtttatatttacattttccccttaggagcatgtggacaaagccattgctctccagccagaaaaccccatggctcactttcttcttggcaggtggtgctatcaggtaagctgcgtttcagtgcttgacataatggtcctaaatgcaacaagatcctcagccttctctggctcaggtgcccttggtggttcgacccagccccgtttgaccctattttcaatatatccccaaagatttaaagaaaaaaaaccttttaaaacctcttatacacaccttgatctttttgtggcagtctctcacctgagctggctagaaaaaaaaactgctacagccttgcttgaaagccctctcagtgccactgtggaagatgccctccagagcttcctaaaggctgaagaactacagccaggattttccaaagcaggaagggtatatatttccaagtgctacagagaactagggaaaaactctgaagctagatggtggatgaagttggccctggagctgccagatgtcacgaaggaggatttggctatccagaaggacctggaagaactggaagtcattttacgagactaaccacgtttcactggccttcatgacttgatgccactatttaaggtgggggggcggggaggcttttttccttagaccttgctgagatcaggaaaccacacaaatctgtctcctgggtctgactgctacccactaccactccccattagttaatttattctaacctctaacctaatctagaattggggcagtactcatggcttccgtttctgttgttctctcccttgagtaatctcttaaaaaaatcaagattcacacctgccccaggattacacatgggtagagcctgcaagacctgagaccttccaattgctggtgaggtggatgaacttcaaagctataggaacaaagcacataacttgtcactttaatctttttcactgactaataggactcagtacatatagtcttaagatcataccttacctaccaaggtaaaaagagggatcagagtggcccacagacattgctttcttatcacctatcatgtgaattctacctgtattcctgggctggaccacttgataacttccagtgtcctggcagcttttggaatgacagcagtggtatggggtttatgatgctataaaacaatgtctgaaaagttgcctagaatatattttgttacaaacttgaaataaaccaaatttgatgtta

SEQ ID NO: 62551 - DNA, 1614 bp, Homo sapiens
tgacgtcacggtcactgacagcgtgagcccgcggcggctgctgccatggtggctggcggccgggtaagggtctgagtggatctcctgccaggccagagcgccttcgggggccgcggcggaaggccaggagtttgcagccagggcgccgggtttgtggtctgcagtgtcgtgaggctgaggtgcagcatgtctagactgggagccctgggtggtgcccgtgccgggctgggactgttgctgggtaccgccgccggccttggattcctgtgcctcctttacagccagcgatggaaacggacccagcgtcatggccgcagccagagcctgcccaactccctggactatacgcagacttcagatcccggacgccacgtgatgctcctgcgggctgtcccaggtggggctggagatgcctcagtgctgcccagccttccacgggaaggacaggagaaggtgctggaccgcctggactttgtgctgaccagccttgtggcgctgcggcgggaggtggaggagctgagaagcagcctgcgagggcttgcgggggagattgttggggaggtccgatgccacatggaagagaaccagagagtggctcggcggcgaaggtttccgtttgtccgggagaggagtgactccactggctccagctctgtctacttcacggcctcctcgggagccacgttcacagatgctgagagtgaaggggggtgagttgtctctcttggaggcagttatggctacagccaggttgtgttttgtaaaagtattatcaatggaaaattcaaaccaagctgctgcaaatgatttttggaacaggtaagagtataataaatacagaagagttgaaacaaaaaacccatccaatttatgtcattcagacaaatgtagatgttaatagcagttattgcttgcatctgttatcttagtttattacatagttatgatatattatttgggcatttttctgtgttatcacaaggacttgataagcattgtttgactttgttcctttccttgggtggctgagctggtatacggagatgtctaagcacgaagcatgctcctccctgggagtcaccctcttcccacaggggagccttgcctgtgatcctttgcatttttacaggtgggaggtggatgtcctgagttctcagtggcccaggagggctgacgataggcctttctgtgaggcggggcagctggcaggagtctggtggacagcctcctccaagtctggtcatgctaagggtgttttgagtttaaaccactagcaccactttgaaactctggtcccaaggatagagtgtgatgtcagtagcagcatctgacccatctgaccttatctgctgctagctccagttattcaggtagcctgtgtgaggcctagaggccgatttctccttgtccagcctttattcttcttaagggaaagactggtgtagagaacagccaagttttatgctggatcagaggaattagctataagcaggtacatggaaactagaagttaaaatcagtccaggtgtggtggtggctcatgggtaatcccagcactttgggaggccgagacaggaggattgcttgagttcaggagcttgagaccatcctgga

SEQ ID NO: 62552 - DNA, 456 bp, Homo sapiens
agcggaactgaatttacctccccttgagtatgggctgtacttagtgactcacttctaacaaagtcggacgtgatggcatgtggcttccaaccgtaggtcttaaaagacactgcaagctccgacctgggctccctctttgatcactagctctggggaagccagctgccatgctataaagacactcaagcagccccacggagaggtccacaaggcaaggagctgagtcctcccaccaacagccagtgaggagccaaggcttcccacctacaaccagtgaggagctgaggcctcctgccacagtcacgggagtgagccttggaagcggatcctgcagtgtcagtcgagccttcagagactgcagcccctgccgacatcttgactgaaacttcaaaatcatccagctaagctgcttccaaattcccagctgggagacgataaatgtttcaagctgctaag

SEQ ID NO: 62553 - DNA, 306 bp, Homo sapiens
atttacatgacctggtaaaatttaaaatatccattctgactaacaggcagtgatgagaacaataaataaaatatatcttggtttaaattctaagtaaatatatttgacaatataaatataaacatactcatatgagtgaattgcttctaattctggcttttagctaaataagcacttaatgctagtaagaaaaatacattatttcataaagataacaaattctttcagaaatagtaattatatttttaaagagtttggggaaaatagaagtgtatactctaatcttatagcaaagtttctgctaag

SEQ ID NO: 62554 - DNA, 207 bp, Homo sapiens
cactgtttcatatcatatagaaaaattcactgaaaatagatcaacaacctaaatataagggctaaatcatgaaactcttagaaaaaaataaagggaaatcttcatgaccttggatctggcaatggattcttagatagaaaaccagaagactgagcaacaacataaaaaatagattagttagactttgtcaaattttaaaacatttgt

SEQ ID NO: 62555 - DNA, 2703 bp, Homo sapiens
  misc_feature (2703)..(2703): n is a, c, g, or t
acacaaacagcaaaatcaaaccacaagtgtgttagtgggaatgacccatcttaaatagaatgtaaatgcaaatatgcatgagatgcataatttggtaagatgttttggtaatgcctgcagagttactgatttgttgtttttattttattttaaatatagtatatgcatttaatatatttatttcagtctgtgttcatgtctaactcatacataatagtgcatgaaacagcaacatactgaaatagagtaaatggcctaatgagaacattaatgaaacacttaagattaagtgattatagggatgtgtgttttccttgtctgttttgatggcacagttgcagcatctatagtatcactgattggcaagactattcgtgtgcatcatgtgtgctctgtttgtattgaatggcaaagctttgttgtgagatgtagtctagtggatgagagtacactgaggggatgaattttggagaccaagagatcaaaaatggtacactgcaattctaaacatgtccaaagcctacttggagagtgagaatgtactggaaccttcaccagccaacatattgcaggataacttcctgaaggtttatcttagccatcttagtactttgagggattggaaatgtggtcagtcctccatttatgactctactaagccagtaacatggtcaacatttaaaacttgcttctacaatcacacgtatggtttattttagccctgttcgctgtcagctttaccagattatttataggatgaaggaaactgtcttgtaccttcaatttttcccacggtaatggaatataactatttatcaatttatcactgcaactgacatagccagggaaatgtttaagaaatgaataaatagaagtttattccctgcaggtagtcgattgagtccaccaaaatcttaagctaaattttatgttgtttcatggtagctgttatgaaaatggaccatctaagagaaaatccattgtttctcaaattcaaatgcattctgtgtgactaggttgttcccgtgataatgctatgtgacattgctgttctcttctattcaccagtttgccttcctaataacctcttctcatatacattctttagggaaaagaccagtgccctcagtctgagcaacgttgctggagtattctacatccttgtcgggggccttggtttggcaatgctggtggctttgattgagttctgttacaagtcaagggccgaggcgaaacgaatgaaggtggcaaagaatgcacagaatattaacccatcttcctcgcagaattcacagaattttgcaacttataaggaaggttacaacgtatatggcatcgaaagtgttaaaatttaggggatgaccttgaatgatgccatgaggaacaaggcaaggctgtcaattacaggaagtactggagaaaatggacgtgttatgactccagaatttcccaaagcagtgcatgctgtcccttacgtgagtcctggcatgggaatgaatgtcagtgtgactgatctctcgtgattgataagaaccttttgagtgccttacacaatggttttcttgtgtgtttattgtcaaagtggtgagaggcatccagtatcttgaagacttttctttcagccaagaattcttaaatatgtggagttcatcttgaattgtaaggaatgattaattaaaacacaacatctttttctactcgagttacagacaaagcgtggtggacatgcacagctaacatggaagtactataatttacctgaagtctttgtacagacaacaaacctgtttctgcagccactattgttagtctcttgattcataatgacttaagcacacttgacatcaactgcatcaagatgtgacatgttttataaaaaaaggaaaaaaaacatttaaaactaaaaaatatttttaggtattttcacaaacaaactggcttttaaataaatttgcttccatattggttgaataagacaaaaacaattaaactgagtgggaagtgaataaaaaaaggctttaggtatcgattccatatttttcaaagccaaatatgtaaatgctaaggaaagtaaacaaagaggagattccaatcttgtaatttaatattgttattaaaactttaatgtatcctattctttaacatttggtgttaatataaaattacttggcaatgcttgacatttgaaataaacatttttctattgttttattgcaagtggtccaattaattttgcttagctacagtttggtcataaatcaagtgagtttaaagacactaccaagttgttaggtgcccagagaaaatttctcccttttaacaaaggccaggtgatttcttcaaatgtaatcttgcccccaaagtaactactctgaatatctttttgacatgtctaaatatatactactatactacaagaacactatttgttaacacaaaagcattcgatctatgtacgataaatgctcaatagatttaaaaagctaatattaacaaataccagaatacgtgaagttccatttttaaagtgtttgagcttacagaagagaaacattcattttaaatgacagtaaacaaatgccttgtaaagtaatatctttagatagcttgcccaattgattaacattccaacaaacctaacatatgtctctcagctttaaacattatacaaagcctgtcatcacactttactatattatgaan

SEQ ID NO: 62556 - DNA, 1953 bp, Homo sapiens
  misc_feature (1953)..(1953): n is a, c, g, or t
ctaaaattgcagtgtttgataaaatgtggacctacatgcggagtgcggagccctctgtgtttgtgaggactacggccgaaggggtggctagagtgcggaagtccaaagggaaatatgcctacttgttggagtccacgatgaacgagtacattgagcaaaggaagccttgcgacaccatgaaagttggtggaaacctggattccaaaggctatggcatcgcaacacctaaaggatcctcattaagaaatgcggttaacctcgcagtactaaaactgaatgaacaaggcctgttggacaaattgaaaaacaaatggtggtacgacaaaggagagtgcggcagcgggggaggtgattccaaggaaaagaccagtgccctcagtctgagcaacgttgctggagtattctacatccttgtcgggggccttggtttggcaatgctggtggctttgattgagttctgttacaagtcaagggccgaggcgaaacgaatgaaggtggcaaagaatgcacagaatattaacccatcttcctcgcagaattcacagaattttgcaacttataaggaaggttacaacgtatatggcatcgaaagtgttaaaatttaggggatgaccttgaatgatgccatgaggaacaaggcaaggctgtcaattacaggaagtactggagaaaatggacgtgttatgactccagaatttcccaaagcagtgcatgctgtcccttacgtgagtcctggcatgggaatgaatgtcagtgtgactgatctctcgtgattgataagaaccttttgagtgccttacacaatggttttcttgtgtgtttattgtcaaagtggtgagaggcatccagtatcttgaagacttttctttcagccaagaattcttaaatatgtggagttcatcttgaattgtaaggaatgattaattaaaacacaacatctttttctactcgagttacagacaaagcgtggtggacatgcacagctaacatggaagtactataatttacctgaagtctttgtacagacaacaaacctgtttctgcagccactattgttagtctcttgattcataatgacttaagcacacttgacatcaactgcatcaagatgtgacatgttttataaaaaaaggaaaaaaaacatttaaaactaaaaaatatttttaggtattttcacaaacaaactggcttttaaataaatttgcttccatattggttgaataagacaaaaacaattaaactgagtgggaagtgaataaaaaaaggctttaggtatcgattccatatttttcaaagccaaatatgtaaatgctaaggaaagtaaacaaagaggagattccaatcttgtaatttaatattgttattaaaactttaatgtatcctattctttaacatttggtgttaatataaaattacttggcaatgcttgacatttgaaataaacatttttctattgttttattgcaagtggtccaattaattttgcttagctacagtttggtcataaatcaagtgagtttaaagacactaccaagttgttaggtgcccagagaaaatttctcccttttaacaaaggccaggtgatttcttcaaatgtaatcttgcccccaaagtaactactctgaatatctttttgacatgtctaaatatatactactatactacaagaacactatttgttaacacaaaagcattcgatctatgtacgataaatgctcaatagatttaaaaagctaatattaacaaataccagaatacgtgaagttccatttttaaagtgtttgagcttacagaagagaaacattcattttaaatgacagtaaacaaatgccttgtaaagtaatatctttagatagcttgcccaattgattaacattccaacaaacctaacatatgtctctcagctttaaacattatacaaagcctgtcatcacactttactatattatgaan

SEQ ID NO: 62557 - DNA, 2048 bp, Homo sapiens
  misc_feature (2048)..(2048): n is a, c, g, or t
ctaaaattgcagtgtttgataaaatgtggacctacatgcggagtgcggagccctctgtgtttgtgaggactacggccgaaggggtggctagagtgcggaagtccaaagggaaatatgcctacttgttggagtccacgatgaacgagtacattgagcaaaggaagccttgcgacaccatgaaagttggtggaaacctggattccaaaggctatggcatcgcaacacctaaaggatcctcattaagaaatgcggttaacctcgcagtactaaaactgaatgaacaaggcctgttggacaaattgaaaaacaaatggtggtacgacaaaggagagtgcggcagcgggggaggtgattccaagtattgaaactcagtgagcaaggcgtcttagacaagctgaaaaacaaatggtggtacgataaaggtgaatgtggagccaaggactctggaagtaaggaaaagaccagtgccctcagtctgagcaacgttgctggagtattctacatccttgtcgggggccttggtttggcaatgctggtggctttgattgagttctgttacaagtcaagggccgaggcgaaacgaatgaaggtggcaaagaatgcacagaatattaacccatcttcctcgcagaattcacagaattttgcaacttataaggaaggttacaacgtatatggcatcgaaagtgttaaaatttaggggatgaccttgaatgatgccatgaggaacaaggcaaggctgtcaattacaggaagtactggagaaaatggacgtgttatgactccagaatttcccaaagcagtgcatgctgtcccttacgtgagtcctggcatgggaatgaatgtcagtgtgactgatctctcgtgattgataagaaccttttgagtgccttacacaatggttttcttgtgtgtttattgtcaaagtggtgagaggcatccagtatcttgaagacttttctttcagccaagaattcttaaatatgtggagttcatcttgaattgtaaggaatgattaattaaaacacaacatctttttctactcgagttacagacaaagcgtggtggacatgcacagctaacatggaagtactataatttacctgaagtctttgtacagacaacaaacctgtttctgcagccactattgttagtctcttgattcataatgacttaagcacacttgacatcaactgcatcaagatgtgacatgttttataaaaaaaggaaaaaaaacatttaaaactaaaaaatatttttaggtattttcacaaacaaactggcttttaaataaatttgcttccatattggttgaataagacaaaaacaattaaactgagtgggaagtgaataaaaaaaggctttaggtatcgattccatatttttcaaagccaaatatgtaaatgctaaggaaagtaaacaaagaggagattccaatcttgtaatttaatattgttattaaaactttaatgtatcctattctttaacatttggtgttaatataaaattacttggcaatgcttgacatttgaaataaacatttttctattgttttattgcaagtggtccaattaattttgcttagctacagtttggtcataaatcaagtgagtttaaagacactaccaagttgttaggtgcccagagaaaatttctcccttttaacaaaggccaggtgatttcttcaaatgtaatcttgcccccaaagtaactactctgaatatctttttgacatgtctaaatatatactactatactacaagaacactatttgttaacacaaaagcattcgatctatgtacgataaatgctcaatagatttaaaaagctaatattaacaaataccagaatacgtgaagttccatttttaaagtgtttgagcttacagaagagaaacattcattttaaatgacagtaaacaaatgccttgtaaagtaatatctttagatagcttgcccaattgattaacattccaacaaacctaacatatgtctctcagctttaaacattatacaaagcctgtcatcacactttactatattatgaan

SEQ ID NO: 62558 - DNA, 2388 bp, Homo sapiens
  misc_feature (2388)..(2388): n is a, c, g, or t
acacaaacagcaaaatcaaaccacaagtgtgttagtgggaatgacccatcttaaatagaatgtaaatgcaaatatgcatgagatgcataatttggtaagatgttttggtaatgcctgcagagttactgatttgttgtttttattttattttaaatatagtatatgcatttaatatatttatttcagtctgtgttcatgtctaactcatacataatagtgcatgaaacagcaacatactgaaatagagtaaatggcctaatgagaacattaatgaaacacttaagattaagtgattatagggatgtgtgttttccttgtctgttttgatggcacagttgcagcatctatagtatcactgattggcaagactattcgtgtgcatcatgtgtgctctgtttgtattgaatggcaaagctttgttgtgagatgtagtctagtggatgagagtacactgaggggatgaattttggagaccaagagatcaaaaatggtacactgcaattctaaacatgtccaaagcctacttggagagtgagaatgtactggaaccttcaccagccaacatattgcaggataacttcctgaaggtttatcttagccatcttagtactttgagggattggaaatgtggtcagtcctccatttatgactctactaagccagtaacatggtcaacatttaaaacttgcttctacaatcacacgtatggtttattttagccctgttcgctgtcagctttaccagattatttataggatgaaggaaactgtcttgtaccttcaatttttcccacggaaaagaccagtgccctcagtctgagcaacgttgctggagtattctacatccttgtcgggggccttggtttggcaatgctggtggctttgattgagttctgttacaagtcaagggccgaggcgaaacgaatgaaggtggcaaagaatgcacagaatattaacccatcttcctcgcagaattcacagaattttgcaacttataaggaaggttacaacgtatatggcatcgaaagtgttaaaatttaggggatgaccttgaatgatgccatgaggaacaaggcaaggctgtcaattacaggaagtactggagaaaatggacgtgttatgactccagaatttcccaaagcagtgcatgctgtcccttacgtgagtcctggcatgggaatgaatgtcagtgtgactgatctctcgtgattgataagaaccttttgagtgccttacacaatggttttcttgtgtgtttattgtcaaagtggtgagaggcatccagtatcttgaagacttttctttcagccaagaattcttaaatatgtggagttcatcttgaattgtaaggaatgattaattaaaacacaacatctttttctactcgagttacagacaaagcgtggtggacatgcacagctaacatggaagtactataatttacctgaagtctttgtacagacaacaaacctgtttctgcagccactattgttagtctcttgattcataatgacttaagcacacttgacatcaactgcatcaagatgtgacatgttttataaaaaaaggaaaaaaaacatttaaaactaaaaaatatttttaggtattttcacaaacaaactggcttttaaataaatttgcttccatattggttgaataagacaaaaacaattaaactgagtgggaagtgaataaaaaaaggctttaggtatcgattccatatttttcaaagccaaatatgtaaatgctaaggaaagtaaacaaagaggagattccaatcttgtaatttaatattgttattaaaactttaatgtatcctattctttaacatttggtgttaatataaaattacttggcaatgcttgacatttgaaataaacatttttctattgttttattgcaagtggtccaattaattttgcttagctacagtttggtcataaatcaagtgagtttaaagacactaccaagttgttaggtgcccagagaaaatttctcccttttaacaaaggccaggtgatttcttcaaatgtaatcttgcccccaaagtaactactctgaatatctttttgacatgtctaaatatatactactatactacaagaacactatttgttaacacaaaagcattcgatctatgtacgataaatgctcaatagatttaaaaagctaatattaacaaataccagaatacgtgaagttccatttttaaagtgtttgagcttacagaagagaaacattcattttaaatgacagtaaacaaatgccttgtaaagtaatatctttagatagcttgcccaattgattaacattccaacaaacctaacatatgtctctcagctttaaacattatacaaagcctgtcatcacactttactatattatgaan

SEQ ID NO: 62559 - DNA, 709 bp, Homo sapiens
ctaaaattgcagtgtttgataaaatgtggacctacatgcggagtgcggagccctctgtgtttgtgaggactacggccgaaggggtggctagagtgcggaagtccaaagggaaatatgcctacttgttggagtccacgatgaacgagtacattgagcaaaggaagccttgcgacaccatgaaagttggtggaaacctggattccaaaggctatggcatcgcaacacctaaaggatcctcattaagaaatgcggttaacctcgcagtactaaaactgaatgaacaaggcctgttggacaaattgaaaaacaaatggtggtacgacaaaggagagtgcggcagcgggggaggtgattccaaggtcagccccagtgagaaaagtaatgggtaactcaatgcaaaacaaagtaagcagcagctatgcacagtgtgggcactccgtccagccaagtttccaacgctaagctgaagagtgcaattggatgaccaggacacttgacttcttctttctttcttcctctacttctctttccctctctttctccatatctcaaggaaaaatttgtaactaatggatttgttgcaaactgttgcacctgctggttacttccagcgatacattaatgctcatttggctctgcaaatcttaccgtttgcttaggccaaatggcgcatcaatgactatcgctcttacaaagctcttgaatcagt

SEQ ID NO: 62560 - DNA, 741 bp, Homo sapiens
  misc_feature (631)..(631): n is a, c, g, or t
  misc_feature (720)..(720): n is a, c, g, or t
  misc_feature (731)..(731): n is a, c, g, or t
ctaaaattgcagtgtttgataaaatgtggacctacatgcggagtgcggagccctctgtgtttgtgaggactacggccgaaggggtggctagagtgcggaagtccaaagggaaatatgcctacttgttggagtccacgatgaacgagtacattgagcaaaggaagccttgcgacaccatgaaagttggtggaaacctggattccaaaggctatggcatcgcaacacctaaaggatcctcattaagaaatgcggttaacctcgcagtactaaaactgaatgaacaaggcctgttggacaaattgaaaaacaaatggtggtacgacaaaggagagtgcggcagcgggggaggtgattccaagtattgaaactcagtgagcaaggcgtcttagacaagctgaaaaacaaatggtggtacgataaaggtgaatgtggagccaaggactctggaagtaaggaaaagaccagtgccctcagtctgagcaacgttgctggagtattctacatccttgtcgggggccttggtttggcaatgctggtggctttgattgagttctgttacaagtcaagggccgaggcgaaacgaatgaaggtggcaaagaatgcacagaatattaacccatcttcctcgcanaatcacagaattttgccacttataaggaagtaccacgtatatgcatcaaagtgtattaagggatacttgaatgatccatagacaagcangctgcaattcngggtctgttg

SEQ ID NO: 62561 - DNA, 257 bp, Homo sapiens
accttacccaaagtttcagatttttagtagctcatagtaacatattattgtggcctttttcccacttcatttttttgtgacaagagttgccacagaagccaaagaaaaacaaattaaaacaaaacaaacaaaaagtctaaaatttgctcaccctgtctgacaagtatgttttatcgtttcaagaaatgcggttaacctcgcagtactaaaactgaatgaacaaggcctgttggacaaattgaaaaacaaatggtggt

SEQ ID NO: 62562 - DNA, 1717 bp, Homo sapiens
  misc_feature (1)..(1): n is a, c, g, or t
  misc_feature (3)..(3): n is a, c, g, or t
  misc_feature (5)..(5): n is a, c, g, or t
  misc_feature (7)..(7): n is a, c, g, or t
  misc_feature (1717)..(1717): n is a, c, g, or t
ncntnangaaccccagtaaatcttgcagtattgaaactcagtgagcaaggcgtcttagacaagctgaaaaacaaatggtggtacgataaaggtgaatgtggagccaaggactctggaagtaaggaaaagaccagtgccctcagtctgagcaacgttgctggagtattctacatccttgtcgggggccttggtttggcaatgctggtggctttgattgagttctgttacaagtcaagggccgaggcgaaacgaatgaaggtggcaaagaatgcacagaatattaacccatcttcctcgcagaattcacagaattttgcaacttataaggaaggttacaacgtatatggcatcgaaagtgttaaaatttaggggatgaccttgaatgatgccatgaggaacaaggcaaggctgtcaattacaggaagtactggagaaaatggacgtgttatgactccagaatttcccaaagcagtgcatgctgtcccttacgtgagtcctggcatgggaatgaatgtcagtgtgactgatctctcgtgattgataagaaccttttgagtgccttacacaatggttttcttgtgtgtttattgtcaaagtggtgagaggcatccagtatcttgaagacttttctttcagccaagaattcttaaatatgtggagttcatcttgaattgtaaggaatgattaattaaaacacaacatctttttctactcgagttacagacaaagcgtggtggacatgcacagctaacatggaagtactataatttacctgaagtctttgtacagacaacaaacctgtttctgcagccactattgttagtctcttgattcataatgacttaagcacacttgacatcaactgcatcaagatgtgacatgttttataaaaaaaggaaaaaaaacatttaaaactaaaaaatatttttaggtattttcacaaacaaactggcttttaaataaatttgcttccatattggttgaataagacaaaaacaattaaactgagtgggaagtgaataaaaaaaggctttaggtatcgattccatatttttcaaagccaaatatgtaaatgctaaggaaagtaaacaaagaggagattccaatcttgtaatttaatattgttattaaaactttaatgtatcctattctttaacatttggtgttaatataaaattacttggcaatgcttgacatttgaaataaacatttttctattgttttattgcaagtggtccaattaattttgcttagctacagtttggtcataaatcaagtgagtttaaagacactaccaagttgttaggtgcccagagaaaatttctcccttttaacaaaggccaggtgatttcttcaaatgtaatcttgcccccaaagtaactactctgaatatctttttgacatgtctaaatatatactactatactacaagaacactatttgttaacacaaaagcattcgatctatgtacgataaatgctcaatagatttaaaaagctaatattaacaaataccagaatacgtgaagttccatttttaaagtgtttgagcttacagaagagaaacattcattttaaatgacagtaaacaaatgccttgtaaagtaatatctttagatagcttgcccaattgattaacattccaacaaacctaacatatgtctctcagctttaaacattatacaaagcctgtcatcacactttactatattatgaan

SEQ ID NO: 62563 - DNA, 201 bp, Homo sapiens
  misc_feature (2)..(2): n is a, c, g, or t
  misc_feature (5)..(7): n is a, c, g, or t
  misc_feature (9)..(9): n is a, c, g, or t
  misc_feature (12)..(12): n is a, c, g, or t
gnagnnngnggnctccctgcccagcaaccggtagtggtacctgagaacaaaggaggagaaggaggctttggacacaggtgtggagaagcccaaggaggaagaagaagacttggactatgggatgctggatggcctcaaggaccccctcccagaaaaggaactttgaggctgagatgaaagtgctccctatttctatcctgg

SEQ ID NO: 62564 - DNA, 467 bp, Homo sapiens
gttttaatttaatgactatagcctgtactacactcattatataatagggtgacaaatactttaataatagattacatattacatccaataacaatacgttattgatttattagaaaataaatgggtatataactccatttgtcaaatcagttcagccggaaccataggttggctatggattgcaaaagttctgcaaaaatcaatgaaagcagtctgtaggaaccaatagtaaaatttacaaatagtaaattgtgtgtaacaatcttttatatcagaaaaatttataataaatatgtatgtatataaatgcatgcgtttttctttaagagtcagttgttgaacatttaccagcacaccactggagctatctaatggataatatatatttaagtttcttttgtgatgagaacctattttatatcttatcacaaagtctttaataaaatatcaatttttctttaaatttg

SEQ ID NO: 62565 - DNA, 403 bp, Homo sapiens
gtttcgccattttagccaggctggtcttgaactcctaaccccaagtgatccacctgcctcggcctcccaaagtgctgggattaaaggtatgagccattgcttccagccagaaaacattttaaaacagctgaagaatattccactaatggatatattatttatagaaccaatttatattgtgttcacacttagagcgtttattaatttctgattattataaaacacaatgaatattgctaaatatgactttcagtatttctgtattctcaaaatagattattgtaagtggaattatcaagtcaaagtgtattaacatttctagagctctcaggagagcaaaacattgcacagttgctttctagaatggctgtacaagtttacatttccattaacagtgtatgag

SEQ ID NO: 62566 - DNA, 860 bp, Homo sapiens
ctaccactgtctgatgacagtacagcctgtgccacttcttcctacaagagctagtaccaagaggggcattctcatgtagtcatgtaatgagggtgatggcaatcttacgaagcagaaaacactgataaaccataggattcatttttgaactttttgtatctatgtgtcacacacccaaattcacttagaaaacaggtataatgcagaagtgttccatagcttagcattaggtgactagaacagactgctcttcttctcacaaaaataatctgaatagaccatcagtttctaattttctgtaaaattcatttttttgtacccagaatcatctcattaaaatagggttttactgagtaacagtgttcctacctaatttgcagaggaatactaaaattctaggtaatagacctaaaagagaaaatccttgtcatctgtatcatttacttgccaacagttaatttttcttaggtattcagtgattatactatattttgcaaaggccatgaaaatattcaacagatttttttaaagaaaggatctaagcagatttttagaagtgtgtttggtttcatcttattatatgcacaaatttctcctttttttctgaaaatgaaaggaaggggaggggagaagagagggaagaaaagagagagacgtttctttgaaaactgttaagatttttttcctcaatgaacttttttttttttttcagacagagtctcactttgtcgcccaggctggagtacagtggcacaatctcagttcactgcaacctctgcctttcagattcaagtgattctcctgcctcaacctcccgatgttgagcatctggtcatggtgttggtcatcagacaaggtat

SEQ ID NO: 62567 - DNA, 360 bp, Homo sapiens
cagacagagtctcactttgtcgcccaggctggagtacagtggcacaatctcagttcactgcaacctctgcctttcagattcaagtgattctcctgcctcaacctcccaagtagctgggatcacaggcatgtgctaccacacccggctaatttttgtatttttagtagagacagggttttgccaagttggccagtctggtcttgaactcgtgacctcaggtgatccacccatctcagcctcccaaagtgctggaattacaggcttgagccacggtgccgggcccctccatgaccttttatgcctccaccaagcctacagataccaccataataaagttaaaactggttctagttgttacat

SEQ ID NO: 62568 - DNA, 163 bp, Homo sapiens
tttttttaagcaaattacttactgtatttttatggcaggagggagaaaaagtgttacaacggtttctaatgaagtccggtatttaaatgataaatgactaatgtgtttagtagagacaaaataaaccaataaatgattgttctttgccatttaaaacaggaaa

SEQ ID NO: 62569 - DNA, 402 bp, Homo sapiens
tgctaaatgatagaagacagattcaaagttgtagttactgcgtaactttatttatgaggcattttagaataggcaaaactgatctgttgtggtagaagtaagaagtggggtaccctctggaggaagagaatttactttgaagtggcatgagaggatttgtttggctaatgaaattatttttatatctgagtagggttgtgggttacacagtttaggcatttgtcaaaactcatggaaccattcatccaagtcctgtgcattttactgtgtgaaaattatatctcgacttttttcaaaaaagaaaaaaatacttaattataatatagcatttatgaattaaaataatccctttatgtaaaaatattttattggattggtcaagattcatgattgcaaacaaca

SEQ ID NO: 62570 - DNA, 785 bp, Homo sapiens
acctggccaacatggtgaaaccctatctctactaaaaaaataaaaataaaaaaaattagccaagcatggtttggaagactgaggcaggagaatcacttgaacctggaaggcagaggttacagtgagccaagatcgtgccacttcactgcagcctgggcgacagagcgagactatctcaaaagaaaaaaaatccaaggagaaaaaaatatcttagggtattctggaagtggttgttgagtatatatatgtgtatgtgtactcaatttaatgtaaaaaattgttttcagtttcttaaatatgtgattgattatattgctcaaccctgtttattatacgcagattcctttggacgaggtgttctaacagtcttagaacatctgatatatgggatcaaaagttaccttgaaaaatgacttctagtgtatacctttaacagcctcctttttgtgaattttcactgttcttaccaagaaacttaagtgtttttgagatgggacctgttggcaatggaactgtgttcaccctctcaaagatcattaaaatcaacgttatctaagacagctgtatcacatttttgggatacatcatggtacagtcagaagcatataaaattatggttctgcttgtcagtcacatacagaatccaatacattttgacaaactgcccattcctgcaagttaatgccctttttgaagcttcatttcctcttgtaaagtacagataggaatcattattttgtggagttgctgtaaagattaaataaaggtgaatgaaaataaaagta

SEQ ID NO: 62571 - DNA, 364 bp, Homo sapiens
acgaaactgtttagtacgggaaacttgaggagtcagctgtactcgttcagaaatccttttatgtttcacatgtttatttggttagaaacgtgttttcagaaaattgctaatttggtatcctacatgtatgtgagggcagtgaggaaaagttgaggtttataaaaaatattgctggtaatagatatttttcttcctataaaaattgttatttttttatttttagaaactcatgcattaaaaagtaaatgtttatccataccttcaaagtgttaattttttctggtctttcagtaattttgaaatatttctgtaattgcttacaaagaatatattacttaaatgtctcaataaaattttctttttg

SEQ ID NO: 62572 - DNA, 347 bp, Homo sapiens
caatgaactccttaagctttgttaatatgagaatgtctttatctcttctttatttccaaaggacagctttgctggttaaaatattcttggttaagttttgtttttagtacttagcatatatcattccactctctcctggcctgtaaagcctctgctgaaagatccacttctagccttattgaaactcccttctatgttattcgtttcttcctcttgctgcttccaacatcctgtctttgtccataatttgtaacagattgaatataatatgaattagtcctctttagactgaatctcattggagacttttcaccttcttgtttttggatatttatttcttttcacag

SEQ ID NO: 62573 - DNA, 418 bp, Homo sapiens
gctacagctagctatggttgcaccactgcacttcagcctggacaagagagagagaccctatctccaaaacaaacaggccgggtgaagtgagtcacgcctgtactcccaaagtgctgggattacaggcgtgagccaccgcgcccgaccggtgggatacttcttattacaaagaaaaacagaggctgggtgcggtgacccctgcctataagcccagcactttgggaagcctacacaggtgaatctcttgagtccaggagttccagaccaggctaagtaacatggcgaaaccctgtctgtacaaaaaatacgaaaataagccaggtgtagtggtacgcgcctgtcatcccagctacccgggaggttgaggtgggaggactgattgaacccaggaggtcgaggctgcagtgagccatgatcg

SEQ ID NO: 62574 - DNA, 295 bp, Homo sapiens
atgaggcgaggcctgcgaagtggctggcatgcagcaggtgctaatgagtgttgcaaaggtgatgtcacgcaggcagcttcccgtggccagagaaacattgcagagaagggataagtagggcttagtgactttgacgggtcaatggaagaatgacccaaagaaggcttcaaggccaggcctgcagttctccaccacaaaggccctcactgatagcacccactcccccacactcagctttggggcctaggtctggtcacccagctagaagccacaggaccctgaggcgtccgagggt

SEQ ID NO: 62575 - DNA, 342 bp, Homo sapiens
tcgagaaattcgagtaagctacaagagaagagacgagatgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctcgtctcttctctgtacatctcgtctcttctcttgtgaggggatacctctgagagtcg

SEQ ID NO: 62576 - DNA, 525 bp, Homo sapiens
tcgagaaattcgagtaagctacaagagaagagacgagatgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctcgtctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccattttttttttgttcaaatgattttaattattggaatgcacaatttttttaatatgcaaataaaaagtttaaaaacttaaaaaaaa

SEQ ID NO: 62577 - DNA, 1197 bp, Homo sapiens
tcgagaaattcgagtaagctacaagagaagagacgagatgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctcgtctatctggctggcagggaaggaaagaacttgcatgttggtgaaggaagaagtggggtggaagaagtggggtgggacgacagtgaaatctagagtaaaaccaagctggcccaaggtgtcctgcaggctgtaatgcagtttaatcagagtgccattttttttttgttcaaatgattttaattattggaatgcacaatttttttaatatgcaaataaaaagtttaaaaacttaaaaaaaaaaaaaaaaaaaaaaaaaaaaaaaaaaaaaaaaaaaaaaaaaaaaaaataaaaaaaaaaaaaaaaaaaaaaaaaaaaaaaaaaaaaaaaaaaaaaaaaaaaaaaagacaaaagaaaaaaaaaaaaaaaaaaaaaatcttttttctcggcgtgggacccatggcattttaaattgaaaaaaattttgttttgggccccaatttggaaataatttagaaattccccttttttgggaggaattataaaaaacacggggcccgtttaaaaaatgcatgaggggaaaaaaaccaagcctcccaaaaaaaaaactgattaaaaaaataccctttttcctttttggggtaaaaaaaaaaaaagccaaacctaaaaccctttcaaaaaagaaaaacctcattaaaggaaaaaaaaataggaaaagggaaaatttttctataaaagcgtggaaaaattgggaaaaaacgaaaatttttaaaaaaaaacaaaaaaggaaaaaaatttataaaaaaaaaaaaaacccgaaccggggtgggttttttccctttgcacaaaaaaccccttttaataaacggggccccgcccaaaaggagaaaacccattattagggatagggccctccgcggaaacagccctaaaaagttttggggcgggggggggaaaagaccttgaggcgcctt

SEQ ID NO: 62578 - DNA, 339 bp, Homo sapiens
tcgagaaattcgagtaagctacaagagaagagacgagatgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaagacactgacccagtcaagccgaatttcagtacaatggaggcggttactaggggatccgagctcgggaccaagcttgg

SEQ ID NO: 62579 - DNA, 196 bp, Homo sapiens
tcagcacactgctgcagagactcgtgtagaatgtgaatgtgacgacagtgaatctagagtaacagctgtgcagtgtcctgcaggctgtaatgcagtttaatcagagtgccattttttttttgttcaaatgattttaattattggaatgcacaatttttttaatatgcaaataaaaagtttaaaaacttaaaaaaaa

SEQ ID NO: 62580 - DNA, 321 bp, Homo sapiens
  misc_feature (308)..(308): n is a, c, g, or t
aagtgaaagcaagtttattaagaaagtaaaggaataaaagaatggctactccagaggcagagcagcagcatgggttgctcaactctgatatttctttaacaagttaattagtttgtttattcaactaatatttactgagcatcctaatatgtgccaggcactctgtaatactctggagatatcaggagaatcacttgaacctgggaggtggaggttgcagtgagcctaggcagattattttgtacctctttaagactcagtttcctcatctgtaaaatgtgggaaatagtctcctgggaaggttggtntaaggattaaatg

SEQ ID NO: 62581 - DNA, 3081 bp, Homo sapiens
  misc_feature (1)..(4): n is a, c, g, or t
nnnngagatcgggaatcctctcagtccttagttacaaggctccatcctcactttgttcgctcctcagtcgtccaggcggattcctttttcgccaggcaccaaggcacagcttagagtagacccgagtcctgctctgcggagttcgtcttcccagcgaaggtacagaggcggatgaactgctgagacttgattgacgtattttaagatttttttaacttctgaagtctagcaggcctgtaagaacaaaaatcattctgtaggaattaaaaacagaatccagtcttgacaacatatccacaatgtctgatgtatctactagtgtacaatcaaaatttgctagacttgcaaagaaaaaggaaaatatcacctatatgaaaagagagcagttaacagaaactgataaggacatagctccggtattagatttaaaatgcaaggacgtatcagcaattatgaataagtttaaggtcttaatggaaattcaagacctgatgtttgaggagatgagggaaactcttaaaaatgacctaaaagcagttttaggaggaaaagctacaatacctgaggtaaagaattcagagaactccagtagtaggacagagtttcagcaaataatcaatttagcattacaaaaaacagggatggtagggaaaatagaaggagaaaactctaaaataggtgatgataatgaaaatttaacctttaaattagaagtaaatgagctgagtggtaaattagacaacactaacgaatacaatagtaatgatggtaagaaattaccccagggtgaatcacgaagttacgaagtcatgggaagtatggaagaaaccttatgcaatatagatgacagagatggaaatcgcaatgtccatttagaatttacagaaagagagagtaggaaggatggagaggatgaatttgtcaaagaaatgagagaggaaagaaaatttcagaaattgaagaataaagaggaggttttaaaagcctccagagaagaaaaagtgttgatggatgaaggagcagtacttaccctggtagccgacctttcatcagcaacactggatattagtaagcaatggagtaatgtcttcaacattctgagagaaaatgattttgaacctaaatttctgtgtgaagttaaattagcatttaaatgtgatggtgaaataaagacattttcagatctgcaaagccttagaaaatttgccagccaaaaatcttctatgaaagaattactgaaagatgtactcccacaaaaggaagaaataaatcaaggaggaagaaaatatggaattcaagaaaaaagggataaaaccctaatagactcaaagcatagagctggagaaataaccagtgatggcttgagcttcctatttcttaaagaagtaaaagttgctaagccagaggagatgaaaaacttagagactcaagaggaagagttttccgagctagaggagctggatgaagaggcctcagggatggaggatgatgaagatacctcagggctggaggaggaggaggaagagccctcagggctggaggaggaagaagaagaagaggcttcagggttggaggaggatgaggcctcagggctagaggaggaagaggaacagacttcagaacaggactcaacctttcagggtcatactttggtagatgcaaagcatgaagttgagataaccagtgatggcatggaaactactttcattgactctgtagaggattctgaatcagaggaggaagaagaaggaaagagctctgaaacaggaaaggtaaagactacctccctgactgagaaaaaagcctcacgtagacaaaaagaaattccctttagttatttggttggggactctgggaagaaaaagttggtgaaacaccaggtggtgcacaaaacccaggaggaagaggaaacagctgtgcccacaagtcaaggaactggcacaccctgtctgaccttatgtttggcctctccctcaaagtcactagagatgagtcatgatgagcataaaaagcattcacatacaaatttgagtatttcaacaggagtcaccaaacttaagaaaacagaagaaaagaaacacagaactctgcacacagaagaactaacatccaaagaagcagacttaacagaggaaacagaagaaaacttgagaagtagtgtgattaatagcatcagagagataaaagaggagattggaaatttgaaaagttcccattcaggtgtcttggaaattgaaaattcagtagatgatctgagtagcagaatggacatacttgaagaaagaatagacagtctagaagatcaaattgaagaattctctaaggatacaatgcaaatgaccaaacagataattagtaaagaaaggcaaagagatatagaggagagatctagaagttgcaacattcgtttgataggaattccagaaaaggagagttatgagaatagggcagaggacataattaaagaaataattgatgaaaactttgcagaactaaagaaaggttcaagtcttgagattgtcagtgcttgtcgagtacctagtaaaattgatgaaaagagactgactcctagacacatcttggtgaaattttggaattctagtgataaagagaaaataataagggcttctagagagagaagagaaattacctaccaaggaacaagaatcaggttgacagcagacttatcactggacacactggatgctagaagtaaatggagcaatgtcttcaaagttctgctggaaaaaggctttaatcctagaatcctatatccagccaaaatggcatttgattttaggggtaaaacaaaggtatttcttagtattgaagaatttagagattatgttttgcatatgcccaccttgagagaattactggggaataatataccttagcactccagggtgactacaaacaatatgctttcctcccccagcatgcatccaaaaatcaacaagtaaaacgaaaatacacttctacccagaaggatggacagctaatagcgtacttggggatgaggagcaaggaatattacagatattacctagatgttaataaagggtatgtttaaaaaaaata

SEQ ID NO: 62582 - DNA, 1617 bp, Homo sapiens
  misc_feature (1470)..(1470): n is a, c, g, or t
agcagccaaggcttactgaggctggtggagggagccactgctgggctcaccatggaccgccggatgtggggggcccacgtcttctgcgtgttgagcccgttaccgaccgtattgggccacatgcacccagaatgtgacttcatcacccagctgagagaggatgagagtgcctgtctacaagcagcagaggagatgcccaacaccaccctgggctgccctgcgacctgggatgggctgctgtgctggccaacggcaggctctggcgagtgggtcaccctcccctgcccggatttcttctctcacttcagctcagagtcaggggctgtgaaacgggattgtactatcactggctggtctgagccctttccaccttaccctgtggcctgccctgtgcctctggagctgctggctgaggaggaatcttacttctccacagtgaagattatctacaccgtgggccatagcatctctattgtagccctcttcgtggccatcaccatcctggttgctctcaggaggctccactgcccccggaactacgtccacacccagctgttcaccacttttatcctcaaggcgggagctgtgttcctgaaggatgctgcccttttccacagcgacgacactgaccactgcagcttctccactgttctatgcaaggtctctgtggccgcctcccatttcgccaccatgaccaacttcagctggctgttggcagaagccgtctacctgaactgcctcctggcctccacctcccccagctcaaggagagccttctggtggctggttctcgctggctgggggctgcccgtgctcttcactggcacgtgggtgagctgcaaactggccttcgaggacatcgcgtgctgggacctggacgacacctccccctactggtggatcatcaaagggcccattgtcctctcggtcggggtgaactttgggctttttctcaatattatccgcatcctggtgaggaaactggagccagctcagggcagcctccatacccagtctcagtattggcgtctctccaagtcgacacttttcctgatcccactctttggaattcactacatcatcttcaacttcctgccagacaatgctggcctgggcatccgcctccccctggagctgggactgggttccttccagggcttcattgttgccatcctctactgcttcctcaaccaagaggtgaggactgagatctcacggaagtggcatggccatgaccctgagcttctgccagcctggaggacccgtgctaagtggaccacgccttcccgctcggcggcaaaggtgctgacatctatgtgctaggctgcctcatcacgccactggagtccacacttgaatttgggcagctaccacgggtctgccatgctctggaggagcaagggggccacatccccaccccagctgttacccagcccggggcaggtgcagcccttcctccctgtctctgcntctgactctcttttgaggtccctgtatgtctacctctgacttctgtggtccctctgtgtctgctctcatccattcctcttactggggcctggggctctagcccaaggctcagaggagccaataaacctgtaaatgaaaaaaaaaaaa

SEQ ID NO: 62583 - DNA, 1478 bp, Homo sapiens
  misc_feature (1331)..(1331): n is a, c, g, or t
tcacttccctggcctaggtgctgggacagtgagggcctcttttctccctactgcccttaggatgctggcagcccagctcaccactcctcacccctcaggggaataatcctctttgtgaagagatggcacctttgaagccagagaaggaaggccccatagtgtgtccctgggcaggctagacctgggccccaggcctctggagccaccctctctgttgctcagaggagctgtccatgcaaaccctgccagggtcacttgatggtccctggcacccccagccccctcctggggagagggaaggagttgtggctagagagtcttgcttgcctcccaggggctgtgaaacgggattgtactatcactggctggtctgagccctttccaccttaccctgtggcctgccctgtgcctctggagctgctggctgaggaggaatcttacttctccacagtgaagattatctacaccgtgggccatagcatctctattgtagccctcttcgtggccatcaccatcctggttgctctcaggaggctccactgcccccggaactacgtccacacccagctgttcaccacttttatcctcaaggcgggagctgtgttcctgaaggatgctgcccttttccacagcgacgacactgaccactgcagcttctccactggctgcccgtgctcttcactggcacgtgggtgagctgcaaactggccttcgaggacatcgcgtgctgggacctggacgacacctccccctactggtggatcatcaaagggcccattgtcctctcggtcggggtgaactttgggctttttctcaatattatccgcatcctggtgaggaaactggagccagctcagggcagcctccatacccagtctcagtattggcgtctctccaagtcgacacttttcctgatcccactctttggaattcactacatcatcttcaacttcctgccagacaatgctggcctgggcatccgcctccccctggagctgggactgggttccttccagggcttcattgttgccatcctctactgcttcctcaaccaagaggtgaggactgagatctcacggaagtggcatggccatgaccctgagcttctgccagcctggaggacccgtgctaagtggaccacgccttcccgctcggcggcaaaggtgctgacatctatgtgctaggctgcctcatcacgccactggagtccacacttgaatttgggcagctaccacgggtctgccatgctctggaggagcaagggggccacatccccaccccagctgttacccagcccggggcaggtgcagcccttcctccctgtctctgcntctgactctcttttgaggtccctgtatgtctacctctgacttctgtggtccctctgtgtctgctctcatccattcctcttactggggcctggggctctagcccaaggctcagaggagccaataaacctgtaaatgaaaaaaaaaaaa

SEQ ID NO: 62584 - DNA, 1247 bp, Homo sapiens
  misc_feature (1100)..(1100): n is a, c, g, or t
tcacttccctggcctaggtgctgggacagtgagggcctcttttctccctactgcccttaggatgctggcagcccagctcaccactcctcacccctcaggggaataatcctctttgtgaagagatggcacctttgaagccagagaaggaaggccccatagtgtgtccctgggcaggctagacctgggccccaggcctctggagccaccctctctgttgctcagaggagctgtccatgcaaaccctgccagggtcacttgatggtccctggcacccccagccccctcctggggagagggaaggagttgtggctagagagtcttgcttgcctcccaggggctgtgaaacgggattgtactatcactggctggtctgagccctttccaccttaccctgtggcctgccctgtgcctctggagctgctggctgaggagggctgcccgtgctcttcactggcacgtgggtgagctgcaaactggccttcgaggacatcgcgtgctgggacctggacgacacctccccctactggtggatcatcaaagggcccattgtcctctcggtcggggtgaactttgggctttttctcaatattatccgcatcctggtgaggaaactggagccagctcagggcagcctccatacccagtctcagtattggcgtctctccaagtcgacacttttcctgatcccactctttggaattcactacatcatcttcaacttcctgccagacaatgctggcctgggcatccgcctccccctggagctgggactgggttccttccagggcttcattgttgccatcctctactgcttcctcaaccaagaggtgaggactgagatctcacggaagtggcatggccatgaccctgagcttctgccagcctggaggacccgtgctaagtggaccacgccttcccgctcggcggcaaaggtgctgacatctatgtgctaggctgcctcatcacgccactggagtccacacttgaatttgggcagctaccacgggtctgccatgctctggaggagcaagggggccacatccccaccccagctgttacccagcccggggcaggtgcagcccttcctccctgtctctgcntctgactctcttttgaggtccctgtatgtctacctctgacttctgtggtccctctgtgtctgctctcatccattcctcttactggggcctggggctctagcccaaggctcagaggagccaataaacctgtaaatgaaaaaaaaaaaa

SEQ ID NO: 62585 - DNA, 1632 bp, Homo sapiens
  misc_feature (1485)..(1485): n is a, c, g, or t
tcacttccctggcctaggtgctgggacagtgagggcctcttttctccctactgcccttaggatgctggcagcccagctcaccactcctcacccctcaggggaataatcctctttgtgaagagatggcacctttgaagccagagaaggaaggccccatagtgtgtccctgggcaggctagacctgggccccaggcctctggagccaccctctctgttgctcagaggagctgtccatgcaaaccctgccagggtcacttgatggtccctggcacccccagccccctcctggggagagggaaggagttgtggctagagagtcttgcttgcctcccaggggctgtgaaacgggattgtactatcactggctggtctgagccctttccaccttaccctgtggcctgccctgtgcctctggagctgctggctgaggaggaatcttacttctccacagtgaagattatctacaccgtgggccatagcatctctattgtagccctcttcgtggccatcaccatcctggttgctctcaggaggctccactgcccccggaactacgtccacacccagctgttcaccacttttatcctcaaggcgggagctgtgttcctgaaggatgctgcccttttccacagcgacgacactgaccactgcagcttctccactgttctatgcaaggtctctgtggccgcctcccatttcgccaccatgaccaacttcagctggctgttggcagaagccgtctacctgaactgcctcctggcctccacctcccccagctcaaggagagccttctggtggctggttctcgctggctgggggctgcccgtgctcttcactggcacgtgggtgagctgcaaactggccttcgaggacatcgcgtgctgggacctggacgacacctccccctactggtggatcatcaaagggcccattgtcctctcggtcggggtgaactttgggctttttctcaatattatccgcatcctggtgaggaaactggagccagctcagggcagcctccatacccagtctcagtattggcgtctctccaagtcgacacttttcctgatcccactctttggaattcactacatcatcttcaacttcctgccagacaatgctggcctgggcatccgcctccccctggagctgggactgggttccttccagggcttcattgttgccatcctctactgcttcctcaaccaagaggtgaggactgagatctcacggaagtggcatggccatgaccctgagcttctgccagcctggaggacccgtgctaagtggaccacgccttcccgctcggcggcaaaggtgctgacatctatgtgctaggctgcctcatcacgccactggagtccacacttgaatttgggcagctaccacgggtctgccatgctctggaggagcaagggggccacatccccaccccagctgttacccagcccggggcaggtgcagcccttcctccctgtctctgcntctgactctcttttgaggtccctgtatgtctacctctgacttctgtggtccctctgtgtctgctctcatccattcctcttactggggcctggggctctagcccaaggctcagaggagccaataaacctgtaaatgaaaaaaaaaaaa

SEQ ID NO: 62586 - DNA, 1302 bp, Homo sapiens
  misc_feature (1155)..(1155): n is a, c, g, or t
tcacttccctggcctaggtgctgggacagtgagggcctcttttctccctactgcccttaggatgctggcagcccagctcaccactcctcacccctcaggggaataatcctctttgtgaagagatggcacctttgaagccagagaaggaaggccccatagggctgtgaaacgggattgtactatcactggctggtctgagccctttccaccttaccctgtggcctgccctgtgcctctggagctgctggctgaggaggaatcttacttctccacagtgaagattatctacaccgtgggccatagcatctctattgtagccctcttcgtggccatcaccatcctggttgctctcaggaggctccactgcccccggaactacgtccacacccagctgttcaccacttttatcctcaaggcgggagctgtgttcctgaaggatgctgcccttttccacagcgacgacactgaccactgcagcttctccactggctgcccgtgctcttcactggcacgtgggtgagctgcaaactggccttcgaggacatcgcgtgctgggacctggacgacacctccccctactggtggatcatcaaagggcccattgtcctctcggtcggggtgaactttgggctttttctcaatattatccgcatcctggtgaggaaactggagccagctcagggcagcctccatacccagtctcagtattggcgtctctccaagtcgacacttttcctgatcccactctttggaattcactacatcatcttcaacttcctgccagacaatgctggcctgggcatccgcctccccctggagctgggactgggttccttccagggcttcattgttgccatcctctactgcttcctcaaccaagaggtgaggactgagatctcacggaagtggcatggccatgaccctgagcttctgccagcctggaggacccgtgctaagtggaccacgccttcccgctcggcggcaaaggtgctgacatctatgtgctaggctgcctcatcacgccactggagtccacacttgaatttgggcagctaccacgggtctgccatgctctggaggagcaagggggccacatccccaccccagctgttacccagcccggggcaggtgcagcccttcctccctgtctctgcntctgactctcttttgaggtccctgtatgtctacctctgacttctgtggtccctctgtgtctgctctcatccattcctcttactggggcctggggctctagcccaaggctcagaggagccaataaacctgtaaatgaaaaaaaaaaaa

SEQ ID NO: 62587 - DNA, 693 bp, Homo sapiens
ggttgttgtaaaaacaattctttatgtgtccttgaacatgatacttcttcagtttccattgtgattgccaaaggggtatattcatacccttttgaaatgaagaaatggattctctattgggtttggcttttgtgtttcttaaacctgttagcatcatgcatagagcagaaatatattaattgaactctatgaaaatacttcctaactcatagtctaactcaggtttcaaatgactacagtggctagggaagttagaattttttttccctagaagacatgtctcatgatcttttcctctctcctcctaagatggccttttcaatagctcttcacctccccactcccatctcttccatgtgccatagccttgcccctctgcttgagccacaggcactaacgtgtatttaattaggtggaagcaggcccccagccttgcaaggcaaatgtttgtatgtggtagagggtctatattaggtgtagaccctctttctgtatgaacatgtcttagactctcttcctatatgaatgagaacgtaatgatggacctctgatacacggtgtagagtaagggagtgggggctacaattgcacttgttactttttttcggggattagcatcctaggcaacaatgcaagttcttctggagtcagagcagacggaaatatgtcttccattctgattcatgtttcaaa

SEQ ID NO: 62588 - DNA, 430 bp, Homo sapiens
ggttgttgtaaaaacaattctttatgtgtccttgaacatgatacttcttcagtttccattgtgattgccaaaggggtatattcatacccttttgaaatgaagaaatggattctctattgggtttggcttttgtgtttcttaaacctgttagcatcatgcatagagcagaaatatattaattgaactctatgaaaatacttcctaactcatagtctaactcaggtttcaaatgactacagtggctagggaagttagaattttttttccctagaagacatgtctcatgatcttttcctctctctctctcatatatatatatgagggctgtatatgggggtggggggtacaattgcatttgttactttttttcggggattatcagcctaggcaacagtgcaagttcttccggagtcagagcagaaggaaatat

SEQ ID NO: 62589 - DNA, 1247 bp, Homo sapiens
ctcagcttaatagcaggacgctggcaacaggcactccctgctccagtccagcctgcgcgctccaccgccgctatggtctccgtgcctaccacctggtgctccgttgcgctagccctgctcgtggccctgcatgaagggaagggccaggctgctgccaccctggagcagccagcgtcctcatctcatgcccaaggcacccaccttcggcttcgccgttgctcctgcagctcctggctcgacaaggagtgcgtctacttctgccacttggacatcatctgggtgaacactcctgaacagacagctccttacggcctgggaaacccgccaagacgccggcgccgctccctgccaaggcgctgtcagtgctccagtgccagggaccccgcctgtgccaccttctgccttcgaaggccctggactgaagccggggcagtcccaagccggaagtcccctgcagacgtgttccagactggcaagacaggggccactacaggagagcttctccaaaggctgagggacatttccacagtcaagagcctctttgccaagcgacaacaggaggccatgcgggagcctcggtccacacattccaggtggaggaagagatagtgtcgtgagctggaggaacattgggaaggaagcccgcggggagagaggaggagagaagtggccagggcttgtggactctctgcctgcttcctggaccggggccttggtcccagacagctggacccatttgccaggattggcacaagctccctggtgagggagcctcgtccaaggcagttctgtgtcctcgcactgcccagggaagccctcggcctccagactgcggagcagcctccagtgctggctgctggcccacagctctgctggaagaactgcatggggagtacattcatctggaggctgcgtcctgaggagtgtcctgtctgctgggctacaaaccaggagcaaccgtgcagccacgaacacgcatgcctcagccagccctggaggctggatggctcccctgaggctggcatcctggctggctgtgtcctctccagctttccctccccagagttcttgcaccctcattccctcgggaccctcccagtgagaagggcctgctctgcttttcctgtctgtatataacttatttgccctaagaactttgagaatcccaattatttattttaatgtattttttagaccctctatttacctgcgaacttgtgtttataataaatgaggaaacataatct

SEQ ID NO: 62590 - DNA, 1299 bp, Homo sapiens
ctcagcttaatagcaggacgctggcaacaggcactccctgctccagtccagcctgcgcgctccaccgccgctatggtctccgtgcctaccacctggtgctccgttgcgctagccctgctcgtggccctgcatgaagggaagggccaggctgctgccaccctggagcagccagcgtcctcatctcatgcccaaggcacccaccttcggcttcgccgttgctcctgcagctcctggctcgacaaggagtgcgtctacttctgccacttggacatcatctgggtgaacactcctgaattcaggtgctgaggctcagagagcttaagcgcctcccccaagatcacacagacagacagctccttacggcctgggaaacccgccaagacgccggcgccgctccctgccaaggcgctgtcagtgctccagtgccagggaccccgcctgtgccaccttctgccttcgaaggccctggactgaagccggggcagtcccaagccggaagtcccctgcagacgtgttccagactggcaagacaggggccactacaggagagcttctccaaaggctgagggacatttccacagtcaagagcctctttgccaagcgacaacaggaggccatgcgggagcctcggtccacacattccaggtggaggaagagatagtgtcgtgagctggaggaacattgggaaggaagcccgcggggagagaggaggagagaagtggccagggcttgtggactctctgcctgcttcctggaccggggccttggtcccagacagctggacccatttgccaggattggcacaagctccctggtgagggagcctcgtccaaggcagttctgtgtcctcgcactgcccagggaagccctcggcctccagactgcggagcagcctccagtgctggctgctggcccacagctctgctggaagaactgcatggggagtacattcatctggaggctgcgtcctgaggagtgtcctgtctgctgggctacaaaccaggagcaaccgtgcagccacgaacacgcatgcctcagccagccctggaggctggatggctcccctgaggctggcatcctggctggctgtgtcctctccagctttccctccccagagttcttgcaccctcattccctcgggaccctcccagtgagaagggcctgctctgcttttcctgtctgtatataacttatttgccctaagaactttgagaatcccaattatttattttaatgtattttttagaccctctatttacctgcgaacttgtgtttataataaatgaggaaacataatct

SEQ ID NO: 62591 - DNA, 1367 bp, Homo sapiens
ctcagcttaatagcaggacgctggcaacaggcactccctgctccagtccagcctgcgcgctccaccgccgctatggtctccgtgcctaccacctggtgctccgttgcgctagccctgctcgtggccctgcatgaagggaagggccaggctgctgccaccctggagcagccagcgtcctcatctcatgcccaaggcacccaccttcggcttcgccgttgctcctgcagctcctggctcgacaaggagtgcgtctacttctgccacttggacatcatctgggtgaacactcctgaattcaggtgctgaggctcagagagcttaagcgcctcccccaagatcacacaggcaagtggggaccagatgggggcagcttagctatagcctgtgtttacttctgtgagatggagtggccgcccttctccagagctagctgagagccttctttgagaacagggggaccagcctgtctgagaggggagagagactaggaggttcccaattcccaacttcagacagacagctccttacggcctgggaaacccgccaagacgccggcgccgctccctgccaaggcgctgtcagtgctccagtgccagggaccccgcctgtgccaccttctgccttcgaaggccctgggacatttccacagtcaagagcctctttgccaagcgacaacaggaggccatgcgggagcctcggtccacacattccaggtggaggaagagatagtgtcgtgagctggaggaacattgggaaggaagcccgcggggagagaggaggagagaagtggccagggcttgtggactctctgcctgcttcctggaccggggccttggtcccagacagctggacccatttgccaggattggcacaagctccctggtgagggagcctcgtccaaggcagttctgtgtcctcgcactgcccagggaagccctcggcctccagactgcggagcagcctccagtgctggctgctggcccacagctctgctggaagaactgcatggggagtacattcatctggaggctgcgtcctgaggagtgtcctgtctgctgggctacaaaccaggagcaaccgtgcagccacgaacacgcatgcctcagccagccctggaggctggatggctcccctgaggctggcatcctggctggctgtgtcctctccagctttccctccccagagttcttgcaccctcattccctcgggaccctcccagtgagaagggcctgctctgcttttcctgtctgtatataacttatttgccctaagaactttgagaatcccaattatttattttaatgtattttttagaccctctatttacctgcgaacttgtgtttataataaatgaggaaacataatct

SEQ ID NO: 62592 - DNA, 1124 bp, Homo sapiens
ctcagcttaatagcaggacgctggcaacaggcactccctgctccagtccagcctgcgcgctccaccgccgctatggtctccgtgcctaccacctggtgctccgttgcgctagccctgctcgtggccctgcatgaagggaagggccaggctgctgccaccctggagcagccagcgtcctcatctcatgcccaaggcacccaccttcggcttcgccgttgctcctgcagctcctggctcgacaaggagtgcgtctacttctgccacttggacatcatctgggtgaacactcctgagactgaagccggggcagtcccaagccggaagtcccctgcagacgtgttccagactggcaagacaggggccactacaggagagcttctccaaaggctgagggacatttccacagtcaagagcctctttgccaagcgacaacaggaggccatgcgggagcctcggtccacacattccaggtggaggaagagatagtgtcgtgagctggaggaacattgggaaggaagcccgcggggagagaggaggagagaagtggccagggcttgtggactctctgcctgcttcctggaccggggccttggtcccagacagctggacccatttgccaggattggcacaagctccctggtgagggagcctcgtccaaggcagttctgtgtcctcgcactgcccagggaagccctcggcctccagactgcggagcagcctccagtgctggctgctggcccacagctctgctggaagaactgcatggggagtacattcatctggaggctgcgtcctgaggagtgtcctgtctgctgggctacaaaccaggagcaaccgtgcagccacgaacacgcatgcctcagccagccctggaggctggatggctcccctgaggctggcatcctggctggctgtgtcctctccagctttccctccccagagttcttgcaccctcattccctcgggaccctcccagtgagaagggcctgctctgcttttcctgtctgtatataacttatttgccctaagaactttgagaatcccaattatttattttaatgtattttttagaccctctatttacctgcgaacttgtgtttataataaatgaggaaacataatct

SEQ ID NO: 62593 - DNA, 1025 bp, Homo sapiens
ctcagcttaatagcaggacgctggcaacaggcactccctgctccagtccagcctgcgcgctccaccgccgctatggtctccgtgcctaccacctggtgctccgttgcgctagccctgctcgtggccctgcatgaagggaagggccaggctgctgccaccctggagcagccagcgtcctcatctcatgcccaaggcacccaccttcggcttcgccgttgctcctgcagctcctggctcgacaaggagtgcgtctacttctgccacttggacatcatctgggtgaacactcctgaggacatttccacagtcaagagcctctttgccaagcgacaacaggaggccatgcgggagcctcggtccacacattccaggtggaggaagagatagtgtcgtgagctggaggaacattgggaaggaagcccgcggggagagaggaggagagaagtggccagggcttgtggactctctgcctgcttcctggaccggggccttggtcccagacagctggacccatttgccaggattggcacaagctccctggtgagggagcctcgtccaaggcagttctgtgtcctcgcactgcccagggaagccctcggcctccagactgcggagcagcctccagtgctggctgctggcccacagctctgctggaagaactgcatggggagtacattcatctggaggctgcgtcctgaggagtgtcctgtctgctgggctacaaaccaggagcaaccgtgcagccacgaacacgcatgcctcagccagccctggaggctggatggctcccctgaggctggcatcctggctggctgtgtcctctccagctttccctccccagagttcttgcaccctcattccctcgggaccctcccagtgagaagggcctgctctgcttttcctgtctgtatataacttatttgccctaagaactttgagaatcccaattatttattttaatgtattttttagaccctctatttacctgcgaacttgtgtttataataaatgaggaaacataatct

SEQ ID NO: 62594 - DNA, 1156 bp, Homo sapiens
ctcagcttaatagcaggacgctggcaacaggcactccctgctccagtccagcctgcgcgctccaccgccgctatggtctccgtgcctaccacctggtgctccgttgcgctagccctgctcgtggccctgcatgaagctcctggctcgacaaggagtgcgtctacttctgccacttggacatcatctgggtgaacactcctgaacagacagctccttacggcctgggaaacccgccaagacgccggcgccgctccctgccaaggcgctgtcagtgctccagtgccagggaccccgcctgtgccaccttctgccttcgaaggccctggactgaagccggggcagtcccaagccggaagtcccctgcagacgtgttccagactggcaagacaggggccactacaggagagcttctccaaaggctgagggacatttccacagtcaagagcctctttgccaagcgacaacaggaggccatgcgggagcctcggtccacacattccaggtggaggaagagatagtgtcgtgagctggaggaacattgggaaggaagcccgcggggagagaggaggagagaagtggccagggcttgtggactctctgcctgcttcctggaccggggccttggtcccagacagctggacccatttgccaggattggcacaagctccctggtgagggagcctcgtccaaggcagttctgtgtcctcgcactgcccagggaagccctcggcctccagactgcggagcagcctccagtgctggctgctggcccacagctctgctggaagaactgcatggggagtacattcatctggaggctgcgtcctgaggagtgtcctgtctgctgggctacaaaccaggagcaaccgtgcagccacgaacacgcatgcctcagccagccctggaggctggatggctcccctgaggctggcatcctggctggctgtgtcctctccagctttccctccccagagttcttgcaccctcattccctcgggaccctcccagtgagaagggcctgctctgcttttcctgtctgtatataacttatttgccctaagaactttgagaatcccaattatttattttaatgtattttttagaccctctatttacctgcgaacttgtgtttataataaatgaggaaacataatct

SEQ ID NO: 62595 - DNA, 1421 bp, Homo sapiens
  misc_feature (614)..(614): n is a, c, g, or t
ctcagcttaatagcaggacgctggcaacaggcactccctgctccagtccagcctgcgcgctccaccgccgctatggtctccgtgcctaccacctggtgctccgttgcgctagccctgctcgtggccctgcatgaagggaagggccaggctgctgccaccctggagcagccagcgtcctcatctcatgcccaaggcacccaccttcggcttcgccgttgctcctgcagctcctggctcgacaaggagtgcgtctacttctgccacttggacatcatctgggtgaacactcctgaacagacagctccttacggcctgggaaacccgccaagacgccggcgccgctccctgccaaggcgctgtcagtgctccagtgccagggaccccgcctgtgccaccttctgccttcgaaggccctggactgaagccggggcagtcccaagccggaagtcccctgcagacgtgttccagactggcaagacaggggccactacaggagagcttctccaaaggctgaggcctggaagtggactttttagagggtttgaaggctcatgactgggaaggaccacagttgttcgttcaggctgtgctgaatggagcatctcacacatgcnggggtccagaggggccaactgcccagcctgctccctctctgctgcccagttgcatctcctccctggtgcctcagtggacatttccacagtcaagagcctctttgccaagcgacaacaggaggccatgcgggagcctcggtccacacattccaggtggaggaagagatagtgtcgtgagctggaggaacattgggaaggaagcccgcggggagagaggaggagagaagtggccagggcttgtggactctctgcctgcttcctggaccggggccttggtcccagacagctggacccatttgccaggattggcacaagctccctggtgagggagcctcgtccaaggcagttctgtgtcctcgcactgcccagggaagccctcggcctccagactgcggagcagcctccagtgctggctgctggcccacagctctgctggaagaactgcatggggagtacattcatctggaggctgcgtcctgaggagtgtcctgtctgctgggctacaaaccaggagcaaccgtgcagccacgaacacgcatgcctcagccagccctggaggctggatggctcccctgaggctggcatcctggctggctgtgtcctctccagctttccctccccagagttcttgcaccctcattccctcgggaccctcccagtgagaagggcctgctctgcttttcctgtctgtatataacttatttgccctaagaactttgagaatcccaattatttattttaatgtattttttagaccctctatttacctgcgaacttgtgtttataataaatgaggaaacataatct

SEQ ID NO: 62596 - DNA, 1148 bp, Homo sapiens
ctcagcttaatagcaggacgctggcaacaggcactccctgctccagtccagcctgcgcgctccaccgccgctatggtctccgtgcctaccacctggtgctccgttgcgctagccctgctcgtggccctgcatgaagggaagggccaggctgctgccaccctggagcagccagcgtcctcatctcatgcccaaggcacccaccttcggcttcgccgttgctcctgcagctcctggctcgacaaggagtgcgtctacttctgccacttggacatcatctgggtgaacactcctgaacagacagctccttacggcctgggaaacccgccaagacgccggcgccgctccctgccaaggcgctgtcagtgctccagtgccagggaccccgcctgtgccaccttctgccttcgaaggccctgggacatttccacagtcaagagcctctttgccaagcgacaacaggaggccatgcgggagcctcggtccacacattccaggtggaggaagagatagtgtcgtgagctggaggaacattgggaaggaagcccgcggggagagaggaggagagaagtggccagggcttgtggactctctgcctgcttcctggaccggggccttggtcccagacagctggacccatttgccaggattggcacaagctccctggtgagggagcctcgtccaaggcagttctgtgtcctcgcactgcccagggaagccctcggcctccagactgcggagcagcctccagtgctggctgctggcccacagctctgctggaagaactgcatggggagtacattcatctggaggctgcgtcctgaggagtgtcctgtctgctgggctacaaaccaggagcaaccgtgcagccacgaacacgcatgcctcagccagccctggaggctggatggctcccctgaggctggcatcctggctggctgtgtcctctccagctttccctccccagagttcttgcaccctcattccctcgggaccctcccagtgagaagggcctgctctgcttttcctgtctgtatataacttatttgccctaagaactttgagaatcccaattatttattttaatgtattttttagaccctctatttacctgcgaacttgtgtttataataaatgaggaaacataatct

SEQ ID NO: 62597 - DNA, 920 bp, Homo sapiens
ctcagcttaatagcaggacgctggcaacaggcactccctgctccagtccagcctgcgcgctccaccgccgctatggtctccgtgcctaccacctggtgctccgttgcgctagccctgctcgtggccctgcatgaagggaagggccaggctgctgccaccctggagcagccagcgtcctcatctcatgcccaaggcacccaccttcggcttcgccgttgctcctgcagctcctggctcgacaaggagtgcgtctacttctgccacttggacatcatctgggtgaacactcctgaattcaggtgctgaggctcagagagcttaagcgcctcccccaagatcacacaggtaattgtaagggtaggcaccatcctcggttggggaatgccggagctcacagtctctgtcatgctgcctctgcatgctcttccaataataatacgattagtgacagcacccgtgctttgactatgccaggctctttgccaagcactgcacgtgcatgatcatctcaggagcccccccatcctccccataaggcaggatagtccctcaaacgacagatgagaacctgccctgtgctactggctacacccgggtgggagccccgtgctgtctgttccgcctgcacccgcactgcctccaggccactgcataccttcagttgaagtttctgtgtgtgtttgtgattttttcccctccccaaattgcaaaaggcaagagaagccctgcacgtaagcgtgtgtgaagctaatccgcatccaaacacttgcttagggcgggaaccctgccagtccctgcgtgctgagtctacctggagtcactgcgactccaaccacaccatctaaaattagctctgtcactcgaaagtgctggtctagccagccacagggcccctgccattcccctggcccgcttgatca

SEQ ID NO: 62598 - DNA, 970 bp, Homo sapiens
  misc_feature (824)..(824): n is a, c, g, or t
  misc_feature (876)..(876): n is a, c, g, or t
  misc_feature (907)..(907): n is a, c, g, or t
  misc_feature (930)..(930): n is a, c, g, or t
  misc_feature (949)..(949): n is a, c, g, or t
aaatgtcttcctttgagaagtgtctgttcatatccttcacccactccatcaaaaagtgggtgaagtgccaatttactgagcacgagacaaatacatcattgacttcttttgtcttgtggattcaaggatgtgtccacgcccgccctccttcccctccagctcctccccttgaaatactgaagccctcaacatcatctttggaggaaggtacagagttggctctcacgcgcacatccttaaccttggcctaataaacctctaaggtggctgagacctgtctcagatacttgttggcttacaaattgaccaccatgcagggactcagagtggaggtggccctgccctttggcaggtttcctcctggtgcttaggaccagtttgggccttctttattgctcaggacagtaggacaatttgctgagatccgggagccctaccaccctccagagaatctctgatctcccgaaacttggttgaggtcgaaagtttattttgcgcacaatgccttttccttttccggtgttttacttgcttccaacaaagaaggcgagttttcctgcttccgtgatgatggggagcaggagacttccctggagtttcagctcggaaacaactcgagtttttcctgattccacgatgggggagagcagtctaaagcctgggccccattcctagtctttttcccgttggatttgacgaattctgttagacttggtcaaatctgaagcaaacttccaagttgtgggaaacaagcctctgaattagctgaattcccacagctgggaaaaaggaaaaaaagccagaaaaagggaaaaaagattttnaccacgtgatgggctttatttgcataacgaggccacgtttttccagccaagncacactcgaggtaagtgccgtcacctcacgntgcagttcgggccataggggccncttacatttttttacccanggctttgacctggaatgggat

SEQ ID NO: 62599 - DNA, 361 bp, Homo sapiens
cggtttgactatctgatgagccatcacaacattcccatctgttcgtcagggagggagttggaatgtaaacagacccagccactgctttctgactgcctgagttttctggccatcttgtctaccttgtcactagcatcctattcatgaaagccttagcgctctcttgagtcctgcttaacactggtcggccccatctctatgtctctgcacccagatatgattgctccatgtcatcacattgcatcattcatgccacatgtgtttactgagcatctagtttatgccaggcactattctaggcactggggatacaacaaagaacaaactagagtaaaatccccgagccttgcattctagagga

SEQ ID NO: 62600 - DNA, 664 bp, Homo sapiens
acatgtgaatagatattaagtgccatatataattagttctcagaagaagggagaaatgatcataggactgggaattgttttgcaaacgttctaggagatgtgagagaaaatatgtaaccacatcttagtggcccaagaaaatacaggcctgaagggataagattgtgtctctatagagcttcaaagcatacaggtcaattaagaaagcccctctctctccagagccgtttccctagcttttggcacctggatgccacagtcctccattaggctgatgactccaaagatgtaactctagcctcttgcctgagcttcagactcgcgtcccactgcccacaggacacatccacctggatgtgactcacaggtacctccaacccatcatgtggagatacccatcctgttccccctagagctgctcttcctgctgcattctctctctcaattactgggaccaccaagctaggaacctgggagtcatccttgatactttctcttcctccttaatcctgtgtattcagcaagtaactaaaggttggtgttggccaggcatggtggctcatgcctgtaatcccagcattttgggaggccaaggcgggcggatcacttgaggtcaggagctcaagaccagcctggccaacatggtgaaaccccatctctacta

SEQ ID NO: 62601 - DNA, 1134 bp, Homo sapiens
aacctttcaagtgccccctcctttccttaaagtcttttataggggtccccttcttggccatctccatcctgtgagtcaggactgaaagggcacagacaggtcactgccagcattgttggggcaagcctgcaagcacgcatcactggggatctgacatgacaatggccgcctgccccctctgagggctacaggacttaccccagtgggaagcagctaagcaggtctgaccagccgacctggacctggccaagggtcctgtcatccctcatggccaccccgccattccggctgataaggaagatgttttccttcaaggtgagcagatggatggggcttgcctgcttccggtccctggcggcatcctctcccagtattcgccagaagaaactaatgcacaagctgcaggaggaaaaggcttttcgcgaagagatgaaaatttttcgtgaaaaaatagaggacttcagggaagagatgtggactttccgaggcaagatccatgctttccggggccagatcctgggtttttgggaagaggagagacctttctgggaagaggagaaaaccttctggaaagaggaaaaatccttctgggaaatggaaaagtctttcagggaggaagagaaaactttctggaaaaagtaccgcactttctggaaggaggataaggccttctggaaagaggacaatgccttatgggaaagagaccggaaccttcttcaggaggacaaggccctgtgggaggaagaaaaggccctgtgggtagaggaaagagccctccttgagggggagaaagccctgtgggaagataaaacgtccctctgggaggaagagaatgccctctgggaggaagagagggccttctggatggagaacaatggccacattgccggagagcagatgctcgaagatgggccccacaacgccaacagagggcagcgcttgctggccttctcccgaggcagggcgtagccagcatgcaggtgcagggccctgtggtccagactcccctgggttgggattcaagtccagggtgagcccatgtgctggagaaaatacacactcattggtctccttgctttgaaagatccaataaagtcctgaggcaaggtttggaaaaccaacttaaaaaaaaaa

SEQ ID NO: 62602 - DNA, 256 bp, Homo sapiens
gtattttaaaatccatggacaggtcaaaacatgttaagcaagaagaagatatatctaagagataactttgtaaaagtcttcaattatttgaagggcctgttagagagtggctggctgtgaggaacctggctgggaacacatgccagcaaagacctaaggacggcctgagaaatttggaggaagggggaactttccttcagagttattaagcactaaaaccagtcactagtgtttttagagaacctttacataattt

SEQ ID NO: 62603 - DNA, 586 bp, Homo sapiens
  misc_feature (235)..(235): n is a, c, g, or t
aaaaagcacaatgtgtcccaacaaggctcccataatagacacatatcaattcgaagcaccaaaaggcaacaagtgaacattattcttatgtttaactgtgtgtagccttttgagattttgtgcttgaagtgggtgattatggaagttgatataagacttaaacttggtatttaaagcctggtcaagatttccctgtcctgtgtctagtgtgagttcttgacaagagtgtcccttnccgtcacagagtgggcccaacgacctacctcgtgccgaattcggcacgaggttaaaatgaactgttgctattgtgagatggattttaactgacctattaagggtttctttcgaatggcactactttagggacattctagtatttgcttctattgtttgggccttgtggataatgtacagatttaaaaacaaatcttgttgctgatttgtccatttctttccctgcactttgttacatctgggatacagtctaactcatctgatttaatatgcatttaaaaaaatgccataactattaaacaccttgtttacagacagatgaaataaatttattccaaccaaaaaaaaaaag

SEQ ID NO: 62604 - DNA, 335 bp, Homo sapiens
tagaggatcccctccgactagccgacagccaacatacaatgtggctgtcggcagagctggtagagtcttggtctttgtaatgggaaaagaaggggtccatggaggcggattgaataagaaggcatactcaatggcaaaatacttgagagactctgggttctagctgctaggcagactgttaagtattaggggaaaattgctcttaaactttcctagctataagcttaagtcttaattctggaaattttattagcaatgcagggtgatggggtatgaacctgtgtctcctttgtatccctctgtcgggctagtcggtaaggatcctgctagatcga

SEQ ID NO: 62605 - DNA, 2118 bp, Homo sapiens
cgccccgcctccccccgcgccgccgccgcccgctaccgccgccgccgccgctgcgcctgctgctcctcgccgtccgcgctgcagtgcgaagggctcgaagatggccggttggcagagctacgtggataacctgatgtgcgatggctgctgccaggaggccgccattgtcggctactgcgacgccaaatacgtctgggcagccacggccgggggcgtctttcagagcattacgccaatagaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagagtcttggtctttgtaatgggaaaagaaggggtccatggaggcggattgaataagaaggcatactcaatggcaaaatacttgagagactctgggttctagctgctaggcagactgttaagtattaggggaaaattgctcttaaactttcctagctataagcttaagtcttaattctggaaattttattagcaatgcagggtgatggggtatgaacctgtgtctcctttgtatccctctgttggtggggaaaggtgtctttctttctgccctccccccccaaaataattctgttcacttttgttttgtttccttgtgtactccagcattggttatagtcatgggaaaggaaggtgtccacggaggcacacttaacaagaaagcatatgaactcgctttatacctgaggaggtctgatgtgtaagcagcctctccccatctacctagcaactgtcttcatcaacaaccctaattatggtcacaatgctaccaaactgtagatggtagctaatttttctttacctattttctaatgtcatgattcctgtttgcccaatggatcatttgtatgttaaccactgtatgtaaccaacccttatctggcaacataattgcagcacaataatgatttgcatgataccttgaaattggggggagggggcatgccaagttgggcatcactttgtcttagcaattaatgggatattgattactaaaataagttaatattaagcaaggtgccggttgtacaatctctgatcagtgtcttttcagcactttgagcatttacttggctcatttagtcttccttttgtagcgcatggttgggaggaaaaagtgcatgcatcattccttcactcttctctttttcccgcccccccctcccttcgcacataggcatttggtttgcttccatctttttttatgcagtgcctgtttttttttaaccaattaaaatcccttttgttgatgagctattgagagctgcagtagtttgcttttagtattgttgttgcacttgagcagagacaaacctttattcatagtgtctacaggacatatgaagagtgcaatggcaaaacaagagcaaaaagcacttcctcccatgaccttacagtaaccatactgattgaatccccagggacattccatcattgcaatagctcagatttttcttcctttttctttgcacaccagctctactctttagtaaaattgtaaaaggctgccattatggacattaggtatcccaacataaccatctggagtgtgtccagtttgttcttcataggaccaatttttatttgcagcttgagtttttatatgaagttgcattattgtggacttggctgtcttgtgatgaatttttttcatatgtattctgtgccatactattgttaaaatgaactgttgctattgtgagatggattttaactgacctattaagggtttctttcgaatggcactactttagggacattctagtatttgcttctattgtttgggccttgtggataatgtacagatttaaaaacaaatcttgttgctgatttgtccatttctttccctgcactttgttacatctgggatacagtctaactcatctgatttaatatgcatttaaaaaaatgccataactattaaacaccttgtttacagacagatgaaataaatttattccaaccaaaaaaaaaaag

SEQ ID NO: 62606 - DNA, 2103 bp, Homo sapiens
gactaatcgaaccatctagtagctggttcccgccgctgcgcctgctgctcctcgccgtccgcgctgcagtgcgaagggctcgaagatggccggttggcagagctacgtggataacctgatgtgcgatggctgctgccaggaggccgccattgtcggctactgcgacgccaaatacgtctgggcagccacggccgggggcgtctttcagagcattacgccaatagaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagagtcttggtctttgtaatgggaaaagaaggggtccatggaggcggattgaataagaaggcatactcaatggcaaaatacttgagagactctgggttctagctgctaggcagactgttaagtattaggggaaaattgctcttaaactttcctagctataagcttaagtcttaattctggaaattttattagcaatgcagggtgatggggtatgaacctgtgtctcctttgtatccctctgttggtggggaaaggtgtctttctttctgccctccccccccaaaataattctgttcacttttgttttgtttccttgtgtactccagcattggttatagtcatgggaaaggaaggtgtccacggaggcacacttaacaagaaagcatatgaactcgctttatacctgaggaggtctgatgtgtaagcagcctctccccatctacctagcaactgtcttcatcaacaaccctaattatggtcacaatgctaccaaactgtagatggtagctaatttttctttacctattttctaatgtcatgattcctgtttgcccaatggatcatttgtatgttaaccactgtatgtaaccaacccttatctggcaacataattgcagcacaataatgatttgcatgataccttgaaattggggggagggggcatgccaagttgggcatcactttgtcttagcaattaatgggatattgattactaaaataagttaatattaagcaaggtgccggttgtacaatctctgatcagtgtcttttcagcactttgagcatttacttggctcatttagtcttccttttgtagcgcatggttgggaggaaaaagtgcatgcatcattccttcactcttctctttttcccgcccccccctcccttcgcacataggcatttggtttgcttccatctttttttatgcagtgcctgtttttttttaaccaattaaaatcccttttgttgatgagctattgagagctgcagtagtttgcttttagtattgttgttgcacttgagcagagacaaacctttattcatagtgtctacaggacatatgaagagtgcaatggcaaaacaagagcaaaaagcacttcctcccatgaccttacagtaaccatactgattgaatccccagggacattccatcattgcaatagctcagatttttcttcctttttctttgcacaccagctctactctttagtaaaattgtaaaaggctgccattatggacattaggtatcccaacataaccatctggagtgtgtccagtttgttcttcataggaccaatttttatttgcagcttgagtttttatatgaagttgcattattgtggacttggctgtcttgtgatgaatttttttcatatgtattctgtgccatactattgttaaaatgaactgttgctattgtgagatggattttaactgacctattaagggtttctttcgaatggcactactttagggacattctagtatttgcttctattgtttgggccttgtggataatgtacagatttaaaaacaaatcttgttgctgatttgtccatttctttccctgcactttgttacatctgggatacagtctaactcatctgatttaatatgcatttaaaaaaatgccataactattaaacaccttgtttacagacagatgaaataaatttattccaaccaaaaaaaaaaag

SEQ ID NO: 62607 - DNA, 2064 bp, Homo sapiens
cgccccgcctccccccgcgccgccgccgcccgctaccgccgccgccgccgctgcgcctgctgctcctcgccgtccgcgctgcagtgcgaagggctcgaagatggccggttggcagagctacgtggataacctgatgtgcgatggctgctgccaggaggccgccattgtcggctactgcgacgccaaatacgtctgggcagccacggccgggggcgtctttcagagcattacgccaatagaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagagtcttggtctttgtaatgggaaaagaaggggtccatggaggcggattgaataagaaggcatactcaatggcaaaatacttgagagactctgggttctagctgctaggcagactgttaagtattaggggaaaattgctcttaaactttcctagctataagcttaagtcttaattctggaaattttattagcaatgcagggtgatggggtatgaacctgtgtctcctttgtatccctctgttggtggggaaaggtgtctttctttctgccctccccccccaaaataattctgttcacttttgttttgtttccttgtgtactccagcattggttatagtcatgggaaaggaaggtgtccacggaggcacacttaacaagaaagcatatgaactcgctttatacctgaggaggtctgatgtgtaagcagcctctccccatctacctagcaactgtcttcatcaacaaccctaattatggtcacaatgctaccaaactgtagatggtagctaatttttctttacctattttctaatgtcatgattcctgtttgcccaatggatcatttgtatgttaaccactgtatgtaaccaacccttatctggcaacataattgcagcacaataatgatttgcatgataccttgaaattggggggagggggcatgccaagttgggcatcactttgtcttagcaattaatgggatattgattactaaaataagttaatattaagcaaggtgccggttgtacaatctctgatcagtgtcttttcagcactttgagcatttacttggctcatttagtcttccttttgtagcgcatggttgggaggatcgcacataggcatttggtttgcttccatctttttttatgcagtgcctgtttttttttaaccaattaaaatcccttttgttgatgagctattgagagctgcagtagtttgcttttagtattgttgttgcacttgagcagagacaaacctttattcatagtgtctacaggacatatgaagagtgcaatggcaaaacaagagcaaaaagcacttcctcccatgaccttacagtaaccatactgattgaatccccagggacattccatcattgcaatagctcagatttttcttcctttttctttgcacaccagctctactctttagtaaaattgtaaaaggctgccattatggacattaggtatcccaacataaccatctggagtgtgtccagtttgttcttcataggaccaatttttatttgcagcttgagtttttatatgaagttgcattattgtggacttggctgtcttgtgatgaatttttttcatatgtattctgtgccatactattgttaaaatgaactgttgctattgtgagatggattttaactgacctattaagggtttctttcgaatggcactactttagggacattctagtatttgcttctattgtttgggccttgtggataatgtacagatttaaaaacaaatcttgttgctgatttgtccatttctttccctgcactttgttacatctgggatacagtctaactcatctgatttaatatgcatttaaaaaaatgccataactattaaacaccttgtttacagacagatgaaataaatttattccaaccaaaaaaaaaaag

SEQ ID NO: 62608 - DNA, 1758 bp, Homo sapiens
gactaatcgaaccatctagtagctggttcccgccgctgcgcctgctgctcctcgccgtccgcgctgcagtgcgaagggctcgaagatggccggttggcagagctacgtggataacctgatgtgcgatggctgctgccaggaggccgccattgtcggctactgcgacgccaaatacgtctgggcagccacggccgggggcgtctttcagagcattacgaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagagcattggttatagtcatgggaaaggaaggtgtccacggaggcacacttaacaagaaagcatatgaactcgctttatacctgaggaggtctgatgtgtaagcagcctctccccatctacctagcaactgtcttcatcaacaaccctaattatggtcacaatgctaccaaactgtagatggtagctaatttttctttacctattttctaatgtcatgattcctgtttgcccaatggatcatttgtatgttaaccactgtatgtaaccaacccttatctggcaacataattgcagcacaataatgatttgcatgataccttgaaattggggggagggggcatgccaagttgggcatcactttgtcttagcaattaatgggatattgattactaaaataagttaatattaagcaaggtgccggttgtacaatctctgatcagtgtcttttcagcactttgagcatttacttggctcatttagtcttccttttgtagcgcatggttgggaggaaaaagtgcatgcatcattccttcactcttctctttttcccgcccccccctcccttcgcacataggcatttggtttgcttccatctttttttatgcagtgcctgtttttttttaaccaattaaaatcccttttgttgatgagctattgagagctgcagtagtttgcttttagtattgttgttgcacttgagcagagacaaacctttattcatagtgtctacaggacatatgaagagtgcaatggcaaaacaagagcaaaaagcacttcctcccatgaccttacagtaaccatactgattgaatccccagggacattccatcattgcaatagctcagatttttcttcctttttctttgcacaccagctctactctttagtaaaattgtaaaaggctgccattatggacattaggtatcccaacataaccatctggagtgtgtccagtttgttcttcataggaccaatttttatttgcagcttgagtttttatatgaagttgcattattgtggacttggctgtcttgtgatgaatttttttcatatgtattctgtgccatactattgttaaaatgaactgttgctattgtgagatggattttaactgacctattaagggtttctttcgaatggcactactttagggacattctagtatttgcttctattgtttgggccttgtggataatgtacagatttaaaaacaaatcttgttgctgatttgtccatttctttccctgcactttgttacatctgggatacagtctaactcatctgatttaatatgcatttaaaaaaatgccataactattaaacaccttgtttacagacagatgaaataaatttattccaaccaaaaaaaaaaag

SEQ ID NO: 62609 - DNA, 1651 bp, Homo sapiens
ggtaccctggtccctgcaccggagcggggtggccggccgcgggggcaccgcagcgcggggctggaacactgagggccgagcccgcagccaatagaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagagcattggttatagtcatgggaaaggaaggtgtccacggaggcacacttaacaagaaagcatatgaactcgctttatacctgaggaggtctgatgtgtaagcagcctctccccatctacctagcaactgtcttcatcaacaaccctaattatggtcacaatgctaccaaactgtagatggtagctaatttttctttacctattttctaatgtcatgattcctgtttgcccaatggatcatttgtatgttaaccactgtatgtaaccaacccttatctggcaacataattgcagcacaataatgatttgcatgataccttgaaattggggggagggggcatgccaagttgggcatcactttgtcttagcaattaatgggatattgattactaaaataagttaatattaagcaaggtgccggttgtacaatctctgatcagtgtcttttcagcactttgagcatttacttggctcatttagtcttccttttgtagcgcatggttgggaggaaaaagtgcatgcatcattccttcactcttctctttttcccgcccccccctcccttcgcacataggcatttggtttgcttccatctttttttatgcagtgcctgtttttttttaaccaattaaaatcccttttgttgatgagctattgagagctgcagtagtttgcttttagtattgttgttgcacttgagcagagacaaacctttattcatagtgtctacaggacatatgaagagtgcaatggcaaaacaagagcaaaaagcacttcctcccatgaccttacagtaaccatactgattgaatccccagggacattccatcattgcaatagctcagatttttcttcctttttctttgcacaccagctctactctttagtaaaattgtaaaaggctgccattatggacattaggtatcccaacataaccatctggagtgtgtccagtttgttcttcataggaccaatttttatttgcagcttgagtttttatatgaagttgcattattgtggacttggctgtcttgtgatgaatttttttcatatgtattctgtgccatactattgttaaaatgaactgttgctattgtgagatggattttaactgacctattaagggtttctttcgaatggcactactttagggacattctagtatttgcttctattgtttgggccttgtggataatgtacagatttaaaaacaaatcttgttgctgatttgtccatttctttccctgcactttgttacatctgggatacagtctaactcatctgatttaatatgcatttaaaaaaatgccataactattaaacaccttgtttacagacagatgaaataaatttattccaaccaaaaaaaaaaag

SEQ ID NO: 62610 - DNA, 1659 bp, Homo sapiens
gtgggaggcgatctagaggatccctcgctattcgtcggcacacttgagagactctgggttctagctgctaggcagactgttaagtattaggggaaaattgctcttaaactttcctagctataagcttaagtcttaattctggaaattttattagcaatgcagggtgatggggtatgaacctgtgtctcctttgtatccctctgttggtggggaaaggtgtctttctttctgccctccccccccaaaataattctgttcacttttgttttgtttccttgtgtactccagcattggttatagtcatgggaaaggaaggtgtccacggaggcacacttaacaagaaagcatatgaactcgctttatacctgaggaggtctgatgtgtaagcagcctctccccatctacctagcaactgtcttcatcaacaaccctaattatggtcacaatgctaccaaactgtagatggtagctaatttttctttacctattttctaatgtcatgattcctgtttgcccaatggatcatttgtatgttaaccactgtatgtaaccaacccttatctggcaacataattgcagcacaataatgatttgcatgataccttgaaattggggggagggggcatgccaagttgggcatcactttgtcttagcaattaatgggatattgattactaaaataagttaatattaagcaaggtgccggttgtacaatctctgatcagtgtcttttcagcactttgagcatttacttggctcatttagtcttccttttgtagcgcatggttgggaggaaaaagtgcatgcatcattccttcactcttctctttttcccgcccccccctcccttcgcacataggcatttggtttgcttccatctttttttatgcagtgcctgtttttttttaaccaattaaaatcccttttgttgatgagctattgagagctgcagtagtttgcttttagtattgttgttgcacttgagcagagacaaacctttattcatagtgtctacaggacatatgaagagtgcaatggcaaaacaagagcaaaaagcacttcctcccatgaccttacagtaaccatactgattgaatccccagggacattccatcattgcaatagctcagatttttcttcctttttctttgcacaccagctctactctttagtaaaattgtaaaaggctgccattatggacattaggtatcccaacataaccatctggagtgtgtccagtttgttcttcataggaccaatttttatttgcagcttgagtttttatatgaagttgcattattgtggacttggctgtcttgtgatgaatttttttcatatgtattctgtgccatactattgttaaaatgaactgttgctattgtgagatggattttaactgacctattaagggtttctttcgaatggcactactttagggacattctagtatttgcttctattgtttgggccttgtggataatgtacagatttaaaaacaaatcttgttgctgatttgtccatttctttccctgcactttgttacatctgggatacagtctaactcatctgatttaatatgcatttaaaaaaatgccataactattaaacaccttgtttacagacagatgaaataaatttattccaaccaaaaaaaaaaag

SEQ ID NO: 62611 - DNA, 1729 bp, Homo sapiens
gactaatcgaaccatctagtagctggttcccgccgctgcgcctgctgctcctcgccgtccgcgctgcagtgcgaagggctcgaagatggccggttggcagagctacgtggataacctgatgtgcgatggctgctgccaggaggccgccattgtcggctactgcgacgccaaatacgtctgggcagccacggccgggggcgtctttcagagcattacgccaatagaaatagatatgattgtaaatgctcagtgatcagagatagtctatacgtcgatggtgactgcacaatggacatccggacaaagagtcaaggtggggagccaacatacaatgtggctgtcggcagagctggtagagcattggttatagtcatgggaaaggaaggtgtccacggaggcacacttaacaagaaagcatatgaactcgctttatacctgaggaggtctgatgtgtaagcagcctctccccatctacctagcaactgtcttcatcaacaaccctaattatggtcacaatgctaccaaactgtagatggtagctaatttttctttacctattttctaatgtcatgattcctgtttgcccaatggatcatttgtatgttaaccactgtatgtaaccaacccttatctggcaacataattgcagcacaataatgatttgcatgataccttgaaattggggggagggggcatgccaagttgggcatcactttgtcttagcaattaatgggatattgattactaaaataagttaatattaagcaaggtgccggttgtacaatctctgatcagtgtcttttcagcactttgagcatttacttggctcatttagtcttccttttgtagcgcatggttgggaggaaaaagtgcatgcatcattccttcactcttctctttttcccgcccccccctcccttcgcacataggcatttggtttgcttccatctttttttatgcagtgcctgtttttttttaaccaattaaaatcccttttgttgatgagctattgagagctgcagtagtttgcttttagtattgttgttgcacttgagcagagacaaacctttattcatagtgtctacaggacatatgaagagtgcaatggcaaaacaagagcaaaaagcacttcctcccatgaccttacagtaaccatactgattgaatccccagggacattccatcattgcaatagctcagatttttcttcctttttctttgcacaccagctctactctttagtaaaattgtaaaaggctgccattatggacattaggtatcccaacataaccatctggagtgtgtccagtttgttcttcataggaccaatttttatttgcagcttgagtttttatatgaagttgcattattgtggacttggctgtcttgtgatgaatttttttcatatgtattctgtgccatactattgttaaaatgaactgttgctattgtgagatggattttaactgacctattaagggtttctttcgaatggcactactttagggacattctagtatttgcttctattgtttgggccttgtggataatgtacagatttaaaaacaaatcttgttgctgatttgtccatttctttccctgcactttgttacatctgggatacagtctaactcatctgatttaatatgcatttaaaaaaatgccataactattaaacaccttgtttacagacagatgaaataaatttattccaaccaaaaaaaaaaag

SEQ ID NO: 62612 - DNA, 1644 bp, Homo sapiens
cgccccgcctccccccgcgccgccgccgcccgctaccgccgccgccgccgctgcgcctgctgctcctcgccgtccgcgctgcagtgcgaagggctcgaagatggccggttggcagagctacgtggataacctgatgtgcgatggctgctgccaggaggccgccattgtcggctactgcgacgccaaatacgtctgggcagccacggccgggggcgtctttcagagcattacgccaatagaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagagtcttggtctttgtaatgggaaaagaaggggtccatggaggcggattgaataagaaggcatactcaatggcaaaatacttgagagactctgggttctagctgctaggcagactgttaagtattaggggaaaattgctcttaaactttcctagctataagcttaagtcttaattctggaaattttattagcaatgcagggtgatggggtatgaacctgtgtctcctttgtatccctctgttggtggggaaaggtgtctttctttctgccctccccccccaaaataattctgttcacttttgttttgtttccttgtgtactccagcattggttatagtcatgggaaaggaaggtgtccacggaggcacacttaacaagaaagcatatgaactcgctttatacctgaggaggtctgatgtgtaagcagcctctccccatctacctagcaactgtcttcatcaacaaccctaattatggtcacaatgctaccaaactgtagatggtagctaatttttctttacctattttctaatgtcatgattcctgtttgcccaatggatcatttgtatgttaaccactgtatgtaaccaacccttatctggcaacataattgcagcacaataatgatttgcatgataccttgaaattggggggagggggcatgccaagttgggcatcactttgtcttagcaattaatgggatattgattactaaaataagttaatattaagcaaggtgccggttgtacaatctctgatcagtgtcttttcagcactttgagcatttacttggctcatttagtcttccttttgtagcgcatggttgggaggaaaaagtgcatgcatcattccttcactcttctctttttcccgcccccccctcccttcgcacataggcatttggtttgcttccatctttttttatgcagtgcctgtttttttttaaccaattaaaatcccttttgttgatgagctattgagagctgcagtagtttgcttttagtattgttgttgcacttgagcagagacaaacctttattcatagtgtctacaggacatatgaagagtgcaatggcaaaacaagagcaaaaagcacttcctcccatgaccttacagtaaccatactgattgaatccccagggacattccatcattgcaatagctcagatttttcttcctttttctttgcacaccgtgtttatctcaatccgggtacgagctc

SEQ ID NO: 62613 - DNA, 1285 bp, Homo sapiens
cgccccgcctccccccgcgccgccgccgcccgctaccgccgccgccgccgctgcgcctgctgctcctcgccgtccgcgctgcagtgcgaagggctcgaagatggccggttggcagagctacgtggataacctgatgtgcgatggctgctgccaggaggccgccattgtcggctactgcgacgccaaatacgtctgggcagccacggccgggggcgtctttcagagcattacgccaatagaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagagtcttggtctttgtaatgggaaaagaaggggtccatggaggcggattgaataagaaggcatactcaatggcaaaatacttgagagactctgggttctagctgctaggcagactgttaagtattaggggaaaattgctcttaaactttcctagctataagcttaagtcttaattctggaaattttattagcaatgcagggtgatggggtatgaacctgtgtctcctttgtatccctctgttggtggggaaaggtgtctttctttctgccctccccccccaaaataattctgttcacttttgttttgtttccttgtgtactccagcattggttatagtcatgggaaaggaaggtgtccacggaggcacacttaacaagaaagcatatgaactcgctttatacctgaggaggtatcccaacataaccatctggagtgtgtccagtttgttcttcataggaccaatttttatttgcagcttgagtttttatatgaagttgcattattgtggacttggctgtcttgtgatgaatttttttcatatgtattctgtgccatactattgttaaaatgaactgttgctattgtgagatggattttaactgacctattaagggtttctttcgaatggcactactttagggacattctagtatttgcttctattgtttgggccttgtggataatgtacagatttaaaaacaaatcttgttgctgatttgtccatttctttccctgcactttgttacatctgggatacagtctaactcatctgatttaatatgcatttaaaaaaatgccataactattaaacaccttgtttacagacagatgaaataaatttattccaaccaaaaaaaaaaag

SEQ ID NO: 62614 - DNA, 948 bp, Homo sapiens
gactaatcgaaccatctagtagctggttcccgccgctgcgcctgctgctcctcgccgtccgcgctgcagtgcgaagggctcgaagatggccggttggcagagctacgtggataacctgatgtgcgatggctgctgccaggaggccgccattgtcggctactgcgacgccaaatacgtctgggcagccacggccgggggcgtctttcagagcattacgccaatagaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagagcattggttatagtcatgggaaaggaaggtgtccacggaggcacacttaacaagaaagcatatgaactcgctttatacctgaggaggtatcccaacataaccatctggagtgtgtccagtttgttcttcataggaccaatttttatttgcagcttgagtttttatatgaagttgcattattgtggacttggctgtcttgtgatgaatttttttcatatgtattctgtgccatactattgttaaaatgaactgttgctattgtgagatggattttaactgacctattaagggtttctttcgaatggcactactttagggacattctagtatttgcttctattgtttgggccttgtggataatgtacagatttaaaaacaaatcttgttgctgatttgtccatttctttccctgcactttgttacatctgggatacagtctaactcatctgatttaatatgcatttaaaaaaatgccataactattaaacaccttgtttacagacagatgaaataaatttattccaaccaaaaaaaaaaag

SEQ ID NO: 62615 - DNA, 344 bp, Homo sapiens
aagatgcagtcaagtttactattttctgtttagtatattactagtttgaaagttctttttggaaacctacttgacttcagtgcttggcagttcatggaaaactaacttaatgttaacttattaatccgggttctgtctgctaaaacttatgtgactttcttgattaacacttcttttgaaacacttttcttctttctctttcagtcttggtctttgtaatgggaaaagaaggggtccatggaggcggattgaataagaaggcatactcaatggcaaaatacttgagagactctgggttctagctgctaggcagactgttaagtattaggggaaaattgctctta

SEQ ID NO: 62616 - DNA, 375 bp, Homo sapiens
tatataggattaaataattatttagaaaagactgaatcttggttttacattagtgaaatgtggctatctggcagtggtagcataagcctagctacagcccttcctgttacatcaagccctaaaaggagttaactacaacttaatgtgtgtgtttttttttttttctttttggtggggggcagccaatagaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagag

SEQ ID NO: 62617 - DNA, 1796 bp, Homo sapiens
cgccccgcctccccccgcgccgccgccgcccgctaccgccgccgccgccgctgcgcctgctgctcctcgccgtccgcgctgcagtgcgaagggctcgaagatggccggttggcagagctacgtggataacctgatgtgcgatggctgctgccaggaggccgccattgtcggctactgcgacgccaaatacgtctgggcagccacggccgggggcgtctttcagagcattacgccaatagaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagagcattggttatagtcatgggaaaggaaggtgtccacggaggcacacttaacaagaaagcatatgaactcgctttatacctgaggaggtctgatgtgtaagcagcctctccccatctacctagcaactgtcttcatcaacaaccctaattatggtcacaatgctaccaaactgtagatggtagctaatttttctttacctattttctaatgtcatgattcctgtttgcccaatggatcatttgtatgttaaccactgtatgtaaccaacccttatctggcaacataattgcagcacaataatgatttgcatgataccttgaaattggggggagggggcatgccaagttgggcatcactttgtcttagcaattaatgggatattgattactaaaataagttaatattaagcaaggtgccggttgtacaatctctgatcagtgtcttttcagcactttgagcatttacttggctcatttagtcttccttttgtagcgcatggttgggaggaaaaagtgcatgcatcattccttcactcttctctttttcccgcccccccctcccttcgcacataggcatttggtttgcttccatctttttttatgcagtgcctgtttttttttaaccaattaaaatcccttttgttgatgagctattgagagctgcagtagtttgcttttagtattgttgttgcacttgagcagagacaaacctttattcatagtgtctacaggacatatgaagagtgcaatggcaaaacaagagcaaaaagcacttcctcccatgaccttacagtaaccatactgattgaatccccagggacattccatcattgcaatagctcagatttttcttcctttttctttgcacaccagctctactctttagtaaaattgtaaaaggctgccattatggacattaggtatcccaacataaccatctggagtgtgtccagtttgttcttcataggaccaatttttatttgcagcttgagtttttatatgaagttgcattattgtggacttggctgtcttgtgatgaatttttttcatatgtattctgtgccatactattgttaaaatgaactgttgctattgtgagatggattttaactgacctattaagggtttctttcgaatggcactactttagggacattctagtatttgcttctattgtttgggccttgtggataatgtacagatttaaaaacaaatcttgttgctgatttgtccatttctttccctgcactttgttacatctgggatacagtctaactcatctgatttaatatgcatttaaaaaaatgccataactattaaacaccttgtttacagacagatgaaataaatttattccaaccaaaaaaaaaaag

SEQ ID NO: 62618 - DNA, 2046 bp, Homo sapiens
gctagtagggcccgcgggttaatcggcaacgagcggttggcagagctacgtggataacctgatgtgcgatggctgctgccaggaggccgccattgtcggctactgcgacgccaaatacgtctgggcagccacggccgggggcgtctttcagagcattacgccaatagaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagagtcttggtctttgtaatgggaaaagaaggggtccatggaggcggattgaataagaaggcatactcaatggcaaaatacttgagagactctgggttctagctgctaggcagactgttaagtattaggggaaaattgctcttaaactttcctagctataagcttaagtcttaattctggaaattttattagcaatgcagggtgatggggtatgaacctgtgtctcctttgtatccctctgttggtggggaaaggtgtctttctttctgccctccccccccaaaataattctgttcacttttgttttgtttccttgtgtactccagcattggttatagtcatgggaaaggaaggtgtccacggaggcacacttaacaagaaagcatatgaactcgctttatacctgaggaggtctgatgtgtaagcagcctctccccatctacctagcaactgtcttcatcaacaaccctaattatggtcacaatgctaccaaactgtagatggtagctaatttttctttacctattttctaatgtcatgattcctgtttgcccaatggatcatttgtatgttaaccactgtatgtaaccaacccttatctggcaacataattgcagcacaataatgatttgcatgataccttgaaattggggggagggggcatgccaagttgggcatcactttgtcttagcaattaatgggatattgattactaaaataagttaatattaagcaaggtgccggttgtacaatctctgatcagtgtcttttcagcactttgagcatttacttggctcatttagtcttccttttgtagcgcatggttgggaggaaaaagtgcatgcatcattccttcactcttctctttttcccgcccccccctcccttcgcacataggcatttggtttgcttccatctttttttatgcagtgcctgtttttttttaaccaattaaaatcccttttgttgatgagctattgagagctgcagtagtttgcttttagtattgttgttgcacttgagcagagacaaacctttattcatagtgtctacaggacatatgaagagtgcaatggcaaaacaagagcaaaaagcacttcctcccatgaccttacagtaaccatactgattgaatccccagggacattccatcattgcaatagctcagatttttcttcctttttctttgcacaccagctctactctttagtaaaattgtaaaaggctgccattatggacattaggtatcccaacataaccatctggagtgtgtccagtttgttcttcataggaccaatttttatttgcagcttgagtttttatatgaagttgcattattgtggacttggctgtcttgtgatgaatttttttcatatgtattctgtgccatactattgttaaaatgaactgttgctattgtgagatggattttaactgacctattaagggtttctttcgaatggcactactttagggacattctagtatttgcttctattgtttgggccttgtggataatgtacagatttaaaaacaaatcttgttgctgatttgtccatttctttccctgcactttgttacatctgggatacagtctaactcatctgatttaatatgcatttaaaaaaatgccataactattaaacaccttgtttacagacagatgaaataaatttattccaaccaaaaaaaaaaag

SEQ ID NO: 62619 - DNA, 2080 bp, Homo sapiens
gactaatcgaaccatctagtagctggttcccgccgctgcgcctgctgctcctcgccgtccgcgctgcagtgcgaagggctcgaagatggccggttggcagagctacgtggataacctgatgtgcgatggctgctgccaggaggccgccattgtcggctactgcgacgccaaatacgtctgggcagccacggccgggggcgtctttcagagcattacgaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagagtcttggtctttgtaatgggaaaagaaggggtccatggaggcggattgaataagaaggcatactcaatggcaaaatacttgagagactctgggttctagctgctaggcagactgttaagtattaggggaaaattgctcttaaactttcctagctataagcttaagtcttaattctggaaattttattagcaatgcagggtgatggggtatgaacctgtgtctcctttgtatccctctgttggtggggaaaggtgtctttctttctgccctccccccccaaaataattctgttcacttttgttttgtttccttgtgtactccagcattggttatagtcatgggaaaggaaggtgtccacggaggcacacttaacaagaaagcatatgaactcgctttatacctgaggaggtctgatgtgtaagcagcctctccccatctacctagcaactgtcttcatcaacaaccctaattatggtcacaatgctaccaaactgtagatggtagctaatttttctttacctattttctaatgtcatgattcctgtttgcccaatggatcatttgtatgttaaccactgtatgtaaccaacccttatctggcaacataattgcagcacaataatgatttgcatgataccttgaaattggggggagggggcatgccaagttgggcatcactttgtcttagcaattaatgggatattgattactaaaataagttaatattaagcaaggtgccggttgtacaatctctgatcagtgtcttttcagcactttgagcatttacttggctcatttagtcttccttttgtagcgcatggttgggaggaaaaagtgcatgcatcattccttcactcttctctttttcccgcccccccctcccttcgcacataggcatttggtttgcttccatctttttttatgcagtgcctgtttttttttaaccaattaaaatcccttttgttgatgagctattgagagctgcagtagtttgcttttagtattgttgttgcacttgagcagagacaaacctttattcatagtgtctacaggacatatgaagagtgcaatggcaaaacaagagcaaaaagcacttcctcccatgaccttacagtaaccatactgattgaatccccagggacattccatcattgcaatagctcagatttttcttcctttttctttgcacaccagctctactctttagtaaaattgtaaaaggctgccattatggacattaggtatcccaacataaccatctggagtgtgtccagtttgttcttcataggaccaatttttatttgcagcttgagtttttatatgaagttgcattattgtggacttggctgtcttgtgatgaatttttttcatatgtattctgtgccatactattgttaaaatgaactgttgctattgtgagatggattttaactgacctattaagggtttctttcgaatggcactactttagggacattctagtatttgcttctattgtttgggccttgtggataatgtacagatttaaaaacaaatcttgttgctgatttgtccatttctttccctgcactttgttacatctgggatacagtctaactcatctgatttaatatgcatttaaaaaaatgccataactattaaacaccttgtttacagacagatgaaataaatttattccaaccaaaaaaaaaaag

SEQ ID NO: 62620 - DNA, 1756 bp, Homo sapiens
cgccccgcctccccccgcgccgccgccgcccgctaccgccgccgccgccgctgcgcctgctgctcctcgccgtccgcgctgcagtgcgaagggctcgaagatggccggttggcagagctacgtggataacctgatgtgcgatggctgctgccaggaggccgccattgtcggctactgcgacgccaaatacgtctgggcagccacggccgggggcgtctttcagagcattacgccaatagaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagagcattggttatagtcatgggaaaggaaggtgtccacggaggcacacttaacaagaaagcatatgaactcgctttatacctgaggaggtctgatgtgtaagcagcctctccccatctacctagcaactgtcttcatcaacaacctaatttttctttacctattttctaatgtcatgattcctgtttgcccaatggatcatttgtatgttaaccactgtatgtaaccaacccttatctggcaacataattgcagcacaataatgatttgcatgataccttgaaattggggggagggggcatgccaagttgggcatcactttgtcttagcaattaatgggatattgattactaaaataagttaatattaagcaaggtgccggttgtacaatctctgatcagtgtcttttcagcactttgagcatttacttggctcatttagtcttccttttgtagcgcatggttgggaggaaaaagtgcatgcatcattccttcactcttctctttttcccgcccccccctcccttcgcacataggcatttggtttgcttccatctttttttatgcagtgcctgtttttttttaaccaattaaaatcccttttgttgatgagctattgagagctgcagtagtttgcttttagtattgttgttgcacttgagcagagacaaacctttattcatagtgtctacaggacatatgaagagtgcaatggcaaaacaagagcaaaaagcacttcctcccatgaccttacagtaaccatactgattgaatccccagggacattccatcattgcaatagctcagatttttcttcctttttctttgcacaccagctctactctttagtaaaattgtaaaaggctgccattatggacattaggtatcccaacataaccatctggagtgtgtccagtttgttcttcataggaccaatttttatttgcagcttgagtttttatatgaagttgcattattgtggacttggctgtcttgtgatgaatttttttcatatgtattctgtgccatactattgttaaaatgaactgttgctattgtgagatggattttaactgacctattaagggtttctttcgaatggcactactttagggacattctagtatttgcttctattgtttgggccttgtggataatgtacagatttaaaaacaaatcttgttgctgatttgtccatttctttccctgcactttgttacatctgggatacagtctaactcatctgatttaatatgcatttaaaaaaatgccataactattaaacaccttgtttacagacagatgaaataaatttattccaaccaaaaaaaaaaag

SEQ ID NO: 62621 - DNA, 460 bp, Homo sapiens
ctagaaggcagaaatggtttccgttcagcaaatccacaccagcaatcctcttacagcaaatttccaagaaacatggttggataacagtgctggacctaaaaaaggtgttggcccacgagtgcctctctctccctgcctgagctccctgaccagcatgcgtgtggcctccaggtgtgttgtctaccccccaggacctgccaagcacggtggctcatgcctgtaatcccagcactttgggaggccgaggagggaagatcacgagctcaagatatcaagaccatcctggccaacatggtgaaaccctgtctctactaaaaatacaaaaattagctgggcgtggtggtgcatgcctgtagtcccagctactcgggaggctgaggcagcagaatcgcttgaacctgggaggtgcaggttgcaacacactactaactccagcctgggcgacagagcaagactgtct

SEQ ID NO: 62622 - DNA, 290 bp, Homo sapiens
tgatgtcactcattagacccaatttattccatacaaattttcttctcatgtgcaaaagtaaaaaaaaaaaattacacagatatagagggtaatccctctaaggaacatttgctgttgaaataaaaggtaaatttgatttgtaaggcatgggatgcaccatgtctggtgtaagtcaaggagacagatttcaaaacccaagttgttacctgctcacattttgagaatgttactatctccagaagcacagcaaataccattagcatggtattctttaaccagctactaatttg

SEQ ID NO: 62623 - DNA, 1655 bp, Homo sapiens
ctggtaatttgtagagatctgttggcatctctgcttcacaaactggaaaaaatcatttgtaagtcttgctaattacttttcttggagaagaaaaaaaatgctacagttgcaaacaaatgtatagttttcaaaaagaagcaacttttttgctccccagtttattcttagtttccagcccacgccttgcgatagcgataggcatagtgatggcctcaattctttctctcttgcatccataccttttgctgtgatagcagtgatggcctcagttctttccctctcttgcatccgtaccttttgctgtgtgactttgcagctcctctcattaaagaggcagagccccctctcccacccataggagcaggttttgagagtaacagaatgaagtgaaaatgacactgtgccagttctaagaccagccctcaaaggttcatgtgtttctgcttgctttcactgtatttgaaatgttgctgtcagaaagacatctctgaaacagctgaatggtcctaagaaaaggatgagagatgcagggagcagagctcccaactgaggccagcctagatcacctaagagccaggcccccagtttactctgatgtgtaagcaataaatgcttaccccagcaataccaccaaggtttgtggttggtttatatacagcattaatgtggcaataggtgcaatacaccctgttaaacaaaccatacacatatgactctaaccctaatcataaattgattcagtctgttcagttccacaacgctgtttcctccagaatctcacagatgacttactaaatccaacacaaatacacctcagactttctgtctagctcccaaccagttaaaagcaattctaaatattttttttcttagtcgtagtgcaaaagtatattctctccctttctctatagttttctctcatttgtcttcagacctagaagcatgagagcccagctgtcaaagtcatctagacccccttcagaaggtcattaaatttgtctatttcacaggattgcaagataaaatacagaatgcccagttaaatttgaacttcggataaacaacaaatttttttttagtataagcatatcccatacaatatttgggatatacttatatttttatattgtttatctgacgttcaagctgactgggcatcctgtatttttcttagctaaatctggcaactgtgctatttcattgaaaacctgaaagtgtacaaagaaggaagaagcagaatctgccatatgagtaatagaagtgagcaggcccaggactccctaagtcaagaaaccaagaggcgtcattacggaaaagagtaactcaccctgtgtgctccttggtagttctccctcagcgatgcccccatgttatgaatggggaaaagttcactgaagggttcatagtgaagaaactttttggatgatttctgttggtgggttttggataccttcaagggatcagaaaataatatacttaggaaattttggtaatgtcatcattactctctacattattattatgacggttacaattgttaaatctaggtggtgggtatgtgggttatattgtacatgatttttaacttgtctgcatgtttgaaattataataaagtcaataaataaattattgagacactcctgttaaaaagacc

SEQ ID NO: 62624 - DNA, 322 bp, Homo sapiens
taaatgagaaaaccaactaagtggataattagccatttgagtggttcacttatctagtaaatggcaatgaaaagtctgaatcactctgctatagtcttaacaaacatcaattgaggctcttagagaatcactatgtccactgtaacattttcttaaacctcatgtgatattttgaggttaatgtgaccaattcattgacctgtcataagtctattataagttttgcaccttttgccccccctttttaatttgaattaaatggatgacattttaaaaagacaggcataaataggtacaattggtgagaaatgtttttcttctg

SEQ ID NO: 62625 - DNA, 502 bp, Homo sapiens
agaggcagaggcaggggcaggggcagggtagcaaatcttttttctagataggactccccagcttctctgtgcttttaagtctctgaagttgttttcacattatcaacataacaaactcattggcagtggggagtggtttagagtctggtttctttgtttctattatttaaagcataagcattttattagtctcaattccattgtgaactgctgaattttcatccctagtgtgagaaggtcacaatagtatttgtttcaatagataactctttctccctgtgctgtttctcactgagctgtggtgtttatgccttaagtacctgtgttatatgctacatgttgctttgaattctggtatttatgcatatctgtatatgtaagtatgttaatgtacactgatattttgctgtatttgccagtatgtttatgtgaaaattttggtcttggaaaatggtgggtgatgtgtagcttgttatttgggtgtgtgtatttatttgtatat

SEQ ID NO: 62626 - DNA, 230 bp, Homo sapiens
gtctttacccctaagtaggactttcatcaccagacctagtatgagctggttggttcctcaatacccgggccacaggccagcagcagtccatggttaggaactgggccacaccgcaagatgtgagcagcaggcaaacgagcaaagctgtatatttacagccactccctattgcttgcattaccacctgagctccacctgtcagatcagcagtggcattagattcttacagg

SEQ ID NO: 62627 - DNA, 3183 bp, Homo sapiens
ggtagcggcagcagcagcggcggtgcggagagcttggactgggagcccaaagctcggctgggcagcgggagaggaggagccgcaggagctgcagctctgccagcttgggccgagcctagagacaccggcctggctggtccacgccagccgcagaccgtggctgagcatggagctgtccccccgcagtcctccggagatgctggaggagtcggattgcccgtcacccctggagctgaagtcagcccccagcaagaagatgtggattaagcttcggtctctgctgcgctacatggtgaagcagttggagaatggggagataaacattgaggagctgaagaaaaatctggagtacacagcttctctgctggaagccgtctacatagatgagacacggcaaatcttggacacggaggacgagctgcaggagctgcggtcagatgccgtgccttcggaggtgcgggactggctggcctccaccttcacccagcaggcccgggccaaaggccgccgagcagaggagaagcccaagttccgaagcattgtgcacgctgtgcaggctgggatcttcgtggaacggatgttccggagaacatacacctctgtgggccccacttactctactgcggttctcaactgtctcaagaacctggatctctggtgctttgatgtcttttccttgaaccaggcagcagatgaccatgccctgaggaccattgtttttgagttgctgactcggcataacctcatcagccgcttcaagattcccactgtgtttttgatgagtttcctggatgccttggagacaggctatgggaagtacaagaatccttaccacaaccagatccacgcagccgatgttacccagacagtccattgcttcttgctccgcacagggatggtgcactgcctgtcggagattgagctcctggccatcatctttgctgcagctatccatgattatgagcacacgggcactaccaacagcttccacatccagaccaagtcagaatgtgccatcgtgtacaatgatcgttcagtgctggagaatcaccacatcagctctgttttccgattgatgcaggatgatgagatgaacattttcatcaacctcaccaaggatgagtttgtagaactccgagccctggtcattgagatggtgttggccacagacatgtcctgccatttccagcaagtgaagaccatgaagacagccttgcaacagctggagaggattgacaagcccaaggccctgtctctactgctccatgctgctgacatcagccacccaaccaagcagtggttggtccacagccgttggaccaaggccctcatggaggaattcttccgtcagggtgacaaggaggcagagttgggcctgcccttttctccactctgtgaccgcacttccactctagtggcacagtctcagatagggttcatcgacttcattgtggagcccacattctctgtgctgactgacgtggcagagaagagtgttcagcccctggcggatgaggactccaagtctaaaaaccagcccagctttcagtggcgccagccctctctggatgtggaagtgggagaccccaaccctgatgtggtcagctttcgttccacctgggtcaagcgcattcaggagaacaagcagaaatggaaggaacgggcagcaagtggcatcaccaaccagatgtccattgacgagctgtccccctgtgaagaagaggcccccccatcccctgccgaagatgaacacaaccagaatgggaatctggattagccctggggctggcccaggtcttcattgagtccaaagtgtttgatgtcatcagcaccatccatcaggactggctcccccatctgctccaagggagcgtggtcgtggaagaaacaacccacctgaaggccaaatgccagagatttggggttggggaaagggcccctccccacctgacacccactggggtgcactttaatgttccggcagcaagactggggaacttcaggctcccagtggtcactgtgcccatccctcagcctctggattctcttcatggccaggtggctgccagggagcggggagcttcctggaggcttcccagggccttggggaagggtcagagatgccagccccctgggacctcccccatcctttttgcctccaagtttctaagcaatacattttgggggttccctcagccccccaccccagatcttagctggcaggtctgggtgccccttttcctcccctgggaagggctggaataggatagaaagctgggggttttcagagccctatgtgtggggaggggagtggattccttcagggcatggtacctttctaggatctgggaatggggtggagaggacatcctcttcaccccagaattgcgctgcttcagccccatctccagcctgatcctctgaatcttccttccctccctttctgatacagtgactggggcaaaaggagccattgtgaccaggggctgcgggaggcctttcctgggaccttccttgggactggtctgggcccctggggcttgtcgcctgccctgagtccggagccctttgcctccttcctctcccctggggctgggaggctccatccgaccaatgtctgtaaagtgctttgaggatctccccagcaaagcaccttcagaatgtatcgacaccagctgggttagggtcaagggtgcctggggagggtgagtaatcctgcattgctaaaagagagggtctgtcccctcctctccacgtcccagaactggcccagctgcaggcactaagaagctcctcccctgagacaagtgaggggtagtcggtgaaaggcagatggacaaggggctcagggctgctgccttcctgtcctctggagagaacccagccaggcgcggtgccccttcctctcctcaggctcctccttgcccccaccttgccccaggaaaggccaaagtccaggtgactgccctccttctttcttgtaaataccaaccatgcatttgtacagtgggccctgttcatgcgaaatccacatccatggtctcctagacctgctaccctggtacttccaccctaccccaccccgagaagggcagagacgcatgtgactcacccctgcccttggtttcccagacccctgctatagccagagaacaataaagaagggagaccaggaaaaaaaaa

SEQ ID NO: 62628 - DNA, 2030 bp, Homo sapiens
ggtagcggcagcagcagcggcggtgcggagagcttggactgggagcccaaagctcggctgggcagcgggagaggaggagccgcaggagctgcagctctgccagcttgggccgagcctagagacaccggcctggctggtccacgccagccgcagaccgtggctgagcatggagctgtccccccgcagtcctccggagatgctggaggagtcggattgcccgtcacccctggagctgaagtcagcccccagcaagaagatgtggattaagcttcggtctctgctgcgctacatggtgaagcagttggagaatggggagataaacattgaggagctgaagaaaaatctggagtacacagcttctctgctggaagccgtctacatagatgagacacggcaaatcttggacacggaggacgagctgcaggagctgcggtcagatgccgtgccttcggaggtgcgggactggctggcctccaccttcacccagcaggcccgggccaaaggccgccgagcagaggagaagcccaagttccgaagcattgtgcacgctgtgcaggctgggatcttcgtggaacggatgttccggagaacatacacctctgtgggccccacttactctactgcggttctcaactgtctcaagaacctggatctctggtgctttgatgtcttttccttgaaccaggcagcagatgaccatgccctgaggaccattgtttttgagttgctgactcggcataacctcatcagccgcttcaagattcccactgtgtttttgatgagtttcctggatgccttggagacaggctatgggaagtacaagaatccttaccacaaccagatccacgcagccgatgttacccagacagtccattgcttcttgctccgcacagggatggtgcactgcctgtcggagattgagctcctggccatcatctttgctgcagctatccatgattatgagcacacgggcactaccaacagcttccacatccagaccaagtcagaatgtgccatcgtgtacaatgatcgttcagtgctggagaatcaccacatcagctctgttttccgattgatgcaggatgatgagatgaacattttcatcaacctcaccaaggatgagtttgtagaactccgagccctggtcattgagatggtgttggccacagacatgtcctgccatttccagcaagtgaagaccatgaagacagccttgcaacagctggagaggattgacaagcccaaggccctgtctctactgctccatgctgctgacatcagccacccaaccaagcagtggttggtccacagccgttggaccaaggccctcatggaggaattcttccgtcagggtgacaaggaggcagagttgggcctgcccttttctccactctgtgaccgcacttccactctagtggcacagtctcagatagggttcatcgacttcattgtggagcccacattctctgtgctgactgacgtggcagagaagagtgttcagcccctggcggatgaggactccaagtctaaaaaccagcccagctttcagtggcgccagccctctctggatgtggaagtgggagaccccaaccctgatgtggtcagctttcgttccacctgggtcaagcgcattcaggagaacaagcagaaatggaaggaacgggcagcaagtggcatcaccaaccagatgtccattgacgagtgccttcctgtcctctggagagaacccagccaggcgcggtgccccttcctctcctcaggctcctccttgcccccaccttgccccaggaaaggccaaagtccaggtgactgccctccttctttcttgtaaataccaaccatgcatttgtacagtgggccctgttcatgcgaaatccacatccatggtctcctagacctgctaccctggtacttccaccctaccccaccccgagaagggcagagacgcatgtgactcacccctgcccttggtttcccagacccctgctatagccagagaacaataaagaagggagaccaggaaaaaaaaa

SEQ ID NO: 62629 - DNA, 3056 bp, Homo sapiens
aggaaggcaggggccaaagaggaagttgtcccctcttgggggccctggggctcctggggtcaggattttgatactctgaagcaggaaactttgattcccatggcaaaccctgttcctgttcagaggagccacctccagggccccattctcaggctgcgctacatggtgaagcagttggagaatggggagataaacattgaggagctgaagaaaaatctggagtacacagcttctctgctggaagccgtctacatagatgagacacggcaaatcttggacacggaggacgagctgcaggagctgcggtcagatgccgtgccttcggaggtgcgggactggctggcctccaccttcacccagcaggcccgggccaaaggccgccgagcagaggagaagcccaagttccgaagcattgtgcacgctgtgcaggctgggatcttcgtggaacggatgttccggagaacatacacctctgtgggccccacttactctactgcggttctcaactgtctcaagaacctggatctctggtgctttgatgtcttttccttgaaccaggcagcagatgaccatgccctgaggaccattgtttttgagttgctgactcggcataacctcatcagccgcttcaagattcccactgtgtttttgatgagtttcctggatgccttggagacaggctatgggaagtacaagaatccttaccacaaccagatccacgcagccgatgttacccagacagtccattgcttcttgctccgcacagggatggtgcactgcctgtcggagattgagctcctggccatcatctttgctgcagctatccatgattatgagcacacgggcactaccaacagcttccacatccagaccaagtcagaatgtgccatcgtgtacaatgatcgttcagtgctggagaatcaccacatcagctctgttttccgattgatgcaggatgatgagatgaacattttcatcaacctcaccaaggatgagtttgtagaactccgagccctggtcattgagatggtgttggccacagacatgtcctgccatttccagcaagtgaagaccatgaagacagccttgcaacagctggagaggattgacaagcccaaggccctgtctctactgctccatgctgctgacatcagccacccaaccaagcagtggttggtccacagccgttggaccaaggccctcatggaggaattcttccgtcagggtgacaaggaggcagagttgggcctgcccttttctccactctgtgaccgcacttccactctagtggcacagtctcagatagggttcatcgacttcattgtggagcccacattctctgtgctgactgacgtggcagagaagagtgttcagcccctggcggatgaggactccaagtctaaaaaccagcccagctttcagtggcgccagccctctctggatgtggaagtgggagaccccaaccctgatgtggtcagctttcgttccacctgggtcaagcgcattcaggagaacaagcagaaatggaaggaacgggcagcaagtggcatcaccaaccagatgtccattgacgagctgtccccctgtgaagaagaggcccccccatcccctgccgaagatgaacacaaccagaatgggaatctggattagccctggggctggcccaggtcttcattgagtccaaagtgtttgatgtcatcagcaccatccatcaggactggctcccccatctgctccaagggagcgtggtcgtggaagaaacaacccacctgaaggccaaatgccagagatttggggttggggaaagggcccctccccacctgacacccactggggtgcactttaatgttccggcagcaagactggggaacttcaggctcccagtggtcactgtgcccatccctcagcctctggattctcttcatggccaggtggctgccagggagcggggagcttcctggaggcttcccagggccttggggaagggtcagagatgccagccccctgggacctcccccatcctttttgcctccaagtttctaagcaatacattttgggggttccctcagccccccaccccagatcttagctggcaggtctgggtgccccttttcctcccctgggaagggctggaataggatagaaagctgggggttttcagagccctatgtgtggggaggggagtggattccttcagggcatggtacctttctaggatctgggaatggggtggagaggacatcctcttcaccccagaattgcgctgcttcagccccatctccagcctgatcctctgaatcttccttccctccctttctgatacagtgactggggcaaaaggagccattgtgaccaggggctgcgggaggcctttcctgggaccttccttgggactggtctgggcccctggggcttgtcgcctgccctgagtccggagccctttgcctccttcctctcccctggggctgggaggctccatccgaccaatgtctgtaaagtgctttgaggatctccccagcaaagcaccttcagaatgtatcgacaccagctgggttagggtcaagggtgcctggggagggtgagtaatcctgcattgctaaaagagagggtctgtcccctcctctccacgtcccagaactggcccagctgcaggcactaagaagctcctcccctgagacaagtgaggggtagtcggtgaaaggcagatggacaaggggctcagggctgctgccttcctgtcctctggagagaacccagccaggcgcggtgccccttcctctcctcaggctcctccttgcccccaccttgccccaggaaaggccaaagtccaggtgactgccctccttctttcttgtaaataccaaccatgcatttgtacagtgggccctgttcatgcgaaatccacatccatggtctcctagacctgctaccctggtacttccaccctaccccaccccgagaagggcagagacgcatgtgactcacccctgcccttggtttcccagacccctgctatagccagagaacaataaagaagggagaccaggaaaaaaaaa

SEQ ID NO: 62630 - DNA, 2474 bp, Homo sapiens
ggtagcggcagcagcagcggcggtgcggagagcttggactgggagcccaaagctcggctgggcagcgggagaggaggagccgcaggagctgcagctctgccagcttgggccgagcctagagacaccggcctggctggtccacgccagccgcagaccgtggctgagcatggagctgtccccccgcagtcctccggagatgctggaggagtcggattgcccgtcacccctggagctgaagtcagcccccagcaagaagatgtggattaagcttcggtctctgctgcgctacatggtgaagcagttggagaatggggagataaacattgaggagctgaagaaaaatctggagtacacagcttctctgctggaagccgtctacatagatgagacacggcaaatcttggacacggaggacgagctgcaggagctgcggtcagatgccgtgccttcggaggtgcgggactggctggcctccaccttcacccagcaggcccgggccaaaggccgccgagcagaggagaagcccaagttccgaagcattgtgcacgctgtgcaggctgggatcttcgtggaacggatgttccggagaacatacacctctgtgggccccacttactctactgcggttctcaactgtctcaagaacctggatctctggtgctttgatgtcttttccttgaaccaggcagcagatgaccatgccctgaggaccattgtttttgagttgctgactcggcataacctcatcagccgcttcaagattcccactgtgtttttgatgagtttcctggatgccttggagacaggctatgggaagtacaagaatccttaccacaaccagatccacgcagccgatgttacccagacagtccattgcttcttgctccgcacagggatggtgcactgcctgtcggagattgagctcctggccatcatctttgctgcagctatccatgattatgagcacacgggcactaccaacagcttccacatccagaccaagtcagaatgtgccatcgtgtacaatgatcgttcagtgctggagaatcaccacatcagctctgttttccgattgatgcaggatgatgagatgaacattttcatcaacctcaccaaggatgagtttgtagaactccgagccctggtcattgagatggtgttggccacagacatgtcctgccatttccagcaagtgaagaccatgaagacagccttgcaacagctggagaggattgacaagcccaaggccctgtctctactgctccatgctgctgacatcagccacccaaccaagcagtggttggtccacagccgttggaccaaggccctcatggaggaattcttccgtcagggtgacaaggaggcagagttgggcctgcccttttctccactctgtgaccgcacttccactctagtggcacagtctcagatagggttcatcgacttcattgtggagcccacattctctgtgctgactgacgtggcagagaagagtgttcagcccctggcggatgaggactccaagtctaaaaaccagcccagctttcagtggcgccagccctctctggatgtggaagtgggagaccccaaccctgatgtggtcagctttcgttccacctgggtcaagcgcattcaggagaacaagcagaaatggaaggaacgggcagcaagtggcatcaccaaccagatgtccattgacgagctgtccccctgtgaagaagaggcccccccatcccctgccgaagatgaacacaaccagaatgggaatctggattagccctggggctggcccaggtcttcattgagtccaaagtgtttgatgtcatcagcaccatccatcaggactggctcccccatctgctccaagggagcgtggtcgtggaagaaacaacccacctgaaggccaaatgccagagatttggggttggggaaagggcccctccccacctgacacccactggggtgcactttaatgttccggcagcaagactggggaacttcaggctcccagtggtcactgtgcccatccctcagcctctggattctcttcatggccaggtggctgccagggagcggggagcttcctggaggcttcccagggccttggggaagggtcagagatgccagccccctgggacctcccccatcctttttgcctccaagtttctaagcaatacattttgggggttccctcagccccccaccccagatcttagctggcaggtctgggtgccccttttcctcccctgggaagggctggaataggatagaaagctgggggttttcagagaggtatgtcagagtcgaggattaggatacatcggaccaaatgacggttccaggcctgctggatggcgctgaaaagaacctcaccatgagcacacaatggcacgatagcgacccccactcatcccgcatgctaatatgaatatctacctgcatccatatctgaaatagacatcggggggcgtctc

SEQ ID NO: 62631 - DNA, 1884 bp, Homo sapiens
gcggccgcgtcgaccggagagcgagatcaaagggattggaaacagactggggactggcggggggagggggccggccagcctgtggagtcctccctgagaagcggagggcccggcttccaccgtgactccagcggcctgcttggggttttaattattattttgaaatttctgaatcgagctagagcgagagagcgagagatctccgtagactgcgactcgctggctttcgctccgagatgatgcagagtgcgactgtccccgcggaaggggctgtcaaggggctcccggagatgctaggtgtgccgatgcaacagattccccagtgcgctggctgcaaccagcacatcctggacaagttcatcctgaaggtcctggacagacactggcacagctcctgcctcaagtgtgcagactgccagatgcagctggcggacaggtgcttctccagggctgggagcgtctactgcaaggaggacttcttcaagcgcttcggcacaaaatgcacggcctgccagcagggtatccccccaacccaggtggtccgcaaggcccaggactttgtctaccacctgcactgctttgcttgcatcatctgcaaccggcagctggccacgggggacgaattctacctcatggaggacgggcggctggtgtgcaaggaagactacgagacagccaagcagaacgatgactcagaggctggagctaagcggccccggaccaccatcacagccaagcagctggagacattaaagaatgcatacaagaactcccccaagcctgcccggcacgtgagggagcagctgtcctcagagacaggcctggacatgagggtcgtacaggtttggtttcagaacagaagggccaaagagaaacgcctgaagaaggatgcagggcggcaccgctgggggcagttctataagagcgtcaagaggagccggggcagcagcaagcaggagaaggagagctctgcagaggactgtggggttagtgacagtgagctgagcttccgagaggatcaaattctctcagaacttggccacaccaataggatttatggcaacgtgggggacgttacaggcggacagttaatgaatgggagcttctccatggacgggacaggacaatcctatcaggacttgagggatgggagcccctatggaatcccccagtctccatcctccatatcgtccctgccatcccacgctcctttgctcaatgggctggattacacggtggacagtaatttgggcatcattgcgcatgcagggcagggagtaagccagacgctgagagccatggctgggggacccacctctgacatctccacaggaagcagtgtaggctatcccgactttccaactagcccaggctcttggctcgatgaaatggatcatcctcctttttaaacttctctcctccccaccctacctgcccccctggcttgagagaatatcttcaaggatcaaaagagacttgccttttaaggatcgaaagtacgccaatgtgaatttccattattttcaatggaagtcctccgctgattcctagaaggctgtgagaccacactagggcattgtttccctggggaagcagtgggagagcagactcatctcagaacacagcacagggggtaatggcctagagctctagggacactggcttgttgggtctctcccctgctgttctgcttaggggcttggctgctcagtgctttggtagcacaaggtgactgtgataggcccccttggcctttgggaactttgctccaactggtgtgtctcacacaatgcctcccaaaacactgctctcaccagaactgagactcctaaggtagaggcctcacagcccttgagtaaaataaaagtgatttctggaccatcc

SEQ ID NO: 62632 - DNA, 1450 bp, Homo sapiens
ccgctttttgtgtctgagttctgtcgttgtgttgctctcgcatgttttcttgtctcctgctctttttctgttttggttctttgttctgccctccgcggttgttgcgttgtcttgctcgctctctcgcttgtttgtggcgtttcttctcctcctgtgtttggttcgttcttcgtactcctctctttggagtggtgctttctgtctcgtgttccccgcgctcgggcgcgctctctccagcttacccttgttttcttgccttgtttcctctttgtttttctcttccccgtttcttctttttgttttcttgttttagctgtttcttattgttggtccttttttcccgttacatatgctgtggtgtgggttcttatgtgtctctctctgcctgccggtgtgagatttgtgcgcgccccgcgccctcctcttttgttttctttttttttttgttttttttttttttttttttttctcttttttgtttttttttttttttttttttttttttttttttttttttttttttttttttttttttttttttttttttttctttgtccccagtgaagagcttattgaatacagacagaaaccaagtcctttgatattgaacctctcttccagatagaccagaaggattttgtacagatgtctaagagtggtcctcagcttccctgaccatatgggcctgcttgcttcccaatcaactaaaccaagccctttctcagcttgaaagctttcagggtaaatgttgtcagcatgtagtttccatttgtgatgtggagacatctgacccacccagccttaggcattcatcctcctcagtgtagccagagtattagtacacgagccacaagggaccaacgagctcaccaaacatttgtccatccttctgggacctgggaatttagtctttgcaggtgtttcttgtttttctccttggcctgggttggcctctggatatcaggctgccatattggtgtgtctgacccatgcttggctgcaaggcagctgccatccttgggcatctttcctggtcatgtgtgttccttttaaggatcgaaagtacgccaatgtgaatttccattattttcaatggaagtcctccgctgattcctagaaggctgtgagaccacactagggcattgtttccctggggaagcagtgggagagcagactcatctcagaacacagcacagggggtaatggcctagagctctagggacactggcttgttgggtctctcccctgctgttctgcttaggggcttggctgctcagtgctttggtagcacaaggtgactgtgataggcccccttggcctttgggaactttgctccaactggtgtgtctcacacaatgcctcccaaaacactgctctcaccagaactgagactcctaaggtagaggcctcacagcccttgagtaaaataaaagtgatttctggaccatcc

SEQ ID NO: 62633 - DNA, 1088 bp, Homo sapiens
ctgttgggtgcaggtgggtccctgggctgacctatcattggtttctctgggaataatttctcaaagactaaaactgctcacctctgttggagagagaaattctttcaagtggcaaagattccattagatccccttaatgaaattctttaagaaaaaagaaggttcatttgccttaatcaagtcaattctttgtccccagtgaagagcttattgaatacagacagaaaccaagtcctttgatattgaacctctcttccagatagaccagaaggattttgtacagatgtctaagagtggtcctcagcttccctgaccatatgggcctgcttgcttcccaatcaactaaaccaagccctttctcagcttgaaagctttcagggtaaatgttgtcagcatgtagtttccatttgtgatgtggagacatctgacccacccagccttaggcattcatcctcctcagtgtagccagagtattagtacacgagccacaagggaccaacgagctcaccaaacatttgtccatccttctgggacctgggaatttagtctttgcaggtgtttcttgtttttctccttggcctgggttggcctctggatatcaggctgccatattggtgtgtctgacccatgcttggctgcaaggcagctgccatccttgggcatctttcctggtcatgtgtgttccttttaaggatcgaaagtacgccaatgtgaatttccattattttcaatggaagtcctccgctgattcctagaaggctgtgagaccacactagggcattgtttccctggggaagcagtgggagagcagactcatctcagaacacagcacagggggtaatggcctagagctctagggacactggcttgttgggtctctcccctgctgttctgcttaggggcttggctgctcagtgctttggtagcacaaggtgactgtgataggcccccttggcctttgggaactttgctccaactggtgtgtctcacacaatgcctcccaaaacactgctctcaccagaactgagactcctaaggtagaggcctcacagcccttgagtaaaataaaagtgatttctggaccatcc

SEQ ID NO: 62634 - DNA, 826 bp, Homo sapiens
cccttaatgaaattctttaagaaaaaagaaggttcatttgccttaatcaagtcaattctttgtccccagtgaagagcttattgaatacagacagaaaccaagtcctttgatattgaacctctcttccagatagaccagaaggattttgtacagatgtctaagagtggtcctcagcttccctgaccatatgggcctgcttgcttcccaatcaactaaaccaagccctttctcagcttgaaagctttcagggtaaatgttgtcagcatgtagtttccatttgtgatgtggagacatctgacccacccagccttaggcattcatcctcctcagtgtagccagagtattagtacacgagccacaagggaccaacgagctcaccaaacatttgtccatccttctgggacctgggaatttagtctttgcaggtgtttcttgtttttctccttggcctgggttggcctctggatatcaggctgccatattggtgtgtctgacccatgcttggctgcaaggcagctgccatccttgggcatctttcctggtcatgtgtgttcctaggttgtgaagagcaggggaccatcagagtcctggcagctgacaataaatctccgttcttttgtccacagaggatcaaattctctcagaacttggccacaccaataggatttatggcaacgtgggggacgttacaggcggacagttaatgaatgggagcttctccatggacgggacaggacaatcctatcaggacttgagggatgggagcccctatggaatcccccagtctccatcctccatatcgtccctgccatcccacgctcctttg

SEQ ID NO: 62635 - DNA, 474 bp, Homo sapiens
agacagagttctgaggcccaccctggggaaaaaggggtggggccgcatcgcactccccaagacctgtgctcccattcaggcttcagtctgcttcccagccgcccgccctagggggtccctgggggctttgggtttgtggtggacgccccctgagtatgtcccttgtgcttgtgtggcaggtttggtttcagaacagaagggccaaagagaaacgcctgaagaaggatgcagggcggcaccgctgggggcagttctataagagcgtcaagaggagccggggcagcagcaagcaggagaaggagagctctgcagaggactgtggggttagtgacagtgagctgagcttccgaggtgagcagggctggaggggccagccgaggccttaggaaagtcccctgggaatctgtaatccctggcactcaggagggatctttcttgaggccttggcaactccctcctgaacacaggcttttc

SEQ ID NO: 62636 - DNA, 271 bp, Homo sapiens
agaagatttgcaggtctaataatttttaaagttgaatgcagttatttgttatgatgagccattttaaagtcaagttacaactatttctcacccaaagagaattggacacacttcggaaaattaggccataaggcagaattttctagggctgtggctcttgcctaaaaatgtcccagagtgtggggctacctacaaatcatgggcaataaccccttgtcctattaacatcattgattaggtcacctgcctatagatatacaacatctccagg

SEQ ID NO: 62637 - DNA, 399 bp, Homo sapiens
ggctatttttttaaattgaagtgagatttacgtaataaaattaactgtttgaaattgcacaattcagtggtatatattacattcacaatgttgtgcaacacctcctctacctaggtccaaaattttggggtccaaaataatgaccccaaaagaaaactccatcctcattagaagttgctcctcatttcttcctcttcccaacttctggcacccaccaatctgggttctgtctctagatttatctattctggatacttcatataaatggaatcataataggtgggtgttgggcatggcttccttcacttagcataatgtttttgaggttcatccattttgtagcatgtatcagtacttcctttcttcttatggctgaataatattccattgtatgtatat

SEQ ID NO: 62638 - DNA, 428 bp, Homo sapiens
cgtagaaataatttcaggatccagttagacttagtctgtgtgaccacaggggccaagagtcttccttgagatttctatacttaatgaaatgacactacggttattaacaacaacaacagtaatgatagtaactagcccttaatgagctgctatgttccaggcattgtgctcagtcctttacatgcattatttaatttaaagctcttgatagccttacaaggtcttattcctatttcaaagacaagaaaatgcagtgagagaggtaaagtgatttgtcagaggctgagccaagatgtgagccctggtctgtgtcccaccagagctcaggctaccccaccgcaccacactgcctcagatgtactttcttgagagagccctgttttaaactcctgccatcagtgaccactccaggagcctctgggcctcgc

SEQ ID NO: 62639 - DNA, 1189 bp, Homo sapiens
ggacttttctttttccgttatccagggaaatgcgtgagttactatgacagatgccaaagacttttggctctggtagtggaaattgggaggcaatggtgaaatgaagtaagaaattccagggccagaaggtggatgcaagtcagcaacggcttttcccaggagcttgctctttttggacagcataaaatagaggatgctgctataacatatgtaagtgaaaatgaagaaattaaacacgaagaaaaacctggaaaaagcatacatcattcaaaatcacatgttggaagaggacgtatatattatgctaaattcattaacacaaatgcaagaacatacaatgaaccatttccctacatagatcccaaaaaagggccagaaatacagggtgactggtggtcacatggtaaagcactggaacctgtcttcctaccaccttacgactctaagagcacccagaggagtgacttccaaaaaccatcgtgtccactggttttgccagtcaaacacagcaagatgcaaaagccttcttgtggaatagtaccacttgcctctcctggtacatcagcagaacttcaaaacaattttatagaatacatctcttttatacatcaatatgatgccagaaaaactccgaatgagcctctccagggaaagagacacggagcttttgtacagagagagataaaaccaggcagtaggccaacagttcctaaaggagcagaggtattactgaacactccagggtcacgttcatcagaacagtccaaaaaaacagagaaaggaaactcagcggaaagcagaatgatctcaccaggtctctgccaacaaaattctcaggagctgttagagcctaaaactcacttatcagaaacagacgtcagacaggcagccaaggcatgccccagcactcttgagagcagagaaaagacctcaggcgccactcaaacaactgtaggagatgctcttttcactacgcacaagcctttaaatccaccaattaaaaaatcagaataaattaccttcttcagataaaaatctaatccctggaatatagggaaatttcacaatcatcatcttggccctcacatttacttttctgttatcagtaacttcagaacatacaatttatgtaaatggaaaaagagaaaaaagacaattaaaatacaaccaaatgttattaataagagtg

SEQ ID NO: 62640 - DNA, 1015 bp, Homo sapiens
ggacttttctttttccgttatccagggaaatgcgtgagttactatgacagatgccaaagacttttggctctggtagtggaaattgggaggcaatggtgaaatgaagtaagaaattccagggccagaaggtggatgcaagtcagcaacggcttttcccaggagcttgctctttttggacagcataaaatagaggatgctgctataacatatggtgactggtggtcacatggtaaagcactggaacctgtcttcctaccaccttacgactctaagagcacccagaggagtgacttccaaaaaccatcgtgtccactggttttgccagtcaaacacagcaagatgcaaaagccttcttgtggaatagtaccacttgcctctcctggtacatcagcagaacttcaaaacaattttatagaatacatctcttttatacatcaatatgatgccagaaaaactccgaatgagcctctccagggaaagagacacggagcttttgtacagagagagataaaaccaggcagtaggccaacagttcctaaaggagcagaggtattactgaacactccagggtcacgttcatcagaacagtccaaaaaaacagagaaaggaaactcagcggaaagcagaatgatctcaccaggtctctgccaacaaaattctcaggagctgttagagcctaaaactcacttatcagaaacagacgtcagacaggcagccaaggcatgccccagcactcttgagagcagagaaaagacctcaggcgccactcaaacaactgtaggagatgctcttttcactacgcacaagcctttaaatccaccaattaaaaaatcagaataaattaccttcttcagataaaaatctaatccctggaatatagggaaatttcacaatcatcatcttggccctcacatttacttttctgttatcagtaacttcagaacatacaatttatgtaaatggaaaaagagaaaaaagacaattaaaatacaaccaaatgttattaataagagtg

SEQ ID NO: 62641 - DNA, 472 bp, Homo sapiens
aagaggacgtatatattatgctaaattcattaacacaaatgcaagaacatacaatgaaccatttccctacatagatcccaaaaaagggccagaaatacaggttggacagatgttcattgtatacaaatagagatttagattcagatgctgttttgcagaataatttggtcacagactataaaggatgagacacatctcagagtagtacttatcataatccaatagttaaaagcagtaacctgaaactattttgccagctgacttttacatataaacaatacggatacagggagggaatctaagtaattgtttccctagattgggtcagattattgccacaaagtagtgctttggggttactaaagaaatttcatgtatttacgatatatattctaatataaaaatgtcccatgatactcagtaattcacataccttctgtaaaataataatcatttattgaaagcatatgaa

SEQ ID NO: 62642 - DNA, 1050 bp, Homo sapiens
cgtagaggcccatggaggaaaaggaagataagcatcaacagcataaaatagaggatgctgctataacatatgtaagtgaaaatgaagaaattaaacacgaagaaaaacctggaaaaagcatacatcattcaaaatcacatgttggaagaggacgtatatattatgctaaattcattaacacaaatgcaagaacatacaatgaaccatttccctacatagatcccaaaaaagggccagaaatacagggtgactggtggtcacatggtaaagcactggaacctgtcttcctaccaccttacgactctaagagcacccagaggagtgacttccaaaaaccatcgtgtccactggttttgccagtcaaacacagcaagatgcaaaagccttcttgtggaatagtaccacttgcctctcctggtacatcagcagaacttcaaaacaattttatagaatacatctcttttatacatcaatatgatgccagaaaaactccgaatgagcctctccagggaaagagacacggagcttttgtacagagagagataaaaccaggcagtaggccaacagttcctaaaggagcagaggtattactgaacactccagggtcacgttcatcagaacagtccaaaaaaacagagaaaggaaactcagcggaaagcagaatgatctcaccaggtctctgccaacaaaattctcaggagctgttagagcctaaaactcacttatcagaaacagacgtcagacaggcagccaaggcatgccccagcactcttgagagcagagaaaagacctcaggcgccactcaaacaactgtaggagatgctcttttcactacgcacaagcctttaaatccaccaattaaaaaatcagaataaattaccttcttcagataaaaatctaatccctggaatatagggaaatttcacaatcatcatcttggccctcacatttacttttctgttatcagtaacttcagaacatacaatttatgtaaatggaaaaagagaaaaaagacaattaaaatacaaccaaatgttattaataagagtg

SEQ ID NO: 62643 - DNA, 425 bp, Homo sapiens
gaattactaagttgaagattatgatttattttttctcccttgacaacaattgcttacatgtacaatgactggatttgctgggcatttgttgcttgttaataaaaggctaaataattatcttaaaacattttaataacttacattgtcaacaggaatatataaatatatctgtttcattgtaatttactagcactgggttttatcattttaatctgttttcttccaattaataggtatgaggtgatagcttatatctgttttcatttgtatacatttataaagttgaccatttcttgaaactttttacaaatctttatatattccagagagtcgcatgttcataatgagcagggttaccttcatatattcatattaacttctctaataataaatataatactttttccatatataataaatctttt

SEQ ID NO: 62644 - DNA, 574 bp, Homo sapiens
atgatgtgctgccagaatttctaagtttccagttctttggggagctcaagattttggaatagctgggataaaaagagaaatctctttcaagctgagtgaaaagcccactctagctctcctgaagagacaggaagagaaaagtggggcagagaacccatcggcaaagctctgggcttggggcacagggtctctgtgacatcctgggcaccttcactgtggccagtgaggaggaagttctgccccagccggcctgcggggactatggggcaagggaggagctcttcctctagaaatacagcagcctcacccttgtggggtagctgtttcaggcaccagaaggactcagcccatggactccggccacctggggcttggtttcctcaatgcagcatttcaatgcctgagcaggtgccccgagcttaacagttcatgactcctgatgacaacaaggaaggattgctccacattttgtccaaggcgatcatcaagttggggaaagcataggtactggaattttcagattcataaagccataggcttgtagagttggaaaatacctcagtattcacaaatt

SEQ ID NO: 62645 - DNA, 2817 bp, Homo sapiens
agcgggtccagcctcggcgcccgggaccgagcgcgtcgctcgccgccgcggagcgcgtagccggagcgcctggggaaggcggagatgaagaccacgccgccgcgcgccgggagctgctgagcctaccgccgccagagtccagttgacacttactttgacaaaggcaaatttggaagcaattacttgaggacagttcatatagcatctggacagtcaacacgggcaccatgaagcacttcctgagaatgttgatccaggtatgcctgtatttttactgtaaatttctgtggcgctgcctgaaatttgtaatgaggaagctaactggaagatgtgaactacaacggatctgttataataccaagccgggagcttctagaaccatgaaaatcgaaacatcactgagggattctaaaagtaagctgttgcagacttctgtgagtgttcaccccgacgctattgaaaaaactatagaagatatcatggaactgaaaaaaattaatcctgacgtaaatccacagctgggaatctctcttcaggcttgccttctgcaaatcgttgggtacaggaaccttattgcagatgtggaaaaactgcgtagagaggcctatgattctgataatccccaacatgaagaaatgcttttgaagttatggaaattcttgaagcccaatactccactggaatctcggatttctaagcagtggtgtgaaattggtttccaaggtgatgatcctaaaacagactttcgaggaatgggacttctgggactgtacaatttgcagtatttcgcggaaagggatgccacagcagctcagcaggtcctgtctgactctcttcatccgaaatgcagggatatcactaaagaagaaataagcaaattcagcaaagcagaatgggagaagaaaaggatggataaggcaattgggtactcatttgcaattgtgggcatcaatataactgacctggcatataatctactggtcagcggagctctaaaaacccatttctacaatatcgccccagaagctccaacattgtctcactttcagcaaacattctgctatttgatgcatgaatttcataagttttggatcgaagaggaccccatggacataatggaatttaatcgtgtgagggagaaattccgcaagaggatcatcaaacagctgcagaacccagacatggcgctgtgcccacattttgctgcctcggaaggtttaatcaacatgtagttgcccacgccggttttaatggataccctggaacactgcctcattgtcttgttagatctctgcttaggtcgcagctcacgcattgaatgcacacagtgattgtatgcatgccttttggtacagtgttttcatctcttggtcataattccgagatccccagagaccactgtttctggagtatctgtcatccagtgactgctcatattgtggcattatgcagtgttacatcttgccttgatacccaggtatggagagagttttctatttttttagactttttttcctctccctcataattcagcattaaagaattgtatttctctagctgtattttgtatgtaagaggtttagctgaatctcattctgtgaaagccttttaatttattgaaatgtttcatgactactgctgctagctcttcaagccaggttcatgcttggacctcattctgataaagtataagactttaaaataatacaaaacagggccgggcgcagtggctcacacctgtaatcccagcactttggggagctgaggcgggcggatcacgaggtcaagagatcgagaccatcctggccaacatggtgaaaccccgtctctactaaaaataacaaaaattagctgggcgtggtggtgggtgcctgtaatcccagctactcgggaggctgaggcaggagaatcgcttgaacccgggaggtggaggttacagtgagccgagatcataccactgcactccagcctggcgacagagcaagactccatctcaaaaataaataaataaataaataaataaataaataaataaataaataaataaaatagtacagacagacacatgataagccaaactgttcctgcaaacatagctatgcttcatgaggcttacaagaagtaactttaggtaggagctgtttttgtttgaagtactgcaaaattatattgtaacttcccctcaccccagttgcaattgtgtcatagtcatctgtatatcaaactattttattcccataacttcattggcttggatgcctaagtgtatgatgcttgaagcctcagaaaagaaataagcatatttcaaaagctgcaaaaggtttttcactgcctgcctcttgcggaactgggttacaccctggcactgttctgatccaagcatatttgcttggggaactaagtgctgactagtttgttttctatgtcaaggggcaatattaaaaaacaatttgcaagaaaatgtgtttcaagagagcaacctaagctaagtcactctgcgatatttcttgaaaataacgaccttgtcttgtatcagtggaagaagtaagttgcttagaaagggaaaagtcaaattgttccagaactgctaaaaatcattttaaaaaccatgatttagtttggaattatgattgtagtctgttgaatagtatttaccatggcatttcatacccatggtattttataccttctgactatcaattttagtattattagatgtttgtgtaaccacttgcttatttaaatgaattttgagtactgcctaattgtcagttatatgaataaattacatgtcattctactgtaacgtatattgga

SEQ ID NO: 62646 - DNA, 239 bp, Homo sapiens
ccccccatcgtgaaaatgtcaaatttattagaattcaagtacgctaaatcaattgttgcttttaacttaagtcttcatatagaagcttaagcaaatgtttgaagcctctatcccagtagatactgattaagcctctggtgttaatgaaaaggaaagtgattaaaacatgttttccagctgttgcagacttctgtgagtgttcaccccgacgctattgaaaaaactatagaagatatcat

SEQ ID NO: 62647 - DNA, 2305 bp, Homo sapiens
ttatggtgtactcagtggctgctacctaaattgtcgttacctaaatggctgttacctaaatggctgttacctaaatggctgttacctaaatggctgttttaggataatccccaacatgaagaaatgcttttgaagttatggaaattcttgaagcccaatactccactggaatctcggatttctaagcagtggtgtgaaattggtttccaaggtgatgatcctaaaacagactttcgaggaatgggacttctgggactgtacaatttgcagtatttcgcggaaagggatgccacagcagctcagcaggtcctgtctgactctcttcatccgaaatgcagggatatcactaaagaagaaataagcaaattcagcaaagcagaatgggagaagaaaaggatggataaggcaattgggtactcatttgcaattgtgggcatcaatataactgacctggcatataatctactggtcagcggagctctaaaaacccatttctacaatatcgccccagaagctccaacattgtctcactttcagcaaacattctgctatttgatgcatgaatttcataagttttggatcgaagaggaccccatggacataatggaatttaatcgtgtgagggagaaattccgcaagaggatcatcaaacagctgcagaacccagacatggcgctgtgcccacattttgctgcctcggaaggtttaatcaacatgtagttgcccacgccggttttaatggataccctggaacactgcctcattgtcttgttagatctctgcttaggtcgcagctcacgcattgaatgcacacagtgattgtatgcatgccttttggtacagtgttttcatctcttggtcataattccgagatccccagagaccactgtttctggagtatctgtcatccagtgactgctcatattgtggcattatgcagtgttacatcttgccttgatacccaggtatggagagagttttctatttttttagactttttttcctctccctcataattcagcattaaagaattgtatttctctagctgtattttgtatgtaagaggtttagctgaatctcattctgtgaaagccttttaatttattgaaatgtttcatgactactgctgctagctcttcaagccaggttcatgcttggacctcattctgataaagtataagactttaaaataatacaaaacagggccgggcgcagtggctcacacctgtaatcccagcactttggggagctgaggcgggcggatcacgaggtcaagagatcgagaccatcctggccaacatggtgaaaccccgtctctactaaaaataacaaaaattagctgggcgtggtggtgggtgcctgtaatcccagctactcgggaggctgaggcaggagaatcgcttgaacccgggaggtggaggttacagtgagccgagatcataccactgcactccagcctggcgacagagcaagactccatctcaaaaataaataaataaataaataaataaataaataaataaataaataaataaaatagtacagacagacacatgataagccaaactgttcctgcaaacatagctatgcttcatgaggcttacaagaagtaactttaggtaggagctgtttttgtttgaagtactgcaaaattatattgtaacttcccctcaccccagttgcaattgtgtcatagtcatctgtatatcaaactattttattcccataacttcattggcttggatgcctaagtgtatgatgcttgaagcctcagaaaagaaataagcatatttcaaaagctgcaaaaggtttttcactgcctgcctcttgcggaactgggttacaccctggcactgttctgatccaagcatatttgcttggggaactaagtgctgactagtttgttttctatgtcaaggggcaatattaaaaaacaatttgcaagaaaatgtgtttcaagagagcaacctaagctaagtcactctgcgatatttcttgaaaataacgaccttgtcttgtatcagtggaagaagtaagttgcttagaaagggaaaagtcaaattgttccagaactgctaaaaatcattttaaaaaccatgatttagtttggaattatgattgtagtctgttgaatagtatttaccatggcatttcatacccatggtattttataccttctgactatcaattttagtattattagatgtttgtgtaaccacttgcttatttaaatgaattttgagtactgcctaattgtcagttatatgaataaattacatgtcattctactgtaacgtatattgga

SEQ ID NO: 62648 - DNA, 583 bp, Homo sapiens
agcgcagaaactctgcttacaggctgcactcgccccgactcctctccagacgtgggatcccatgttatacttggagtgaatctggtcgctcgctccccgtccccgattcccactttgcttgcctcttctccccatccatctaccccacacgcattttccagaaatctccccaactcgacgcccactcaggctactgaaccccaataacgccacccttttactaagaggagcctccgtcgtcccaaccccttgctccgagcgggaagcttggtgcagcgcaccaaggtccggtagaggggggcggcgccccctgcgccgtgggccagcaggccgcggacgcgcagacagcaagtggaccccaagggctggagccgcaacgcaagttccccctgactgggggacgccgcccagctcctggagcctgcgaaggctcttgaagctgagcttcccagggataccagaagggacactctcgtgcaattccggctagggaaagcgagggaaggtggcggctccgggcagggagcgagcgagtgctccacgccgcccgcaggatcgagtgagtcacgcggccgccagacga

SEQ ID NO: 62649 - DNA, 528 bp, Homo sapiens
aaaggaacgatgtggacctgacctcaaagaaatccattggagaatatgacagatttagatttattgatcaactttacttttcctatacagatgggaaaacagcctgcaaaaatgttaagtagcttcctcaggatcaagtactattggagccagcattggtggtcaatcctgtatagaaatgacttcagttgtagatctgtgaccttccttacttaccttcctctaccaaagtgggtcaaccaaaaccgcatggcgtactactctctgaagcctctactaccctgctcctccgtgttgacatgtggtcaggcaagccaggacttactcacatcagctacatcagttactgggatggagaaaattgaagcctagaaagatcaagaaactttctccaggccataaatagaggaatcaggattcaaatcagatagaccccagggcttgttctcttcaacaccacattaccctacattattattcaattattaaataaaaccttgcattagtggcatttccaaatgcataaca

SEQ ID NO: 62650 - DNA, 317 bp, Homo sapiens
gtgaaaccttatagatcccagcaggttttctgccaagagagtcagatgcaatttttaaaaacattttacttgtgggcaaaaatcccataacagcagctaggccttgaccccttctggttgactcttttcacaaataagtgtttgataatcacctttcgtggtaaaatatttgatttattttatgtcagttctttggagggcccttaaaaaaaactgcaaaagcattcactagcagctttagggaaggggaggaaagaacaggaagaattatgaacacacacccttagaatcgttatcatattaaacctgtgttcctt

SEQ ID NO: 62651 - DNA, 169 bp, Homo sapiens
cctcatggtgggtcgcctgacctatgagcagagatggaaggaagaatgccaatttggaggcagatgtgggaagtaggagtgctgtggcaacacggtgtggaaatagggagttctcttcaggcgtgatgctcacagtttacataaatctattgatctatgtatttacctg

SEQ ID NO: 62652 - DNA, 123 bp, Homo sapiens
cttcattagcatgctgacttgagactgaaactggcctccttgggaaattaggctgctatttctctcgcctgatttcttgggaagtcagataacaactcagtgttggtttgctgagcacgggtg

SEQ ID NO: 62653 - DNA, 2588 bp, Homo sapiens
acagtctgcattgagcttggctcaggaaagaagggaaatccaggcggggcctgttgggcccaggtcttgagctcttttggctccagagttcccagcacagtcatggatcaaaactcagtgcctgaaaaggctcagaatgaggcagacaccaataacgcagataggttctttcgctctcactcatcacccccacaccacaggccaggccacagcagagctctccaccattacgagttgcaccatcacggcgtgccccaccaacgtggtgaatctcaccaccctccggagttccaagacttccacgaccaagccttgtcctcccatgtccaccaatctcaccaccacagcgaggcacggaatcacggcagagcccatggccccacaggctttggtctggctccctctcaaggcgccgtcccctcccaccgttcctacggtgaggactaccatgatgagctccaacgtgatggcaggaggcatcatgatgggtcccaatacggtgggttccatcagcagagtgactcccattaccatagggggtctcaccatggcagaccccaatatctcggtgagaatttatcccactattcctctggcgtgccccaccacggtgaggcttcccaccatggtgggtcctacctcccccatggacccaatccctacagtgagtccttccaccacagcgaggcttcccaccttagcgggctccaacacgatgagtcccagcatcaccaagtcccccaccgtggctggccccaccatcaccaagtccaccaccatggcaggtcccgtcatcatgaagcccaccagcatggaaagtctcctcatcacggagagaccatttcccctcattcctctgtggggtcctaccagcgtgggatatctgactatcacagcgagtaccaccaaggtgatcaccaccccagtgagtaccaccatggcgaccatccccaccacacacagcaccactaccaccagacccaccggcaccgagactaccatcagcaccaagaccaccacggcgcgtatcattccagttacctccatggcgactacgtccagagcacttcccaactctctatcccacacacatcccggagcctgattcacgatgcccccggccctgctgcttctcgtacaggagtcttcccctatcacgtagcacacccacggggctcggctcacagcatgactcggtcctccagcacaatccgctcacgtgtcacccagatgtccaaaaaagtccatacccaggatatctccaccaaacattcagaagactggggcaaagaagaagggcaatttcagaaacgcaaaaccggcaggctccagcggacccgcaagaagggacactctaccaatctcttccagtggctgtgggaaaagctaaccttcctcattcagggcttccgggaaatgatccggaacctgacccaatccttggcctttgaaactttcatcttcttcgttgtctgcctcaacaccgtcatgctggtggcccagaccttcgctgaagtcgagatccggggcgagtggtacttcatggccttggactccatattcttctgcatctacgtggtggaagccctgctcaagatcatcgccctgggcctctcgtacttctttgacttctggaacaatttggacttcttcattatggccatggccgtgctggacttcttgctgatgcagacccactccttcgccatctaccaccaaagcctcttccggatcctcaaggtcttcaagagcctgcgggccctgagggcaatccgggtcctgcggaggctcagcttcctgaccagcgtccaggaagtgacagggaccctgggccagtccttgccgtccatcgcagccatcctcatcctcatgtttacctgcctcttcctcttctccgcggtcctccgggcactgttccgcaaatctgaccccaagcgcttccagaacatcttcaccaccatcttcaccctcttcaccttgctcacgctggatgactggtccctcatctacatggacagccgtgcccagggcgcctggtacatcattcccatcctcataatttacatcatcatccagtacttcatcttcctcaacctggtgattactgtcctggtggatagcttccagacggcgctgttcaaaggccttgagaaagcgaagcaggagagggccgcccggatccaagagaagctgctggaagactcactgacggagctcagagctgcagagcccaaagaggtggcgagtgaaggcaccatgctgaagcggctcatcgagaaaaagtttgggaccatgactgagaagcagcaggagctcctgttccattacctgcagctggtggcaagcgtggagcaggagcagcagaagttccgctcccaggcagccgtcatcgatgagattgtggacaccacatttgaggctggagaagaggacttcaggaattgaccccaggaggacaccagatacagacttcagcccctggcagtctgcccacctgggtgcactgggacgggtccccagatctgctggaatgattgtccggggctgcagagcaggggccccaacagagtttttaaaccccaaaaagc

SEQ ID NO: 62654 - DNA, 402 bp, Homo sapiens
aaatgttgatatttttaaaaaatctgtcgtgaaaaatgccatggtaaagtggtcttctttttaatgatttacaagcctttaacttataacccaaaacacagttgcttatttctttatagactcatgtgttctgaagataagtgaaacttttaaatgatttgagaggtttaggtagcatgcctgttgatatggtttggctctgtggccccacccaaatctcaccttgaattgtaataatccccatgtgtcaagggtggggccaggtggagataattggatcatgggggtggtttccctcaagctgttctcgtggtagtgaatacatctacgagatctgacggttttataaaggagagttcccctgcacatgctctcttgtctgccaccatggaagacatgact

SEQ ID NO: 62655 - DNA, 1007 bp, Homo sapiens
gaacatgattatttcataatttaaaaaataggagccacggggttagtgaataagctgttacgtgtcataatgaaccctcctgtttgtgtaacgaatcccatttacagtagtctgtaggcagacattgtgaagaaactagtagttctttctttctcctatatgcacctataggccggcagaaatatctagccctgaaaagtgaaatgaagcatgctttctgaatggttcatcatttactgtttccttccagtgaatggaagattttaacacaaaggagagtttgcaggcagatgttgagaagaagctagtagaagcttccaccttgttaatctttatgtatttatttagttatcaagtcatttgtcttgatattagttcatttaattatttaaatgaattaatgcctgtaatgtaggcagaagaaaaaaattcaattttaccattaactaaacataattttggaaacgctgagggatttcccagaacccaaagccagcctcttggctcctagtggccccgagcagccctggtgccctgcaaacccacccaccagctgccccacagaggatctcttctctcaaggagagggccattgttactcctccccaccagggaggcactggggatccttgattagggtttgggggagcaggaggaggtcccattgaggacacacaccagacttgtgctgagtaggggcttgggccacatgcagcactctcatgagatttgccaattcaccaaagcaaacccagatcaacactttgttgctctaatagggtgttgtgaccttcttcttctaattgttgaatatttaactgatgttaaaaatggtgattattgttgtaagcaatgaaaacacaataggcatataaatgggatatgtttgtatgtcagattaaatataacctataaatatgtctccccagccctgctctctaagagagaactctgttcacaattgagtctcctcctgctagtatttccccgtactcttagtaccactc

SEQ ID NO: 62656 - DNA, 539 bp, Homo sapiens
ataagttgcaagacatcatgacacttcactcctaaatactttagcatgcacctaacaataacaatattctcccataaaaccacaataccacaatcacacaagaaataagcattaaaagtccgtctttaagggaagatttggccactggggttccactgggcctggccaaccgcatgttctgtctaccactggcccagcatccaaggcctccctggagaggccagccctgagcaccactggttaggcaatcggttagttagttggaagacttatcagggtatgaatgtacactcaaggccagatatgagactcccaacaagacccagactgcaaaaggcagagtggaccccgtgaggctgtcgatggagtctcagggcccatcccaggtgaggagggcaccctgaagccatttccatgacttgctttgtgaacatttctgagaaaactcagcttcctgattctctcttcctctccccctcccataggacatccttcattctccaccataaagttttcaacaactccctcctctggatacg

SEQ ID NO: 62657 - DNA, 1023 bp, Homo sapiens
gagggagacaatactagctatatttcttgaaaaaaatgttagcgggctaggtaacagaaaacatcaaaataagacagactttccaaaccagtcaggctgtgttagataaatcccgtagctacaaaacttaaagcacaggagaatagcacagaatccagcccttctccaagacaaaatggagcaaaagggctgaaccatacatgttcagggctgtcttctaaactcaatctaccacactccctttcgggggaaagaagagtaaaagaacagggagcaattcaaatgaaacttcttccacctctgagagatggattaaattctccgttagcattttttgttttctttggcttcctttgtttcttcaaaccatagtcagccacaatgtgctgttttcatgaacgatactggccagcctggaagcacagacctgcttccaccttgatgaagctgcttcctgcatagcagacattgcttctgtggatggatcttcctgatgccacttcaatgcagtgttgattttgttacatggtcctgaaatgtgctaaaatggttcataagtatctcccagaccactctgcaccaaagactgaatgtcctgttttccacctacatgctgtcaaggtgcaccagccaataagctcatctcctcttcagtgggtcgaaaatgaatgttaaaggtgtgcctgttaaaactgaaagaccaaagaaattaaagttgaaaactaattttcttactcttgtggttagatgatttattgctcaagacttttaaaaacaaactctccaagcccctccccaaattccagtgttgtattttgcttagccttttcccgaaggattccccacgcagggttgttctgggttgggggtctgtcttcctgcagctgaagtcagacctgaattgcagggcaatgtgtgtcattcttttcaaattcagaagatgaaatcagtgagtctctgttcattctcaattttaagcaggacaaacaatgaaacaagaaggataacccaactggccctgta

SEQ ID NO: 62658 - DNA, 737 bp, Homo sapiens
gagggagacaatactagctatatttcttgaaaaaaatgttagcgggctaggtaacagaaaacatcaaaataagacagactttccaaaccagtcaggctgtgttagataaatcccgtagctacaaaacttaaagcacaggagaatagcacagaatccagcccttctccaagacaaaatggagcaaaagggctgaaccatacatgttcagggctgtcttctaaactcaatctaccacactccctttcgggggaaagaagagtaaaagaacagggagcaattcaaatgaaacttcttccacctctgagagatggattaaattctccgttagcattttttgttttctttggcttcctttgtttcttcaaaccatagtcagccacaatgtgctgttttcatgaacgatactggccagcctggaagcacagacctgcttccaccttgatgaagctgcttcctgcatagcagacattgcttctgtggatggatcttcctgatgccacttcaatgcagtgttgattttgttacatggtcctgaaatgtgctaaaatggttcataagtatctcccagaccactctgcaccaaagactgaatgtcctgttttccacctacatgctgtcaaggtgcaccagccaataagctcatctcctcttcagtgggtcgaaaatgaatgttaaaggtgtgcctgttaaaacgacaaggggggaaggtaagaataggaaagaaacaaaaaaaaaaa

SEQ ID NO: 62659 - DNA, 1654 bp, Homo sapiens
atcagcaagagatatgctgctgttagcatgttctcaggatggaacaaaaaaaatgggtaactcatttagtaaagaaaatccctaagaatccaccatctggttttgttcgtgcttcccctcgaacgctttctacaagatccactgcaaatcagtctttccggaaagtggtcaaaaatacatctggaaaaactagttaaccatgtgactgagtgccctgtggaatcgtgtgggatgctacctgataaaccaggcttctttaaccatgcagagcagacaggctgtttctttgacacaaatatcacaggcttcagggttaagattgctgtttttctgtccttgctttggcacaacacactgagggttttttttattgcgggtttgcctacaggtagattagattaattattactatgtaatgcaagtacagttgggggaaagcttaggtagatatattttttttaaaaggtgctgcctttttggatttataagaaaatgcctgtcagtcgtgatagaacagagttttcctcatatgagtaagaggaagggactttcactttcaagtggaacagccatcactatcaagatcagctcatggaaggagtaaagaaaatatctcaaaatgagacaaactgaagttttgttttttttttaatgacttaagtttttgtgctcttgcaagactatacaaaactattttaagaaagcagtgatatcacttgaacttcagtgccctcactgtagaatttaaaagccttactgttgattgcccatgttggacttgatggagaaattaaatatctttcattatgctttacaaaatactgtatatgtttcagcaagtttggggaatgggagaggacaaaaaaaagttacatttaatctatgcatttttgccaagccatattgagttattttactactagagacattaggaaactaactgtacaaaagaaccaagtttaaaagcattttgtggggtacatcatttctataattgtataatgtatttctttgtggttttaaatgataaagacattaagttaacaaacatataagaaatgtatgcactgtttgaaatgtaaattattcttagaacactttcaatgggggttgcattgtccttttagtgccttaatttgagataattattttactgccatgagtaagtatagaaatttcaaaaaatgtattttcaaaaaattatgtgtgtcagtgagtttttcattgataattggtttaatttaaaatatttagaggtttgttggactttcataaattgagtacaatctttgcatcaaactacctgctacaataatgactttataaaactgcaaaaaatgtagaaggttgcaccaacataaaaaggaaatatggcaatacatccatgatgttttccagttaacataggaattaccagataaatactgttaaactcttgtccagtaacaagagttgattcatatggacagtatgatttattgtttatttttttaaccaaatacctcctcagtaatttataatggctttgcagtaatgtgtatcagataagaagcactggaaaaccgatcgtctctaggatgatatgcatgtttcaagtggtattgaaagccgcactgatggatatgtaataataaacatatctgttattaatata

SEQ ID NO: 62660 - DNA, 1846 bp, Homo sapiens
atcagcaagagatatgctgctgttagcatgttctcaggatggaacaaaaaaaatgggtaactcatttagtaaagaaaatccctaagaatccaccatctggttttgttcgtgcttcccctcgaacgctttctacaagatccactgcaaatcagtctttccggaaagtggtcaaaaatacatctggaaaaactagttaaccatgtgactgagtgccctgtggaatcgtgtgggatgctacctgataaaccaggcttctttaaccatgcagagcagacaggctgtttctttgacacaaatatcacaggcttcagggttaagattgctgtttttctgtccttgctttggcacaacacactgagggttttttttattgcgggtttgcctacaggtagattagattaattattactatgtaatgcaagtacagttgggggaaagcttaggtagatatattttttttaaaaggtgctgcctttttggatttataagaaaatgcctgtcagtcgtgatagaacagagttttcctcatatgagtaagaggaagggactttcactttcaagtggaacagccatcactatcaagatcagctcatggaaggagtaaagaaaatatctcaaaatgagacaaactgaagttttgttttttttttaatgacttaagtttttgtgctcttgcaagactatacaaaactattttaagaaagcagtgatatcacttgaacttcagtgccctcactgtagaatttaaaagccttactgttgattgcccatgttggacttgatggagaaattaaatatctttcattatgctttacaaaatactgtatatgtttcagcaagtttggggaatgggagaggacaaaaaaaagttacatttaatctatgcatttttgccaagccatattgagttattttactactagagacattaggaaactaactgtacaaaagaaccaagtttaaaagcattttgtggggtacatcatttctataattgtataatgtatttctttgtggttttaaatgataaagacattaagttaacaaacatataagaaatgtatgcactgtttgaaatgtaaattattcttagaacactttcaatgggggttgcattgtccttttagtgccttaatttgagataattattttactgccatgagtaagtatagaaatttcaaaaaatgtattttcaaaaaattatgtgtgtcagtgagtttttcattgataattggtttaatttaaaatatttagaggtttgttggactttcataaattgagtacaatctttgcatcaaactacctgctacaataatgactttataaaactgcaaaaaatgtagaaggttgcaccaacataaaaaggaaatatggcaatacatccatgatgttttccagttaacataggaattaccagataaatactgttaaactcttgtccagtaacaagagttgattcatatggacagtatgatttattgtttatttttttaaccaaatacctcctcagtaatttataatggctttgcagtaatgtgtatcagataagaagcactggaaaaccgatcgtctctaggatgatatgcatgtttcaagtggtattgaaagccgcactgatggatatgtaataataaacatatctgttattaatatactaatgactctgtgctcatttaatgagaaataaaagtaatttatggatggatatctttaatttttactgcaatgtgttttctcatggctgaaatgaatggaaaacatacttcaaattagtctctgattgtatataaatgtttgtgaaattccatggttagattaaagtgtatttttaaaagataaaaaaagg

SEQ ID NO: 62661 - DNA, 1397 bp, Homo sapiens
atcagcaagagatatgctgctgttagcatgttctcaggatggaacaaaaaaaatgggtaactcatttagtaaagaaaatccctaagaatccaccatctggttttgttcgtgcttcccctcgaacgctttctacaagatccactgcaaatcagtctttccggaaagtggtcaaaaatacatctggaaaaactagttaaccatgtgactgagtgccctgtggaatcgtgtgggatgctacctgataaaccaggcttctttaaccatgcagagcagacaggctgtttctttgacacaaatatcacaggcttcagggttaagattgctgtttttctgtccttgctttggcacaacacactgagggttttttttattgcgggtttgcctacaggtagattagattaattattactatgtaatgcaagtacagttgggggaaagcttaggtagatatattttttttaaaaggtgctgcctttttggatttataagaaaatgcctgtcagtcgtgatagaacagagttttcctcatatgagtaagaggaagggactttcactttcaagtggaacagccatcactatcaagatcagctcatggaaggagtaaagaaaatatctcaaaatgagacaaactgaagttttgttttttttttaatgacttaagtttttgtgctcttgcaagactatacaaaactattttaagaaagcagtgatatcacttgaacttcagtgccctcactgtagaatttaaaagccttactgttgattgcccatgttggacttgatggagaaattaaatatctttcattatgctttacaaaatactgtatatgtttcagcaagtttggggaatgggagaggacaaaaaaaagttacatttaatctatgcatttttgccaagccatattgagttattttactactagagacattaggaaactaactgtacaaaagaaccaagtttaaaagcattttgtggggtacatcatttctataattgtataatgtatttctttgtggttttaaatgataaagacattaagttaacaaacatataagaaatgtatgcactgtttgaaatgtaaattattcttagaacactttcaatgggggttgcattgtccttttagtgccttaatttgagataattattttactgccatgagtaagtatagaaatttcaaaaaatgtattttcaaaaaattatgtgtgtcagtgagtttttcattgataattggtttaatttaaaatatttagaggtttgttggactttcataaattgagtacaatctttgcatcaaactacctgctacaataatgactttataaaactgcaaaaaatgtcgcatgatgcacttcaatttcaagtaaatatgcttttgcattgttcccgttttccg

SEQ ID NO: 62662 - DNA, 1799 bp, Homo sapiens
atcagcaagagatatgctgctgttagcatgttctcaggatggaacaaaaaaaatgggtaactcatttagtaaagaaaatccctaagaatccaccatctggttttgttcgtgcttcccctcgaacgctttctacaagatccactgcaaatcagtctttccggaaagtggtcaaaaatacatctggaaaaactagttaaccatgtgactgagtgccctgtggaatcgtgtgggatgctacctgataaaccaggcttctttaaccatgcagagcagacaggctgtttctttgacacaaatatcacaggcttcagggttaagattgctgtttttctgtccttgctttggcacaacacactgagggttttttttattgcgggtttgcctacaggtagattagattaattattactatgtaatgcaagtacagttgggggaaagcttaggtagatatattttttttaaaaggtgctgcctttttggatttataagaaaatgcctgtcagtcgtgatagaacagagttttcctcatatgagtaagaggaagggactttcactttcaagtggaacagccatcactatcaagatcagctcatggaaggagtaaagaaaatatctcaaaatgagacaaactgaagttttgttttttttttaatgacttaagtttttgtgctcttgcaagactatacaaaactattttaagaaagcagtgatatcacttgaacttcagtgccctcactgtagaatttaaaagccttactgttgattgcccatgttggacttgatggagaaattaaatatctttcattatgctttacaaaatactgtatatgtttcagcaagtttggggaatgggagaggacaaaaaaaagttacatttaatctatgcatttttgccaagccatattgagttattttactactagagacattaggaaactaactgtacaaaagaaccaagtttaaaagcattttgtggggtacatcatttctataattgtataatgtatttctttgtggttttaaatgataaagacattaagttaacaaacatataagaaatgtatgcactgtttgaaatgtaaattattcttagaacactttcaatgggggttgcattgtccttttagtgccttaatttgagataattattttactgccatgagtaagtatagaaatttcaaaaaatgtattttcaaaaaattatgtgtgtcagtgagtttttcattgataattggtttaatttaaaatatttagaggtttgttggactttcataaattgagtacaatctttgcatcaaactacctgctacaataatgactttataaaactgcaaaaaatgtagaaggttgcaccaacataaaaaggaaatatggcaatacatccatgatgttttccagttaacataggaattaccagataaatactgttaaactcttgtccagtaacaagagttgattcatatggacagtatgatttattgtttatttttttaaccaaatacctcctcagtaatttataatggctttgcagtaatgtgtatcagataagaagcactggaaaaccgatcgtctctaggatgatatgcatgtttcaagtggtattgaaagccgcactgatggatatgtaataataaacatatctgttattaatataaaaaaaaaaaaaaaaataaaaaaaaaaaaaaacaataaaaactaaaaatactatctatccctcttcctattctcctccctttttctccttctttttccctctcttcttactctccctctctttatactccattctcctactatcc

SEQ ID NO: 62663 - DNA, 524 bp, Homo sapiens
ggattccggcacgaggagttgttgttggttgggggccttttggccggtgacggagactgcccaggtgtggtcaccatgttcctctccgcggtcttctttgccaagagcaagtcaaaaaacattctggtgagaatggtgagcgaagctgggacaggtttctgcttcaacaccaagagaaaccgactgcgggaaaaactgactcttttgcattatgatccagttgtgaaacaaagagtcctcttcgtggaaaagaaaaaaatacgctccctttaaacggtggattgaaaatgactttgatttataaagagaagactgagggcggggatactgattcagaaatcctgtagcgtgtaataaaagaagaggaaatggcatggaatcactgcctcctgtgatttgaaggccattgtgaaggaaaacaatgcagtgaaagaaagttcttcatattaggacagatatcattgcatcacatttatttatctttctgggtatttttatagcccttaataaaaaatattaaaata

SEQ ID NO: 62664 - DNA, 371 bp, Homo sapiens
  misc_feature (3)..(3): n is a, c, g, or t
gcngccgcctactactactaaattcgcggccgcgtcgacccgcggtcttctttgccaagagcaagtcaaatgaaacaaagagtcctcttcgtggaaaagaaaaaaatacgctccctttaaacggtggattgaaaatgactttgatttataaagagaagactgagggcggggatactgattcagaaatcctgtagcgtgtaataaaagaagaggaaatggcatggaatcactgcctcctgtgatttgaaggccattgtgaaggaaaacaatgcagtgaaagaaagttcttcatattaggacagatatcattgcatcacatttatttatctttctgggtatttttatagcccttaataaaaaatattaaaata

SEQ ID NO: 62665 - DNA, 562 bp, Homo sapiens
tgaatatttcttcattggttgaatatgacttgtggcataccaaggatgctgctgattagctagtggccctatagccattttctccagtctgccctggctcctgggatggaggaactgagtttgcaaatcagctccatcttcatatcaaggaatagtaaaataagagaaaggtgagggcttatggtctgatatgtattttttataaaaatggcgatgatacttaataattttctgccacaatttttttttctccctccatagtgaaacaaagagtcctcttcgtggaaaagaaaaaaatacgctccctttaaacggtggattgaaaatgactttgatttataaagagaagactgagggcggggatactgattcagaaatcctgtagcgtgtaataaaagaagaggaaatggcatggaatcactgcctcctgtgatttgaaggccattgtgaaggaaaacaatgcagtgaaagaaagttcttcatattaggacagatatcattgcatcacatttatttatctttctgggtatttttatagcccttaataaaaaatattaaaata

SEQ ID NO: 62666 - DNA, 873 bp, Homo sapiens
gtcgagttttagggggccgtgagcagcagggccccgtaatgatgcgtggaaggatgtgcgaacaggacgggaagctgcagctgcgtacttttccaggccttcaggaccacagcgtccggccatgcgcccgcggcgcctccctgcgcggacctgtgggtgcctgagaaggggtctgcggtgtctggattcaattgccgtcctcacggaccgttgagtctggctgtggggcgtttttctccagcccgtgttaggagaatctttgtccgaaggacctcagaatttgcagcccacctatttcgaactctaaaaataaggaaaccgctcccgagaggggcaatgaattgcctgagtaatgcggcagggcagttaaagaagtcctcgggctcccgagtcagtgctcttctttacccttggctgacttcccagttagatttagtatctggttttcaccacatgtgatggttgttgtaatttgcaaaggttaaacttgtcaaacaagaagcttgctgcagcgcgaatacttgcaccttagaagagggaaaaaatggagcagttgccaagagcaagtcaaatgaaacaaagagtcctcttcgtggaaaagaaaaaaatacgctccctttaaacggtggattgaaaatgactttgatttataaagagaagactgagggcggggatactgattcagaaatcctgtagcgtgtaataaaagaagaggaaatggcatggaatcactgcctcctgtgatttgaaggccattgtgaaggaaaacaatgcagtgaaagaaagttcttcatattaggacagatatcattgcatcacatttatttatctttctgggtatttttatagcccttaataaaaaatattaaaata

SEQ ID NO: 62667 - DNA, 718 bp, Homo sapiens
  misc_feature (3)..(3): n is a, c, g, or t
gcngccgcctactactactaaattcgcggccgcgtcgacttggccggtgacggagactgcccaggtgtggtcaccatgttcctctccgcggtcttctttgccaagagcaagtcaaatgaaacaaagagtcctcttcgtggaaaagaaaaaaatacgctccctttaaacggtggattgaaaatgactttgatttataaagagaagactgagggcggggatactgattcagaaatcctgtagcgtgtaataaaagaagaggaaatggcatggaatcactgcctcctgtgatttgaaggccattgtgaaggaaaacaatgcagtgaaagaaagttcttcatattaggacagatatcattgcatcacatttatttatctttctgggtatttttatagcccttaataaaaaatattaaaataaacaaaaaaaaattgaataggcagcattgggtagttaggaaaatcgaaagaaggcttgaatatttgttaaggccatgaatgtttttgggtcaaggattgtcaagacctaggggtgggacaacaattgcttgacagaaacaaaatctttttgggccctttctgccaaacattttttaaacctggaacatttttttctggggccccaaaattgggcccttttgggccaaatgccccttaagggggcggattaaaaaaaaactgggcccggtttaccacggcctggggccctgggggtcccctt

SEQ ID NO: 62668 - DNA, 363 bp, Homo sapiens
gacgaggactctttgtttcatttgaaacgaagaggactcttctttgccaagagcaagtcaaatgaaacaaagagtcctcttcgtggaaaagaaaaaaatacgctccctttaaacggtggattgaaaatgactttgatttataaagagaagactgagggcggggatactgattcagaaatcctgtagcgtgtaataaaagaagaggaaatggcatggaatcactgcctcctgtgatttgaaggccattgtgaaggaaaacaatgcagtgaaagaaagttcttcatattaggacagatatcattgcatcacatttatttatctttctgggtatttttatagcccttaataaaaaatattaaaata

SEQ ID NO: 62669 - DNA, 340 bp, Homo sapiens
atctgccaggagggggcctcccgccagtatctgatgaagtgaaacaaagagtcctcttcgtggaaaagaaaaaaatacgctccctttaaacggtggattgaaaatgactttgatttataaagagaagactgagggcggggatactgattcagaaatcctgtagcgtgtaataaaagaagaggaaatggcatggaatcactgcctcctgtgatttgaaggccattgtgaaggaaaacaatgcagtgaaagaaagttcttcatattaggacagatatcattgcatcacatttatttatctttctgggtatttttatagcccttaataaaaaatattaaaata

SEQ ID NO: 62670 - DNA, 498 bp, Homo sapiens
  misc_feature (435)..(435): n is a, c, g, or t
  misc_feature (460)..(460): n is a, c, g, or t
  misc_feature (463)..(464): n is a, c, g, or t
  misc_feature (470)..(471): n is a, c, g, or t
  misc_feature (473)..(473): n is a, c, g, or t
  misc_feature (488)..(488): n is a, c, g, or t
  misc_feature (490)..(490): n is a, c, g, or t
  misc_feature (492)..(492): n is a, c, g, or t
gtgtaataaaagaagaggaaatggcatggaatcgctccctttaaacggtggattgaaaatgactttgatttataaagagaagactgagggcggggatactgattcagaaatcctgtagcgtgtaataaaagaagaggaaatggcatggaatcactgcctcctgtgatttgaaggccattgtgaaggaaaacaatgcagtgaaagaaagttcttcatattaggacagatatcattgcatcacatttatttatctttctgggtatttttatagcccttaataaaaaatattaaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanaaaaaaaaaacaaaacggggggggngcnngccacnncnccggggggggccgcncncncccacc

SEQ ID NO: 62671 - DNA, 544 bp, Homo sapiens
ggattccggcacgaggagttgttgttggttgggggccttttggccggtgacggagactgcccaggtgtggtcaccatgttcctctccgcggtcttctttgccaagagcaagtcaaaaaacattctggtgagaatggtgagcgaagctgggacaggtttctgcttcaacaccaagagaaaccgactgcgggaaaaactgactcttttgcattatgatccagttgtgaaacaaagagtcctcttcgtggaaaagaaaaaaatacgctccctttaaacggtggattgaaaatgactttgatttataaagagaagactgagggcggggatactgattcagaaatcctgtagcgtgtaataaaagaagaggaaatggcatggaatcactgcctcctgtgatttgaaggccattgtgaaggaaaacaatgcagtgaaagaaagttcttcatattaggacagatatcattgcatcacatttatttatctttctgggtatttttatagcccttaataaaaaatattaaaataagcctgtgctattgtgtctt

SEQ ID NO: 62672 - DNA, 400 bp, Homo sapiens
gatggctcatcttgactttttccttacttacaaatggagagccccaaagtccaaatccttggaccagctatcccccaacttcctccttaggggcagaagtgaaacaaagagtcctcttcgtggaaaagaaaaaaatacgctccctttaaacggtggattgaaaatgactttgatttataaagagaagactgagggcggggatactgattcagaaatcctgtagcgtgtaataaaagaagaggaaatggcatggaatcactgcctcctgtgatttgaaggccattgtgaaggaaaacaatgcagtgaaagaaagttcttcatattaggacagatatcattgcatcacatttatttatctttctgggtatttttatagcccttaataaaaaatattaaaata

SEQ ID NO: 62673 - DNA, 470 bp, Homo sapiens
ggattccggcacgaggagttgttgttggttgggggccttttggccggtgacggagactgcccaggtgtggtcaccatgttcctctccgcggtcttctttgccaagagcaagtcaaaaaacattctggtgagaatggtgagcgaagctgggacaggtttctgcttcaacaccaagagaaaccgactgcgggaaaaactgactcttttgcattatgatccagttgtgaaacaaagagtcctcttcgtggaaaagaaaaaaatacgctccctttaaacggtggattgaaaatgactttgatttataaagagaagactgagggcggggatactgattcagaaatcctgtagcgtgtaataaaagaagaggaaatggcatggaatcactgcctcctgtgatttgaaggccattgtgaaggaatttatttatctttctgggtatttttatagcccttaataaaaaatattaaaata

SEQ ID NO: 62674 - DNA, 520 bp, Homo sapiens
  misc_feature (457)..(457): n is a, c, g, or t
  misc_feature (482)..(482): n is a, c, g, or t
  misc_feature (485)..(486): n is a, c, g, or t
  misc_feature (492)..(493): n is a, c, g, or t
  misc_feature (495)..(495): n is a, c, g, or t
  misc_feature (510)..(510): n is a, c, g, or t
  misc_feature (512)..(512): n is a, c, g, or t
  misc_feature (514)..(514): n is a, c, g, or t
ggattccggcacgaggagttgttgttggttgggggccttttggccggtgacggagactgcccaggtgtggtcaccatgttcctcttgaaacaaagagtcctcttcgtggaaaagaaaaaaatacgctccctttaaacggtggattgaaaatgactttgatttataaagagaagactgagggcggggatactgattcagaaatcctgtagcgtgtaataaaagaagaggaaatggcatggaatcactgcctcctgtgatttgaaggccattgtgaaggaaaacaatgcagtgaaagaaagttcttcatattaggacagatatcattgcatcacatttatttatctttctgggtatttttatagcccttaataaaaaatattaaaataaaaaaaaaaaaaaaaaaaaaaaaaaaaaaaaaaaaaaaaaaaaaaaaaaaaaaaaaaaaaaaaaaaaaaanaaaaaaaaaacaaaacggggggggngcnngccacnncnccggggggggccgcncncncccacc

SEQ ID NO: 62675 - DNA, 658 bp, Homo sapiens
  misc_feature (595)..(595): n is a, c, g, or t
  misc_feature (620)..(620): n is a, c, g, or t
  misc_feature (623)..(624): n is a, c, g, or t
  misc_feature (630)..(631): n is a, c, g, or t
  misc_feature (633)..(633): n is a, c, g, or t
  misc_feature (648)..(648): n is a, c, g, or t
  misc_feature (650)..(650): n is a, c, g, or t
  misc_feature (652)..(652): n is a, c, g, or t
ggattccggcacgaggagttgttgttggttgggggccttttggccggtgacggagactgcccaggtgtggtcaccatgttcctctccgcggtcttctttgccaagagcaagtcaaaaaacattctggtgagaatggtgagcgaagctgggacaggtttctgcttcaacaccaagagaaaccgactgcgggaaaaactgactcttttgcattatgatccagttgtgaaacaaagagtcctcttcgtggaaaagaaaaaaatacgctccctttaaacggtggattgaaaatgactttgatttataaagagaagactgagggcggggatactgattcagaaatcctgtagcgtgtaataaaagaagaggaaatggcatggaatcactgcctcctgtgatttgaaggccattgtgaaggaaaacaatgcagtgaaagaaagttcttcatattaggacagatatcattgcatcacatttatttatctttctgggtatttttatagcccttaataaaaaatattaaaataaaaaaaaaaaaaaaaaaaaaaaaaaaaaaaaaaaaaaaaaaaaaaaaaaaaaaaaaaaaaaaaaaaaaaanaaaaaaaaaacaaaacggggggggngcnngccacnncnccggggggggccgcncncncccacc

SEQ ID NO: 62676 - DNA, 417 bp, Homo sapiens
ggattccggcacgaggagttgttgttggttgggggccttttggccggtgacggagactgcccaggtgtggtcaccatgttcctctccgcggtcttctttgccaagagcaagtcaaatgaaacaaagagtcctcttcgtggaaaagaaaaaaatacgctccctttaaacggtggattgaaaatgactttgatttataaagagaagactgagggcggggatactgattcagaaatcctgtagcgtgtaataaaagaagaggaaatggcatggaatcactgcctcctgtgatttgaaggccattgtgaaggaaaacaatgcagtgaaagaaagttcttcatattaggacagatatcattgcatcacatttatttatctttctgggtatttttatagcccttaataaaaaatattaaaata

SEQ ID NO: 62677 - DNA, 551 bp, Homo sapiens
  misc_feature (488)..(488): n is a, c, g, or t
  misc_feature (513)..(513): n is a, c, g, or t
  misc_feature (516)..(517): n is a, c, g, or t
  misc_feature (523)..(524): n is a, c, g, or t
  misc_feature (526)..(526): n is a, c, g, or t
  misc_feature (541)..(541): n is a, c, g, or t
  misc_feature (543)..(543): n is a, c, g, or t
  misc_feature (545)..(545): n is a, c, g, or t
ggattccggcacgaggagttgttgttggttgggggccttttggccggtgacggagactgcccaggtgtggtcaccatgttcctctccgcggtcttctttgccaagagcaagtcaaatgaaacaaagagtcctcttcgtggaaaagaaaaaaatacgctccctttaaacggtggattgaaaatgactttgatttataaagagaagactgagggcggggatactgattcagaaatcctgtagcgtgtaataaaagaagaggaaatggcatggaatcactgcctcctgtgatttgaaggccattgtgaaggaaaacaatgcagtgaaagaaagttcttcatattaggacagatatcattgcatcacatttatttatctttctgggtatttttatagcccttaataaaaaatattaaaataaaaaaaaaaaaaaaaaaaaaaaaaaaaaaaaaaaaaaaaaaaaaaaaaaaaaaaaaaaaaaaaaaaaaaanaaaaaaaaaacaaaacggggggggngcnngccacnncnccggggggggccgcncncncccacc

SEQ ID NO: 62678 - DNA, 470 bp, Homo sapiens
ggattccggcacgaggagttgttgttggttgggggccttttggccggtgacggagactgcccaggtgtggtcaccatgttcctctccgcggtcttctttgccaagagcaagtcaaatgaaacaaagagtcctcttcgtggaaaagaaaaaaatacgctccctttaaacggtggattgaaaatgactttgatttataaagagaagactgagggcggggatactgattcagaaatcctgtagcgtgtaataaaagaagaggaaatggcatggaatcactgcctcctgtgatttgaaggccattgtgaaggaaaacaatgcagtgaaagaaagttcttcatattaggacagatatcattgcatcacatttatttatctttctgggtatttttatagcccttaataaaaaatattaaaatatgagcaacaaaaacaaatgtaaaaaaacaatctcgagggggggcccgggaccc

SEQ ID NO: 62679 - DNA, 321 bp, Homo sapiens
agctcatcagctatcatttgtgttagtgtattttatgtatggcccaagacaattcttctttttccagtgtggcccagggaagccaaaagattggatacccctgacaggattccaggattcttttgtaatttctcagaggccctctgtgcatactccgtaaggactatccacattctttattactttcattggcaataggtataaaattttatttgttggatattttactgaaatgttacttgtttttgcttatttactgattggtgggaggaagtcaaaggatgaataaatctaacctttttaaaagaaaaggctaaaata

SEQ ID NO: 62680 - DNA, 695 bp, Homo sapiens
agtgagagagaaggcagtctagaatgatgcccagatttctttcttgaagcagtgggttggtggaacaggaacagtagtaagagtgggagcatatgaggagtttgttctgatacgtatttagttggaaatgtctgtggggccttgtacctgactaaggccttttcctcagtcagatgcttgttcaagattctctccctgaactgttttgttattaaccatcctcctccatgccttcccagtttctcagggctggccctttgattggaatatataaatggccactcttgaaattgtggctgctatcctcccctttctctctatcttcattctgcaaccccagaaccagccttagtttctgtcttggccaccaaaagaatcttaagtctcagtccacaaagggaagagaagaaataggctgcctgtttttccgagcaccgttgaagtaccaggcaagggcttttgatacagagtccttagtaccatgaatttcctccagtagaaatcactttagagaagagctaatccctccatttatcccttattttatagataagaaaacagaattcttaagaagggaagaggatgtattcactcagtattaaatgttattttctttgctttatccaggttctatgtcaatgggcccaggattctgaaacatagtccatgttgtcataaaggccacagcctagttg

SEQ ID NO: 62681 - DNA, 616 bp, Homo sapiens
ggatctgctataggtagtatcttagcctgttctgaccctagggagaatcagactcctttggtctatgacagtaatagaagttatttctttagataaattttgtttaaggctttaaattaattctatcttggcattgtgtggttctagattcattcattcatttaacaaaacttacttgagtatccgctctctgccaagcacagtggtaaatgatgagtattacattaactccaatcaatccaatattcttctgtagtaagaacatctggcccagttaccctgctgtcctctgcgttgcacacaccccccgccaggctcatccctgtatcctccttggaggaaagtgccaggctggtgctacttggccctgcctgggtcacacgcctgcctcgggatgtggaggatggtcagcccagccacagcacatggattgctatgtgaaggatgatgttccacaagaaaaccaggacggcttcaccagggaggcaagagcagcagatgcccatgacagagggtgtatactctgaataaaagaatttggaattgctggatcatatggtaattctgcatttaactttttaaggaactggcaaactggtttccacagagctgtaac

SEQ ID NO: 62682 - DNA, 1529 bp, Homo sapiens
taatgttctattgtgtgcatatgccacatttggtttatccattcatcagttgatgcacatttcggttgttcccacctttgggctattatgaataatgttgctgtgaacactggtatacaaatatctgagtggaattgctggatcatatggtaattctgcatttaactttttaaggaactgccaaactgttttccacagagctgtaacattttacatccaaaccagcaataggacctggataaaaggtggctaaggcacagttaaataaaatactgttagttactgcccatttgcattgggtttctagtggcaaataatctagccgtgtccttgactggatctcccaatgattcttttcagtcatttgaatgagtatggtggtggtgacactggcaggaggctggagggtactttaattaacacgcgaacacacacaaatccattgcaccccactaagccgcccaaacacacatgaaacacaaaaactatccttgctagggaaacacagccctggaacaaaccccctggaccccttgtcaccaccagcccatcctgtaagaaaatgatggttgaagctgcagtgacagaattggagagatgctctgttagacaagtctgtcagctgaaaggggcagaaaccattgttgaactgcttatatgagaggaagacctgggtggcacaggcctggctggacgcagggctcacagagcgtcatcagcacttcatctcttcccctgcgggacctgctgtcctctgcgttgcacacaccccccgccaggctcatccctgtatcctccttggaggaaagtgccaggctggtgctacttggccctgcctgggtcacacgcctgcctcgggatgtggaggatggtcagcccagccacagcacatggattgctatgtgaaggatgatgttccacaagaaaaccaggacggcttcaccagggaggcaagagcagcagatgcccatgacagagggtgtatactctgaataaaagaatttggatttttaaaaagagacaggaagaaaaggacttccaaactctagaaagtttaaaactagtagaatgaaacatattgtgtataaatgtaaagctctttgttgagattaaatatacgtatcagttaaattttatttaaacatatatatacacatatacacacacacacatacatatatatgacccaagtacaggataaagatgaaattaataagtactctttaaaaatcttagttttggggctgggcgcggtggctcacgcctctaatccaagcactttgggaggccaaggcgggcggatcacctgagatcggtagttcgagaccagcctgaccaacgtggagaaaccctgtctctactaaaaatacaaagaattagccggacgtggtggcgcatgcctgtaatcccagctactcgggaggctgaggcaggagaatcgcttgaacccgggaggcggagatcgcagtgagccaagatggtgccatgtcactccagcctaggcaacaagagcaaaactccatctcaaa

SEQ ID NO: 62683 - DNA, 1497 bp, Homo sapiens
atggataaaccaaatgtggcatatgcacaccatggaacattactccacctgctgtggagttcacgctgctgtgaacactggtatacaaatatctgagtggaattgctggatcatatggtaattctgcatttaactttttaaggaactgccaaactgttttccacagagctgtaacattttacatccaaaccagcaataggacctggataaaaggtggctaaggcacagttaaataaaatactgttagttactgcccatttgcattgggtttctagtggcaaataatctagccgtgtccttgactggatctcccaatgattcttttcagtcatttgaatgagtatggtggtggtgacactggcaggaggctggagggtactttaattaacacgcgaacacacacaaatccattgcaccccactaagccgcccaaacacacatgaaacacaaaaactatccttgctagggaaacacagccctggaacaaaccccctggaccccttgtcaccaccagcccatcctgtaagaaaatgatggttgaagctgcagtgacagaattggagagatgctctgttagacaagtctgtcagctgaaaggggcagaaaccattgttgaactgcttatatgagaggaagacctgggtggcacaggcctggctggacgcagggctcacagagcgtcatcagcacttcatctcttcccctgcgggacctgctgtcctctgcgttgcacacaccccccgccaggctcatccctgtatcctccttggaggaaagtgccaggctggtgctacttggccctgcctgggtcacacgcctgcctcgggatgtggaggatggtcagcccagccacagcacatggattgctatgtgaaggatgatgttccacaagaaaaccaggacggcttcaccagggaggcaagagcagcagatgcccatgacagagggtgtatactctgaataaaagaatttggatttttaaaaagagacaggaagaaaaggacttccaaactctagaaagtttaaaactagtagaatgaaacatattgtgtataaatgtaaagctctttgttgagattaaatatacgtatcagttaaattttatttaaacatatatatacacatatacacacacacacatacatatatatgacccaagtacaggataaagatgaaattaataagtactctttaaaaatcttagttttggggctgggcgcggtggctcacgcctctaatccaagcactttgggaggccaaggcgggcggatcacctgagatcggtagttcgagaccagcctgaccaacgtggagaaaccctgtctctactaaaaatacaaagaattagccggacgtggtggcgcatgcctgtaatcccagctactcgggaggctgaggcaggagaatcgcttgaacccgggaggcggagatcgcagtgagccaagatggtgccatgtcactccagcctaggcaacaagagcaaaactccatctcaaa

SEQ ID NO: 62684 - DNA, 229 bp, Homo sapiens
ctttcaatctgtcaagaaagcttgttggttgtaccttcaaaatagaacagagtgggcaacatagcgagaccctgtctctacaaaaaaaaaaaaaaaaaattaccctggtgtgttggcgtgtacctatagttccaggtactctggaggctgaggccaggagttacgttacagtgagccatcatcaggccactgcactccagcttgggctggacagagtgacacgtgttcc

SEQ ID NO: 62685 - DNA, 400 bp, Homo sapiens
ccttgttgcttttcccttctttgtggccccacatgttctagcctaggaatctgcttattctaaaggccatttggcgtaattattttttgaccccaacatcctttagcaattatttgtctgtaaaaatcacccttccctgtattcactatttttatttattatggataaagagatagtgtggtggctcacatctataatcccaaagtgctgggattgcaggcgtgacgactgtgcctggcggaagtgcccccttctatctaaggccaaggcaggcggatcacaaggtcaggagatccagaccatcctggctaacacagtgaaaccccgtctctattaaaaatacaaaaaaattagccgggtgtggtggcgggcgctgtagtcccagctactcgagaggctg

SEQ ID NO: 62686 - DNA, 406 bp, Homo sapiens
gccctgttatagggtacagtgggagccaaaagcatcatttaggtctcatatttgcgaaaccttttaagcctgaatgtaataatgaagaagtaatcagacacatccagatggtggggtactctataaaacaggtgctctgtaatcttcaaaaatgccagtatcttaagaagtgaaggaaggctgagaaatttttccagatgataggagactaaggacacgtaacaacaaaacacaatatgagatcccagtttgcatcctggattagaggaaagaaccttattgtgagctactcggcagactgaggcaggagaatcgctcgaaccctggaggcggaggttgcagtgagtgatatgtatatatatcactacaacctcgaactcctggctccttaacgtaccaggctcaa

SEQ ID NO: 62687 - DNA, 2926 bp, Homo sapiens
aagtaattgtccgtgtcaggaaggtaggcgtgccaagccgcggctctgcggagaaaccacgaccaccgcggccgccggaaacccaaagcgctccagagcgtccccgggtggccgggcagcaccagggacagcgcccgggactccactggggaccggctcctgggcttcccagcgtcgcgggtagaggtacagctgctccgtgtgccgcaggctccagattctcgccaccccacccctccctcagaaactcggactgctctcgtctgccgtgtggttctcttttcttccgaaaggccagtgtcttatctctccacttcaagtccagaggacttgctcagtctcctccccttaagtcatttccaccatcctcaggcagctgtgggaagccgagagtcctggactgttcgtccgggtgccagcgctggcagtcccagtccgtccggtgcagcagcccggcgcattcccctctctccctccctcttgctctccctccctttctgtcttcctctctttcctcctctactgctccctccctctcttgcctcttaagtttcctgcaccgtgaatccaactgtgccaagccttggctcccgcgaaccaatcctgagcgcgacccgggcactgggacggcgactccgccaaagctggacgaggcagccggacccgtctgcgctcgagcatggagacggagcgcctgggagggcacgtccggggcgctggagacgccaggcccgagtagcttctccatggagcctgcccagagcggtcccttctcgcaggattcgccccaagtcctgtgcggctgctgagagcgctccttgctctgtaaagtggatgtcaggtggatctatgtttctgaaggaacaaagactcaaagaaggcaccgccaaggaagtttgagacgcgggagaatgcaggctgcgtgctggtacgtgcttttcctcctgcagcccaccgtctacttggtcacatgtgccaatttaacgaacggtggaaagtcagaacttctgaaatcaggaagcagcaaatccacactaaagcacatatggacagaaagcagcaaagacttgtctatcagccgactcctgtcacagacttttcgtggcaaagagaatgatacagatttggacctgagatatgacaccccagaaccttattctgagcaagacctctgggactggctgaggaactccacagaccttcaagagcctcggcccagggccaagagaaggcccattgttaaaacgggcaagtttaagaaaatgtttggatggggcgattttcattccaacatcaaaacagtgaagctgaacctgttgataactgggaaaattgtagatcatggcaatgggacatttagtgtttatttcaggcataattcaactggtcaagggaatgtatctgtcagcttggtaccccctacaaaaatcgtggaatttgacttggcacaacaaaccgtgattgatgccaaagattccaagtcttttaattgtcgcattgaatatgaaaaggttgacaaggctaccaagaacacactctgcaactatgacccttcaaaaacctgttaccaggagcaaacccaaagtcatgtatcctggctctgctccaagccctttaaggtgatctgtatttacatttccttttatagtacagattataaactggtacagaaagtgtgccctgactacaactaccacagtgacacaccttactttccctcgggatgaaggtgaacatgggggtgagactgaagcctgaggaattaaaggtcatatgacagggctgttacctcaaagaagaaggtcacatctgttgcctggaatgtgtctacactgctgctcttgtcaactggctgcaaaatacactagtggaaaacactctgatgtaatttctgcccagtcagcttcatccctcagtataattgtaaatcatcacagattttgaagtcacacctgaagacatgctctcacatatagaggtacacaaacacaccgtcatgcacatttcagcttgcgtctatcatgattcctgttgagagggctttcattgtctgactcataatggttcaggatcaactatcatcaaacggaaggattaactagacagagaatgtttctaacagttgctgttatggaaatctcttttaaagtcttgagtacatgctaatcaataatctccactcatgcattcctactgcttggagtagctgtactggtaaatactactgtaggagtatctgcttgttaaaatggaaaaatgtgtctttagagctcagtattctttattttacaaacacaacaaaatgtagtaacttttttccagcatacagtaggcacattcaaagtggtccaagatggctcttttttctttgaaaggggcctgttctcagtaaagatgagcaaacatttggaatttacatgtgggcagacattgggataacaactttcatcaccaatcattggacttttgtgaagtcgacaccagctaaggctgcttaaaataagttctgatcattatataagaagggaaatgcctggcagacaccatgtaagttataagtgtctgtcttatctttactacacatattgtaacaaattcaatatcctagtcttcatttgtatgaatggtttgtattgtacatagtttaaccaagtgttatttgagctgcttattaatattaacttgtacttgtctctctgcttgttattggttaagaaaaaaggatatgaggaattcattttatcaatgtagctgtgaaggccattaaaaagacaaacttaatgtacagagcatttattcagatcaagtattgttgaaagctatacatatacaacattacagtctgtctgtatttagatattttatttctggaaaaaatgaaatgtacataaaaataaaacacttaaagttgagtttcaatatgtac

SEQ ID NO: 62688 - DNA, 2021 bp, Homo sapiens
  misc_feature (51)..(51): n is a, c, g, or t
ggaagcagcagaaagtctattaataaatgggatatacatgctttgcatganagaaatttggtcacatgtgccaatttaacgaacggtggaaagtcagaacttctgaaatcaggaagcagcaaatccacactaaagcacatatggacagaaagcagcaaagacttgtctatcagccgactcctgtcacagacttttcgtggcaaagagaatgatacagatttggacctgagatatgacaccccagaaccttattctgagcaagacctctgggactggctgaggaactccacagaccttcaagagcctcggcccagggccaagagaaggcccattgttaaaacgggcaagtttaagaaaatgtttggatggggcgattttcattccaacatcaaaacagtgaagctgaacctgttgataactgggaaaattgtagatcatggcaatgggacatttagtgtttatttcaggcataattcaactggtcaagggaatgtatctgtcagcttggtaccccctacaaaaatcgtggaatttgacttggcacaacaaaccgtgattgatgccaaagattccaagtcttttaattgtcgcattgaatatgaaaaggttgacaaggctaccaagaacacactctgcaactatgacccttcaaaaacctgttaccaggagcaaacccaaagtcatgtatcctggctctgctccaagccctttaaggtgatctgtatttacatttccttttatagtacagattataaactggtacagaaagtgtgccctgactacaactaccacagtgacacaccttactttccctcgggatgaaggtgaacatgggggtgagactgaagcctgaggaattaaaggtcatatgacagggctgttacctcaaagaagaaggtcacatctgttgcctggaatgtgtctacactgctgctcttgtcaactggctgcaaaatacactagtggaaaacactctgatgtaatttctgcccagtcagcttcatccctcagtataattgtaaatcatcacagattttgaagtcacacctgaagacatgctctcacatatagaggtacacaaacacaccgtcatgcacatttcagcttgcgtctatcatgattcctgttgagagggctttcattgtctgactcataatggttcaggatcaactatcatcaaacggaaggattaactagacagagaatgtttctaacagttgctgttatggaaatctcttttaaagtcttgagtacatgctaatcaataatctccactcatgcattcctactgcttggagtagctgtactggtaaatactactgtaggagtatctgcttgttaaaatggaaaaatgtgtctttagagctcagtattctttattttacaaacacaacaaaatgtagtaacttttttccagcatacagtaggcacattcaaagtggtccaagatggctcttttttctttgaaaggggcctgttctcagtaaagatgagcaaacatttggaatttacatgtgggcagacattgggataacaactttcatcaccaatcattggacttttgtgaagtcgacaccagctaaggctgcttaaaataagttctgatcattatataagaagggaaatgcctggcagacaccatgtaagttataagtgtctgtcttatctttactacacatattgtaacaaattcaatatcctagtcttcatttgtatgaatggtttgtattgtacatagtttaaccaagtgttatttgagctgcttattaatattaacttgtacttgtctctctgcttgttattggttaagaaaaaaggatatgaggaattcattttatcaatgtagctgtgaaggccattaaaaagacaaacttaatgtacagagcatttattcagatcaagtattgttgaaagctatacatatacaacattacagtctgtctgtatttagatattttatttctggaaaaaatgaaatgtacataaaaataaaacacttaaagttgagtttcaatatgtac

SEQ ID NO: 62689 - DNA, 564 bp, Homo sapiens
cattggtcaccaagcccatcagttctttgttggaaatgtctctcaaatctgtttcccctctccatccatattattgttgtctctcttcaggcccatgccattctgtcttgatctgtttagagtaatcacatactaaaatgcttccttgtacttttctccaagccattctccataagaaatttttttggcttattgaagtttagacagtgcatgagtgcaggcatcatgcatttcaagtgatagggaaatagcctagaacaggtatttttgagtaccttgaattgagatttagtttggttaagtttggccatggggattgggatttagggattgttaacatagggaggtaataaaacattgagaaacagaagacaggctttttgaaaaaaatagcaaaaaattggagacttagctttgaaagagatacttacccttatacaatttagtgaagcctcaaagaacagaccagcactttgggaggccgaggtcagagagtcacttgaggccaggagtcaacatagctcctgtgaccagcctggtcaacatagagactctatctctacc

SEQ ID NO: 62690 - DNA, 324 bp, Homo sapiens
tgttggattgttctaatttcaaaacagagaaagttttgaactcctgctttcatggttcattcttagaaataaatagaattgttttcccaagaaaaccttggaaaactttctagtaatagcaggaggaatatgggagtaggaaatggcaagttgaaggattttaatttggaaactgccaccttttggaatacagaagagctggttatgggattggcccctggctttacttgtccttaacatgggctttgataaggggaaaacaaagtgagggcttcgagccacaagtcaaggtcttgggaaagcttagcaaaatggtgcaagtct

SEQ ID NO: 62691 - DNA, 286 bp, Homo sapiens
tatttgatagaattttctagtgaaaccatcctgacttggggttttattttggaggaattttaagttattaattccgtctccttaatagtgataggactattcagattaccttatttcatatttggtgagttttggtagcttgtgtttctcaaggaagtgatccatttcatctaagttgccaaatttatgtgtgtataataatttgtagtattcctgtattatccttttgatgtctgtagggtctctagtgatatcctatgttttattcctgatattagttatttgt

SEQ ID NO: 62692 - DNA, 367 bp, Homo sapiens
gatattacacatcccccatgtagcttctggaaaactccactgtacacttgtgggagaatgacaatgagaaaatcaagtaacattattacggaaatagttttgactttgtaaaattctcctgaaaaattactggggatccctaggatttcctggctcatactttgagaatcgctagtctagcagagtagtccctggtattctgaagggattagtttaggacaaccctccttccccataccaaaatctagatgctcaagctccttttataaaatgacacagtatttgtatataacctacccatatcctcctttaaacctctagtcatctcttgattacttttacctaataaatgtaaatgctatgtaaa

SEQ ID NO: 62693 - DNA, 1746 bp, Homo sapiens
  misc_feature (482)..(482): n is a, c, g, or t
  misc_feature (745)..(745): n is a, c, g, or t
  misc_feature (895)..(895): n is a, c, g, or t
  misc_feature (1741)..(1741): n is a, c, g, or t
  misc_feature (1743)..(1744): n is a, c, g, or t
  misc_feature (1746)..(1746): n is a, c, g, or t
gaggggtctgcggtgtcccagtcagtgcagaggagttcaggacaccggttcgatgcctctgaaggaacagccatcatcatccctggaaacatagattgttggttggtagagcttattgctaaatttgaagagtgtgcatcagacactaaagctggtcctttcgtgaagtggggtttggaggctgcacattgccagaaagaacctggcttgcatcccttccctcttcgtcactccctggcttttggagcctcttcattaggcttgcttgtgaagtgtgtccctgtgctcgggttctctttctggatctcagtccccctcagattgtctggtccttactgtgatcttcacacctgactccgttttctgagtcctgctacctagttccagctccaagtctcaagttcccatgcaggcctcaggcacacacagacacatgttcacttttgggaagattccaccctgcctctgtggcagctgtgctntgaggccgttgagaagccatgcactatgtcagcagcgttcttttcccccagactctcagaccctgtgtgcccctctctgcaccgtgaccctgtttgtgggaccccgctttggctgttttgtctctttgttctcttctcttcctcttgaaaagtggactcccctggagctgttcttgactgttgtgtgatgttgtctacattcccttttgtgttttattcactaacttcaaattcctgatcatctgcctgcagaccacgcatanagcttctcctagtcagcctcactggcatccccaaacactccatttgcctggccaacctccagctccacctttctgtgatttccctgctcctgtgaatggtatcaccagccatctagttagccgctgccattgtcagccatccccttcctnccacccctggtggttctggcttcacgtacccttcccacccctctttaatatctcagagttctgcgctaatctggaccctcatgctgctggagggtacgcatggctgcactggtcactcagcggcccagctatctccatagaatggcctaatgcccatgtctaaatcatgttactctcatgctcagccaatcctcagaccttcaaggggtgctcacaggttgcaaaaggaagcccaaacatttcaaagtattggccatgccccatattccccgtcctaatctacttgtagctgcaccaaacccttcaccttatacagcctccctctggtcctggggactgtctcttaatgttgccccttttgtgtcctttgcttgtgtgagttcttctctctgggacactcaactcttctgaccaaatcccagttcaaacacagtctccttcaggaagcctttcttggtctctgaagagatccttctttccctgggcttccccagcccacccgctaagttgagtatcctagaggcacttgccccggcctctagctgcccaggagtgatttgtgttcttagaagcctcatcttcctttcaactctaagtccattgagtcaagaaccttgtcttcttaatgtatgtatctttcatttactgtatgaacttgctttactatggtaagccctgacaaatgattgatttcatcttgttggaagaaagacggcctggcttccatgaggggagttttatatgtcttacgtactctgcaaaaatccttattgagagttttctcctattttaaatcagactccaatttgtggattaaaattaggtgacatgaaagaattacaaaanannan

SEQ ID NO: 62694 - DNA, 185 bp, Homo sapiens
ctatgaagattaagttaataaatgtagaacatcttaccacattgctgatacctggtttcattattagtaactattatcctgtctcatttttcaaaagaatttaagaaaggcactatcaaaaactgcagacagccaagatcgatgacctcggaaataacttcagttgcccttttgcaattgggaag

SEQ ID NO: 62695 - DNA, 783 bp, Homo sapiens
gccaatcggaactcatggcggggctgctgggtcttccaggagcgcgcatgagcggacgctgcctatgggttgccgggcgagatgtaaccggctgctgagctggcagttctgtgtcgctaggcttctgcccggccgccgccacacataagctgcgatgaggagctttacgacttcccggtcttcggggccgggcgcagcaagggccagactctgcgctagcaggcgctgcgcgccaaccggccggcacctgtcgcagaaggtgcaaccgatcgcactgtcgcgcagaagctcctcaatggccagcaccagctgcagccccggccgcccactcgcctcacttgagcctgtctggcagcctgctatcaattatattgatagtaaatttgaggactacctaaatgcagaatcgcgagtgaacagatgtcagatgcctggtaacagggtgcagtgttgtttatacttcattgctccttcaggacatggactcccaccttcaggcaggattgggtagtacatgtttgtaactacctggcattgccttttgttgaggtggcagacaagaaacatggattattgcgtggagttccattagtaggaataagactcattctacattcttgttgttcttagtgttttttgtttttcatgagaaggaattgtatcagcacaaggcaatattctaacatgacaatgacagcagacagaacctcaataaactctgacttggtactgcaaaaaccatttcatgataccttaattcaaataaacctttgtttaatcaat

SEQ ID NO: 62696 - DNA, 745 bp, Homo sapiens
gccaatcggaactcatggcggggctgctgggtcttccaggagcgcgcatgagcggacgctgcctatgggttgccgggcgagatgtaaccggctgctgagctggcagttctgtgtcgctaggcttctgcccggccgccgccacacataagctgcgatgaggagctttacgacttcccggtcttcggggccgggcgcagcaagggccagactctgcgctagcaggcgctgcgcgccaaccggccggcacctgtcgcagaaggtgcaaccgatcgcactgtcgcgcagaagctcctcaatggccagcaccagctgcagccccggccgcccactcgcctcacttgagcctgtctggcagcctgctatcaattatattgatagtaaatttgaggactacctaaatgcagaatcgcgagtgaacagatgtcagatgcctggtaacagggtgcagtgttgtttatacttcattgctccttcaggacatggggccagacccaaaggctcaatgtgaaagttcctggactcagaggtgtcacgtaagaaagtgagtggaaacttgggagtatggctgtcccatgaagagctcaccctctggaaaacagaaaagggtcctaatcttggaggtttgacactcatcataatgtgggaatgacagctagaaaaaaacggtgaactccaggaaggcttgaaggcattggagcaaggccagcagcctctccctcccaccatcacttccatgagaaccacg

SEQ ID NO: 62697 - DNA, 444 bp, Homo sapiens
cccacaacgcctcccccagccagggcccgtggatccccgggagcgtccccggctatctggcgctgctcatcctggctggcagcctgctatcaattatattgatagtaaatttgaggactacctaaatgcagaatcgcgagtgaacagatgtcagatgcctggtaacagggtgcagtgttgtttatacttcattgctccttcaggacatgggtggcagacaagaaacatggattattgcgtggagttccattagtaggaataagactcattctacattcttgttgttcttagtgttttttgtttttcatgagaaggaattgtatcagcacaaggcaatattctaacatgacaatgacagcagacagaacctcaataaactctgacttggtactgcaaaaaccatttcatgataccttaattcaaataaacctttgtttaatcaat

SEQ ID NO: 62698 - DNA, 611 bp, Homo sapiens
caatccaaagttttaatcaaagaaggtggtgttcagttgctgcttacaatagttgataccccaggatttggagatgcagtggataatagtaattgctggcagcctgctatcaattatattgatagtaaatttgaggactacctaaatgcagaatcgcgagtgaacagatgtcagatgcctggtaacagggtgcagtgttgtttatacttcattgctccttcaggacatggctctgttcacggaaagggcctgggagctgcaacacctcaacagcaacgagcacacctgctacctagaacttggtttctaaaaaccatcctcctctaaaaggaaacagagctctttgaagaaatggtaatttcaaagctagagcacagaaagtataagatgagcccagaatatctttttgtacaagaaagtaaggcaatgctcaaagaatgatggagacatgcccaaaaaaagcagagaagccaacttgaaaagattccaacaggccaaatatgggacaatttgaacatcagaataaaatggtgacagtcacagaattataacccattgaagaaaggaattcatgacatcatattaatataaataataattgaataaaaaaa

SEQ ID NO: 62699 - DNA, 1157 bp, Homo sapiens
  misc_feature (914)..(914): n is a, c, g, or t
gccaatcggaactcatggcggggctgctgggtcttccaggagcgcgcatgagcggacgctgcctatgggttgccgggcgagatgtaaccggctgctgagctggcagttctgtgtcgctaggcttctgcccggccgccgccacacataagctgcgatgaggagctttacgacttcccggtcttcggggccgggcgcagcaagggccagactctgcgctagcaggcgctgcgcgccaaccggccggcacctgtcgcagaaggtgcaaccgatcgcactgtcgcgcagaagctcctcaatggccagcaccagctgcagccccggccgcccactcgcctcacttgagcctgtctggcagcctgctatcaattatattgatagtaaatttgaggactacctaaatgcagaatcgcgagtgaacagatgtcagatgcctggtaacagggtgcagtgttgtttatacttcattgctccttcaggacatggctctgttcacggaaagggcctgggagctgcaacacctcaacagcaacgagcacacctgctacctagaacttggtttctaaaaaccatcctcctctaaaaggaaacagagctctttgaagaaatgagacagatctcattatgttgcccagggtgatccttgatctcctggcctcaagtgatcctccaaccttggtctcccaaagtgctgggattacagatgtgaactaccacacccagtcaacgtgcagaaggttttcagtttgatgtagtctgatgtagtctcatgtatttatccttgttgttgttgcctgagcttttggtgtgatatccaaaaatatcattgccaagatcaatatcaagaaactttccccctatgtttcttacagaaattttatggtttcagatttttcatctattttgagtatattttngtgtatgatgtaagataagggtccagtctccccagtgttggatatccaattttcataacaccatttattgaagagattattcttgtctccacgtgtgtttttcttgatggtccttgctcaaaaattagttgaccttttatatgcttgggtttattttctggggcctctattctggtttccttgctttacatctctgttttcatggcagtgccacagtgtttgattactattagcttgtatcta

SEQ ID NO: 62700 - DNA, 396 bp, Homo sapiens
ctggcagcctgctatcaattatattgatagtaaatttgaggactacctaaatgcagaatcgcgagtgaacagatgtcagatgcctggtaacagggtgcagtgttgtttatacttcattgctccttcaggacatgggtcagtaacctgatacttctgattcctttttgttgttgttgcttactgttacctttatgtgcatatttgagtaatctttaagtttgtgaagtacatacaactatacccattattaagtaccaaatttcatgtagaaatgtcttagttgaaaagcctttttaagtcctgtgtaagctaacagtgcttttactccttagttcttattcataaggattttccctgcttcatggaaataaacagtgttgccaccatggtttgagg

SEQ ID NO: 62701 - DNA, 390 bp, Homo sapiens
ctacatcaagcagtgagcaacatgctttcacagcagaggaaactatggcttaggaactgaggtgacaggcctgaggtcccacagcaagggcagaactggaacttgaagtccatttcctttgccagctccacaccacctcagaaaagctcaacagattctagaggattccctctacatgctttgttcagattcctttagtcaataactctaggggccaggcatggtgtctcaaggctataatcccagcactttggggaggccgagatgggctggtcacttgaagccaggagtttgagaccagcctggccaacatggtgaaaccctgtttctactaaaaataatacaaaaaaagtaggcatggtggctcaagcctataattccagccaagat

SEQ ID NO: 62702 - DNA, 180 bp, Homo sapiens
ggagatgtccagtaaggagctgaaagcacagctctagatagaagtgttagggatggtcactatttactgtggttgaagtcttgagaatagtgagattatccaggtagaattgaagtacagagaagacaagcattgatatccagttggaatgatttacacattaaatgtcaaagtcctcag

SEQ ID NO: 62703 - DNA, 295 bp, Homo sapiens
ctcacgcctccttacagagcttacttctcaataccattaaaagcatcttccctaagccctatcccttgttttcctttcactacaggttctccctatgacttcagatagagagctgagaaataagggagcagaaccaagttaaaagctcaaaaccctgaaagtctacccccttcagtgttgctcctattttatttttatttatttatttattttttgagaccgtgtcttgctcttttgcccaggctggagtgcagtggcgagatctcggctcactgcaagctccgcctcctgggtt

SEQ ID NO: 62704 - DNA, 904 bp, Homo sapiens
gccttcccaaggaagaccctgagtaaaatctgcatctgtcctcaccacctggcacagtctctcataacggtcagattttgtatgttcatcctatttattcaggggctcgtactagaaagccacaggagaggtcggcttgtagggactggaaaatcagccccaagcagagcagctgcagggcccctggagccggaaggacactgcacagaacagactgcgttattgttatttttaaataaaaatatacatttgaaaccttaaggctaaacaaaaataaacaaaaaatcctttagaattctttccacaacaatatctctttctgagaaattgttacaaacaaggtcagattttctctgtataacatttgcttttatgaggacaatatcatatgcattatatgcataatatgatattataaatcaaaatgcctgcacccactttagggtatagctattgacttattattaatattatattattattattttgctggaagaaggtcacactaagatataattttttatgttttcagttaacggtatgctttcttctttgcttatttggtttttgtctctgtaccaaatatcttcttgcttaaggtagaaaagtatttgtttacctctatctccagttttttttcttatttgaatgttgaaggtaaaattgatataccaattttaactatttctgatacagctgaaagcactaaactacttcataagaagtagatactcatttttgtaacactatttagggcttttgtggttaattttaaaggaaaccactctttctacaggaaacaagggctcaggattcttcagatgaccttataaaaatgcagtccacagtgctatcaatattgtaacagtaatgactacaataaagccaaaagtccagtgtacct

SEQ ID NO: 62705 - DNA, 5618 bp, Homo sapiens
gttggctgatagttcaccttcaaatcttcaaattattataaaagaactgctttctatgcatcaccagcctgaccctgctcttaccaaggagtttgattaccttcccccagtggatagcaggtccagttcagggtttgtggggctgagaaatggtggtgcaacttgttatatgaatgcagtcttccagcagctgtatatgcaacctgggctccctgagtcattactttcagtggatgatgacacagacaatccagatgatagcgtgttttaccaagtgcagtctctctttggacatttaatggaaagcaagctgcagtactatgtacctgagaatttttggaagattttcaagatgtggaataaagaactttatgtgagagaacagcaggatgcatatgaattctttactagtctcattgatcagatggatgaatacctcaagaaaatggggagagaccaaatttttaagaatacatttcagggcatctactctgatcagaagatctgtaaagactgtcctcacagatatgagcgtgaagaagctttcatggctctcaatctaggagtgacttcttgtcagagtttggaaatttctttggaccaatttgttagaggagaagttctagaaggaagtaatgcgtactactgtgaaaagtgtaaagaaaagagaataacagtgaaaaggacctgtattaaatctttacctagcgtcttggtaattcacctaatgagatttgggtttgactgggaaagcggacgctccattaaatatgatgaacaaataaggtttccctggatgctaaacatggagccttacacagtttcaggaatggctcgccaagattcttcttctgaagttggggaaaatgggcgaagtgtggatcagggcggtggaggatccccacgaaaaaaggttgccctcacagaaaactatgaacttgtcggtgtcatcgtacacagtgggcaggcacacgcaggccactactattccttcattaaggacaggcgagggtgtggaaaaggaaagtggtataaatttaatgacacagttatagaagaatttgacctaaatgacgagaccctggagtatgaatgctttggaggagaatatagaccaaaagtttatgatcaaacaaacccatacactgatgtgcgccgaagatactggaatgcctatatgcttttctaccaaagggtgtctgatcagaactccccagtattaccaaagaaaagtcgagtcagcgttgtacggcaggaagctgaggatctctctctgtcagctccatcttcaccagaaatttcacctcagtcatcccctcggccccataggccgaacaatgaccggctgtctattcttaccaagctggttaaaaaaggcgagaagaaaggactgtttgtggagaaaatgcctgctcgaatataccagatggtgagagatgagaacctcaagtttatgaagaatagagatgtatacagtagtgattatttcagttttgttttgtctttagcttcattgaatgctactaaattaaagcatccatattatccttgcatggcaaaggtgagcttacagcttgctattcaattcctttttcaaacttatctacggacaaagaagaaactcagggttgatactgaagaatggattgctaccattgaagcattgctttcaaaaagttttgatgcttgtcagtggttagttgaatattttattagttctgaaggacgagaattgataaagattttcttactggagtgcaatgtgagagaagtacgagttgctgtggccaccattctggagaaaaccctagacagtgccttgttttatcaggataagttaaaaagccttcatcagttactggaggtactacttgctctgttggacaaagacgtcccagaaaattgtaaaaactgtgctcagtactttttcctgttcaacacttttgtacaaaagcaaggaattagggctggagatcttcttctgaggcattcagctctgcggcacatgatcagcttcctcctaggggccagtcggcaaaacaatcagatacgtcgatggagttcagcacaagcacgagaatttgggaatcttcacaatacagtggcgttacttgttttgcattcagatgtctcatcccaaaggaatgttgctcctggcatatttaagcaacgaccacccattagcattgctccctcaagccctctgttgcccctccatgaggaggtagaagccttgttgttcatgtctgaagggaaaccttacctgttagaggtaatgtttgctttgcgggagctgacaggctcgctcttggcactcattgagatggtagtgtactgctgtttctgtaatgagcatttttccttcacaatgctgcatttcattaagaaccaactagaaacggctccacctcatgagttaaagaatacgttccaactacttcatgaaatattggttattgaagatcctatacaagcagagcgagtcaaatttgtgtttgagacagaaaatggattactagctttgatgcaccacagtaatcatgtggacagtagtcgctgctaccagtgtgtcaaatttcttgtcactcttgctcaaaagtgtcctgcagctaaggagtacttcaaggagaattcccaccactggagctgggctgtgcagtggctacagaagaagatgtcagaacattactggacaccacagagtaatgtctctaatgaaacatcaactggaaaaacctttcagcgaaccatttcagctcaggacacgttagcgtatgccacagctttgttgaatgaaaaagagcaatcaggaagcagtaatgggtcggagagtagtcctgccaatgagaacggagacaggcatctacagcagggttcagaatctcccatgatgattggtgagttgagaagtgaccttgatgatgttgatccctagaggaacatgcccagcctgagaggagtcaagacacaatactggatgctcagcaccttcttggaatcagaatctcgaaccctttggaagagcctggagattggactgggaaagctgctgtgacttgggcggatcgtgtatttctcaaggaaagcatttttaagccactagaaggtttgggagctgtttggcagtgggagaactccggcatgtggatcagctgtcccgggagcgtggtctatatgtggattcacatttctgtggagattttcggaaatagagccagtggcagacttttttgttacacgaacatacaagagtgagcataaagctgttgctttctctacgatgctacaaaagaaattcctttggtttttatattttaagaaaaagcaagctgcttttagatatgtgggggcaaatttttaatcttgcagtaatattaaacaggaatatccaatttaaaatgatgtaaagatgtaataaaattccttttcattgtaaaatagtaattaagtcaatttacacagacctttgtatttaatatgtctccctatttgtatagaatttcagatgggtctagatgagaaccctatgcataagcttggatcttgatgaaaggttaccaggatcaggatcaaaaattgggaaatactaagctcttgaagatatttttctgatataattagattgaaaagagcaattttgaaaatgctgtgttctccagaagtacagggtgcattatttgacatcaattacttaaagaagttatgagttgttccccaaacagattttaaaaacagcaaaataaaagcactttaagatataattttactgagtttaacttcacagaattatctttttaatgcttggagacatattgaataaactgtagtcttaaatcatgtgatctgcaatcgtttgcttttgcttaaaacataattactgaaacccttggtattggttgtatatgaagttaactatttgagttggtacacactgcttgtgagtttcatagttattgtaatgcagagaaggaatttgagaatttgtttctcctcaacatgactaattaacactgaaaagtcagtcaaggtttaagatttattttcccagaaataaatataaagcaattgaataaccatccatttagtcgtatttccaaagtatagcaccattcactcatttataccagctcccttttatggtgtgggggagaggtttacacccacatatttcatatatattttgtacattttgtattttgaattgctcacattttcggccctgttttgcctttagttacaggtcctgccttattttcatctcaccatgcacagaactagggagccttaggaagtgccaggttttcactgtcagatttgccaagtcacagaggcgcagccagccctgaagtgcctgtctggctgctgtggcattgtgtgggcatgtggccaggcagatggcatctcattactgtgctctcgccatggcccagtcttttcattctctggcagtgagggtttctgtgctgtcagacttcattgttattctgtgacttgctggaggttggcagtggcctttgtcaaacacactgagaagatggaagggccagcacttaagagcagaactgtacccttagagaaacggacagaggcgagtggcaaacttcagacggttccaatggtcttgcagtttgaaatgtgatgttctaccattggttttgagtacgtgaatacttcctgtcctactgtttcccctaccctattctcaccttctctccgcccacatcctcaccaagagattgtgtgggacatgaccttgaaatgctggcgatgatccacactgggatatcatcgctggcgactgcactctcaggagcccaaaatcaggagtgaaattgccacttctagtccccttatttcctatggaaacaacgccttccgcacccctagcacctgccgtcctcactgtaaaggttcatcaggatcgtccaccgtgtatattatacgcttcagatcatgttgcttatattgttgctgcaatgaccatcgttttcactttgctggtaaccacttgattgctgacagctacagtcaatgaacctgctgatgactttttttaatgtagtacaacagtgacagttatgacaggcttaccttggaagagttgtcatttttactgccaattttttggatgaagatgtttttataaacctttcaaaatggtctgcaaacagagcaggaattgcacaattaactcaataatgctgtgtgttctcaagaagctcccttagtgaggccgatcttaagatggccgattctgcccgttgaaggcatcctgggaaagaaaacaagcatcccagcgggcatctcaccacgacttctcctggagtcctcacacggtcactgacaactacagtcagttttaggaactagagtgccgtatcatcagacttaccctgtcctgccccaccttccctgctaacatcgaggtgtgtgcagttaccttctgagcttggaacaagcagactggaattttcctctgctacctcttgtgtataaaatcttgtttataaaatttcaaaaggaagtagatacactagggaagaaccttaattctaaatttggttcatgtgtggcaaagttcttagcttctaagagtataaaataaatttttcaaaaac

SEQ ID NO: 62706 - DNA, 786 bp, Homo sapiens
acccatcaggccttatgtcagaaaggcaggaatcagggcagatatggaggctttaagagcaagagttcatgagctttcactcaaggtttctcattaatgtaacccagctaccagctcttcaggctctaggtccctaacctcagaatagcctttcaaatcatgtcacctgtagctcctgagcacttgtgaacccaggcaccgtgtcaagaaccttgcctgtattatcttatttcatctttgtaacaacttcatgaggttagtacagttgtgagtcatatatcatgggtagtttaagtgacatgcctagagtcatagagtgaaaacttgaacacaggctgattgactgcaaaatgaaggttcttttttttttaattgtggcgaaatgtacataacataaaatttactatttgaaccatttttaagtgtatagttcagtgactttaagtacattcacactgatgtgcaaccatcaccaccatccatctccagaactcttttcatcttctgaaactgaaactctggacctattgaagactgactccctattcctcccttcccccagcccctgggggaagcaattgtaatttctgtctccatgaatttgactactctaggaaccccatttaagtagaatcacaaatataaagacaactgaattttaatgaaactagcatttacgtttcaaaatgaagcactaggaacaagcaaagaaagaatttggctaataaaaatctcctcggtcatcaggtgtcctgcagctaaggagtacttcaaggagaattccca

SEQ ID NO: 62707 - DNA, 4478 bp, Homo sapiens
gttggctgatagttcaccttcaaatcttcaaattattataaaagaactgctttctatgcatcaccagcctgaccctgctcttaccaaggagtttgattaccttcccccagtggatagcaggtccagttcagggtttgtggggctgagaaatggtggtgcaacttgttatatgaatgcagtcttccagcagctgtatatgcaacctgggctccctgagtcattactttcagtggatgatgacacagacaatccagatgatagcgtgttttaccaagtgcagtctctctttggacatttaatggaaagcaagctgcagtactatgtacctgagaatttttggaagattttcaagatgtggaataaagaactttatgtgagagaacagcaggatgcatatgaattctttactagtctcattgatcagatggatgaatacctcaagaaaatggggagagaccaaatttttaagaatacatttcagggcatctactctgatcagaagatctgtaaagactgtcctcacagatatgagcgtgaagaagctttcatggctctcaatctaggagtgacttcttgtcagagtttggaaatttctttggaccaatttgttagaggagaagttctagaaggaagtaatgcgtactactgtgaaaagtgtaaagaaaagagaataacagtgaaaaggacctgtattaaatctttacctagcgtcttggtaattcacctaatgagatttgggtttgactgggaaagcggacgctccattaaatatgatgaacaaataaggtttccctggatgctaaacatggagccttacacagtttcaggaatggctcgccaagattcttcttctgaagttggggaaaatgggcgaagtgtggatcagggcggtggaggatccccacgaaaaaaggttgccctcacagaaaactatgaacttgtcggtgtcatcgtacacagtgggcaggcacacgcaggccactactattccttcattaaggacaggcgagggtgtggaaaaggaaagtggtataaatttaatgacacagttatagaagaatttgacctaaatgacgagaccctggagtatgaatgctttggaggagaatatagaccaaaagtttatgatcaaacaaacccatacactgatgtgcgccgaagatactggaatgcctatatgcttttctaccaaagggtgtctgatcagaactccccagtattaccaaagaaaagtcgagtcagcgttgtacggcaggaagctgaggatctctctctgtcagctccatcttcaccagaaatttcacctcagtcatcccctcggccccataggccgaacaatgaccggctgtctattcttaccaagctggttaaaaaaggcgagaagaaaggactgtttgtggagaaaatgcctgctcgaatataccagatggtgagagatgagaacctcaagtttatgaagaatagagatgtatacagtagtgattatttcagttttgttttgtctttagcttcattgaatgctactaaattaaagcatccatattatccttgcatggcaaaggtgagcttacagcttgctattcaattcctttttcaaacttatctacggacaaagaagaaactcagggttgatactgaagaatggattgctaccattgaagcattgctttcaaaaagttttgatgcttgtcagtggttagttgaatattttattagttctgaaggacgagaattgataaagattttcttactggagtgcaatgtgagagaagtacgagttgctgtggccaccattctggagaaaaccctagacagtgccttgttttatcaggataagttaaaaagccttcatcagttactggaggtactacttgctctgttggacaaagacgtcccagaaaattgtaaaaactgtgctcagtactttttcctgttcaacacttttgtacaaaagcaaggaattagggctggagatcttcttctgaggcattcagctctgcggcacatgatcagcttcctcctaggggccagtcggcaaaacaatcagatacgtcgatggagttcagcacaagcacgagaatttgggaatcttcacaatacagtggcgttacttgttttgcattcagatgtctcatcccaaaggaatgttgctcctggcatatttaagcaacgaccacccattagcattgctccctcaagccctctgttgcccctccatgaggaggtagaagccttgttgttcatgtctgaagggaaaccttacctgttagaggtaatgtttgctttgcgggagctgacaggctcgctcttggcactcattgagatggtagtgtactgctgtttctgtaatgagcatttttccttcacaatgctgcatttcattaagaaccaactagaaacggctccacctcatgagttaaagaatacgttccaactacttcatgaaatattggttattgaagatcctatacaagcagagcgagtcaaatttgtgtttgagacagaaaatggattactagctttgatgcaccacagtaatcatgtggacagtagtcgctgctaccagtgtgtcaaatttcttgtcactcttgctcaaaagtgtcctgcagctaaggagtacttcaaggagaattcccaccactggagctgggctgtgcagtggctacagaagaagatgtcagaacattactggacaccacagagtaatgtctctaatgaaacatcaactggaaaaacctttcagcgaaccatttcagctcaggacacgttagcgtatgccacagctttgttgaatgaaaaagagcaatcaggaagcagtaatgggtcggagagtagtcctgccaatgagaacggagacaggcatctacagcagggttcagaatctcccatgatgattggtgagttgagaagtgaccttgatgatgttgatccctagaggaacatgcccagcctgagaggagtcaagacacaatactggatgctcagcaccttcttggaatcagaatctcgaaccctttggaagagcctggagattggactgggaaagctgctgtgacttgggcggatcgtgtatttctcaaggaaagcatttttaagccactagaaggtttgggagctgtttggcagtgggagaactccggcatgtggatcagctgtcccgggagcgtggtctatatgtggattcacagaggcgcagccagccctgaagtgcctgtctggctgctgtggcattgtgtgggcatgtggccaggcagatggcatctcattactgtgctctcgccatggcccagtcttttcattctctggcagtgagggtttctgtgctgtcagacttcattgttattctgtgacttgctggaggttggcagtggcctttgtcaaacacactgagaagatggaagggccagcacttaagagcagaactgtacccttagagaaacggacagaggcgagtggcaaacttcagacggttccaatggtcttgcagtttgaaatgtgatgttctaccattggttttgagtacgtgaatacttcctgtcctactgtttcccctaccctattctcaccttctctccgcccacatcctcaccaagagattgtgtgggacatgaccttgaaatgctggcgatgatccacactgggatatcatcgctggcgactgcactctcaggagcccaaaatcaggagtgaaattgccacttctagtccccttatttcctatggaaacaacgccttccgcacccctagcacctgccgtcctcactgtaaaggttcatcaggatcgtccaccgtgtatattatacgcttcagatcatgttgcttatattgttgctgcaatgaccatcgttttcactttgctggtaaccacttgattgctgacagctacagtcaatgaacctgctgatgactttttttaatgtagtacaacagtgacagttatgacaggcttaccttggaagagttgtcatttttactgccaattttttggatgaagatgtttttataaacctttcaaaatggtctgcaaacagagcaggaattgcacaattaactcaataatgctgtgtgttctcaagaagctcccttagtgaggccgatcttaagatggccgattctgcccgttgaaggcatcctgggaaagaaaacaagcatcccagcgggcatctcaccacgacttctcctggagtcctcacacggtcactgacaactacagtcagttttaggaactagagtgccgtatcatcagacttaccctgtcctgccccaccttccctgctaacatcgaggtgtgtgcagttaccttctgagcttggaacaagcagactggaattttcctctgctacctcttgtgtataaaatcttgtttataaaatttcaaaaggaagtagatacactagggaagaaccttaattctaaatttggttcatgtgtggcaaagttcttagcttctaagagtataaaataaatttttcaaaaac

SEQ ID NO: 62708 - DNA, 3836 bp, Homo sapiens
gttggctgatagttcaccttcaaatcttcaaattattataaaagaactgctttctatgcatcaccagcctgaccctgctcttaccaaggagtttgattaccttcccccagtggatagcaggtccagttcagggtttgtggggctgagaaatggtggtgcaacttgttatatgaatgcagtcttccagcagctgtatatgcaacctgggctccctgagtcattactttcagtggatgatgacacagacaatccagatgatagcgtgttttaccaagtgcagtctctctttggacatttaatggaaagcaagctgcagtactatgtacctgagaatttttggaagattttcaagatgtggaataaagaactttatgtgagagaacagcaggatgcatatgaattctttactagtctcattgatcagatggatgaatacctcaagaaaatggggagagaccaaatttttaagaatacatttcagggcatctactctgatcagaagatctgtaaagactgtcctcacagatatgagcgtgaagaagctttcatggctctcaatctaggagtgacttcttgtcagagtttggaaatttctttggaccaatttgttagaggagaagttctagaaggaagtaatgcgtactactgtgaaaagtgtaaagaaaagagaataacagtgaaaaggacctgtattaaatctttacctagcgtcttggtaattcacctaatgagatttgggtttgactgggaaagcggacgctccattaaatatgatgaacaaataaggtttccctggatgctaaacatggagccttacacagtttcaggaatggctcgccaagattcttcttctgaagttggggaaaatgggcgaagtgtggatcagggcggtggaggatccccacgaaaaaaggttgccctcacagaaaactatgaacttgtcggtgtcatcgtacacagtgggcaggcacacgcaggccactactattccttcattaaggacaggcgagggtgtggaaaaggaaagtggtataaatttaatgacacagttatagaagaatttgacctaaatgacgagaccctggagtatgaatgctttggaggagaatatagaccaaaagtttatgatcaaacaaacccatacactgatgtgcgccgaagatactggaatgcctatatgcttttctaccaaagggtgtctgatcagaactccccagtattaccaaagaaaagtcgagtcagcgttgtacggcaggaagctgaggatctctctctgtcagctccatcttcaccagaaatttcacctcagtcatcccctcggccccataggccgaacaatgaccggctgtctattcttaccaagctggttaaaaaaggcgagaagaaaggactgtttgtggagaaaatgcctgctcgaatataccagatggtgagagatgagaacctcaagtttatgaagaatagagatgtatacagtagtgattatttcagttttgttttgtctttagcttcattgaatgctactaaattaaagcatccatattatccttgcatggcaaaggtgagcttacagcttgctattcaattcctttttcaaacttatctacggacaaagaagaaactcagggttgatactgaagaatggattgctaccattgaagcattgctttcaaaaagttttgatgcttgtcagtggttagttgaatattttattagttctgaaggacgagaattgataaagattttcttactggagtgcaatgtgagagaagtacgagttgctgtggccaccattctggagaaaaccctagacagtgccttgttttatcaggataagttaaaaagccttcatcagttactggaggtactacttgctctgttggacaaagacgtcccagaaaattgtaaaaactgtgctcagtactttttcctgttcaacacttttgtacaaaagcaaggaattagggctggagatcttcttctgaggcattcagctctgcggcacatgatcagcttcctcctaggggccagtcggcaaaacaatcagatacgtcgatggagttcagcacaagcacgagaatttgggaatcttcacaatacagtggcgttacttgttttgcattcagatgtctcatcccaaaggaatgttgctcctggcatatttaagcaacgaccacccattagcattgctccctcaagccctctgttgcccctccatgaggaggtagaagccttgttgttcatgtctgaagggaaaccttacctgttagaggtaatgtttgctttgcgggagctgacaggctcgctcttggcactcattgagatggtagtgtactgctgtttctgtaatgagcatttttccttcacaatgctgcatttcattaagaaccaactagaaacggctccacctcatgagttaaagaatacgttccaactacttcatgaaatattggttattgaagatcctatacaagcagagcgagtcaaatttgtgtttgagacagaaaatggattactagctttgatgcaccacagtaatcatgtggacagtagtcgctgctaccagtgtgtcaaatttcttgtcactcttgctcaaaagtgtcctgcagctaaggagtacttcaaggagaattcccaccactggagctgggctgtgcagtggctacagaagaagatgtcagaacattactggacaccacagagtaatgtctctaatgaaacatcaactggaaaaacctttcagcgaaccatttcagctcaggacacgttagcgtatgccacagctttgttgaatgaaaaagagcaatcaggaagcagtaatgggtcggagagtagtcctgccaatgagaacggagacaggcatctacagcagggttcagaatctcccatgatgattggtgagttgagaagtgaccttgatgatgttgatccctagaggaacatgcccagcctgagaggagtcaagacacaatactggatgctcagcaccttcttggaatcagaatctcgaaccctttggaagagcctggagattggactgggaaagctgctgtgacttgggcggatcgtgtatttctcaaggaaagcatttttaagccactagaaggtttgggagctgtttggcagtgggagaactccggcatgtggatcagctgtcccgggagcgtggtctatatgtggattcacatttctgtggagattttcggaaatagagccagtggcagacttttttgttacacgaacatacaagagtgagcataaagctgttgctttctctacgatgctacaaaagaaattcctttggtttttatattttaagaaaaagcaagctgcttttagatatgtgggggcaaatttttaatcttgcagtaatattaaacaggaatatccaatttaaaatgatgtaaagatgtaataaaattccttttcattgtaaaatagtaattaagtcaatttacacagacctttgtatttaatatgtctccctatttgtatagaatttcagatgggtctagatgagaaccctatgcataagcttggatcttgatgaaaggttaccaggatcaggatcaaaaattgggaaatactaagctcttgaagatatttttctgatataattagattgaaaagagcaattttgaaaatgctgtgttctccagaagtacagggtgcattatttgacatcaattacttaaagaagttatgagttgttccccaaacagattttaaaaacagcaaaataaaagcactttaagatataattttactgagtttaacttcacagaattatctttttaatgcttggagacatattgaataaactgtagtcttaaatc

SEQ ID NO: 62709 - DNA, 427 bp, Homo sapiens
atgtgatctgacgggtaacacaggtatggatggagacttactgacagaggctgggacaggagtcagtaaccgagaggaatgggctggggaagtcaccaatagccttgtgaaaagtaggctcctgtgtagctataataaggacttccttagtgctcaagcctgccttttgctcctgcagttacgttatgatgatgaagtgaagcgggtggtggcagagccggtggagttggcccaagagttccgcaaatttgacctgaacagcccctgggaggctttcccagtctatcgccaacccccggagagtctcaagcttgaagccggagacaagaagcctgatgccaagtagctccagggaacgcatgtggatcctagacagcgccttatctatgattgagtgtccgtgtaaataaattcctacttagactta

SEQ ID NO: 62710 - DNA, 581 bp, Homo sapiens
ccccccaactaggaggcacggcccccaacagcatcacccgcttaaatcccctgaagtcccactcctaaacacatccgtattactcgcatcaggagtatcaatcacctgagctcaccatagtctaatagaaaacaaccgaaaccaaataattcaagcactgcttattacaattttactgggtctctattttaccctcctacaagcctcagagtacttcgagtctcccttcaccatttccgacggcatctacggctcaacattttttgtaccacaggcttccacggacttcacgtcattattggctcaactttcctctatctggctatgttgagttacgttatgatgatgaagtgaagcgggtggtggcagagccggtggagttggcccaagagttccgcaaatttgacctgaacagcccctgggaggctttcccagtctatcgccaacccccggagagtctcaagcttgaagccggagacaagaagcctgatgccaagtagctccagggaacgcatgtggatcctagacagcgccttatctatgattgagtgtccgtgtaaataaattcctacttagactta

SEQ ID NO: 62711 - DNA, 496 bp, Homo sapiens
tgtgctgaatctaaaatatgagtaggagaccaggtagccttgtgagatggaccagggaaatattcctgacaaagtgaatagcatgagcaaacacaggcatgctgacatgctaagctacagctgtggcctgggcctttggaagtagttgtaagcataggagaatcttgaggttttgaggttcagaatagaaggcagggtcacagggcagaactctcccaatcagggactcccatctcagccctccagatccttctgttctccctagattgtctacaacctgttgtctctgcgcttcaactcacggatccgtgtgaagacctacacagatgagctgacgcccattgagtctgctgtctctgtgttcaaggcagccaactggtatgaaagggaggtgagttaccggatatggtggacctgcctctgggccacagttgcagaactggttcagactacgggatgcagtgtagccccttccccctgttgttagtcttgatgg

SEQ ID NO: 62712 - DNA, 976 bp, Homo sapiens
tatgggctagtacgggcctggggtcaaatcggcgaggcgtgccttggggctccgtgtcctgctgtctttccgtccgctgcctagtctgcatctgagtaacatggcggcggcggcggtagccaggctgtggtggcgcgggatcttgggggcctcggcgctgaccagggggactgggcgaccctccgttctgttgctgccggtgaggcgggagagcgccggggccgacacgcgccccactgtcagaccacggaatgatgtggcccacaagcagctctcagcttttggagagtatgtggctgaaatcttgcccaagtatgtccaacaagttcaggtgtcctgcttcaatgagttagaggtctgtatccatcctgatggcgtcatcccagtgctgactttcctcagggatcacaccaatgcacagttcaaatctctggttgacttgacagcagtggacgtcccaactcggcaaaaccgttttgagattgtctacaacctgttgtctctgcgcttcaactcacggatccgtgtgaagacctacacagatgagctgacgcccattgagtctgctgtctctgtgttcaaggcagccaactggtatgaaagggagatctgggacatgtttggagtcttctttgctaaccaccctgatctaagaaggatcctgacagattatggcttcgagggacatcctttccggaaagactttcctctatctggctatgttgagttacgttatgatgatgaagtgaagcgggtggtggcagagccggtggagttggcccaagagttccgcaaatttgacctgaacagcccctgggaggctttcccagtctatcgccaacccccggagagtctcaagcttgaagccggagacaagaagcctgatgccaagtagctccagggaacgcatgtggatcctagacagcgccttatctatgattgagtgtccgtgtaaataaattcctacttagactta

SEQ ID NO: 62713 - DNA, 920 bp, Homo sapiens
aaggctaggtacgaggcctgggtggtagtctgcatctgagtaacatggcggcggcggcggtagccaggctgtggtggcgcgggatcttgggggcctcggcgctgaccagggggactgggcgaccctccgttctgttgctgccggtgaggcgggagagcgccggggccgacacgcgccccactgtcagaccacggaatgatgtggcccacaagcagctctcagcttttggagagtatgtggctgaaatcttgcccaagtatgtccaacaagttcaggtgtcctgcttcaatgagttagaggtctgtatccatcctgatggcgtcatcccagtgctgactttcctcagggatcacaccaatgcacagttcaaatctctggttgacttgacagcagtggacgtcccaactcggcaaaaccgttttgagattgtctacaacctgttgtctctgcgcttcaactcacggatccgtgtgaagacctacacagatgagctgacgcccattgagtctgctgtctctgtgttcaaggcagccaactggtatgaaagggagatctgggacatgtttggagtcttctttgctaaccaccctgatctaagaaggatcctgacagattatggcttcgagggacatcctttccggaaagactttcctctatctggctatgttgagttacgttatgatgatgaagtgaagcgggtggtggcagagccggtggagttggcccaagagttccgcaaatttgacctgaacagcccctgggaggctttcccagtctatcgccaacccccggagagtctcaagcttgaagccggagacaagaagcctgatgccaagtagctccagggaacgcatgtggatcctagacagcgccttatctatgattgagtgtccgtgtaaataaattcctacttagactta

SEQ ID NO: 62714 - DNA, 919 bp, Homo sapiens
aggctagtacgaggctggtgttctgagtctgcatctgagtaacatggcggcggcggcggtagccaggctgtggtggcgcgggatcttgggggcctcggcgctgaccagggggactgggcgaccctccgttctgttgctgccggtgaggcgggagagcgccggggccgacacgcgccccactgtcagaccacggaatgatgtggcccacaagcagctctcagcttttggagagtatgtggctgaaatcttgcccaagtatgtccaacaagttcaggtgtcctgcttcaatgagttagaggtctgtatccatcctgatggcgtcatcccagtgctgactttcctcagggatcacaccaatgcacagttcaaatctctggttgacttgacagcagtggacgtcccaactcggcaaaaccgttttgagattgtctacaacctgttgtctctgcgcttcaactcacggatccgtgtgaagacctacacagatgagctgacgcccattgagtctgctgtctctgtgttcaaggcagccaactggtatgaaagggagatctgggacatgtttggagtcttctttgctaaccaccctgatctaagaaggatcctgacagattatggcttcgagggacatcctttccggaaagactttcctctatctggctatgttgagttacgttatgatgatgaagtgaagcgggtggtggcagagccggtggagttggcccaagagttccgcaaatttgacctgaacagcccctgggaggctttcccagtctatcgccaacccccggagagtctcaagcttgaagccggagacaagaagcctgatgccaagtagctccagggaacgcatgtggatcctagacagcgccttatctatgattgagtgtccgtgtaaataaattcctacttagactta

SEQ ID NO: 62715 - DNA, 1310 bp, Homo sapiens
tatgggctagtacgggcctggggtcaaatcggcgaggcgtgccttggggctccgtgtcctgctgtctttccgtccgctgcctagtctgcatctgagtaacatggcggcggcggcggtagccaggctgtggtggcgcgggatcttgggggcctcggcgctgaccagggggactgggcgaccctccgttctgttgctgccggtgaggcgggagagcgccggggccgacacgcgccccactgtcagaccacggaatgatgtggcccacaagcagctctcagcttttggagagtatgtggctgaaatcttgcccaagtatgtccaacaagttcaggtgtcctgcttcaatgagttagaggtctgtatccatcctgatggcgtcatcccagtgctgactttcctcagggatcacaccaatgcacagttcaaatctctggttgacttgacagcagtggacgtcccaactcggcaaaaccgttttgagattgtctacaacctgttgtctctgcgcttcaactcacggatccgtgtgaagacctacacagatgagctgacgcccattgagtctgctgtctctgtgttcaaggcagccaactggtatgaaagggagatctgggacatgtttggagtcttctttgctaaccaccctgatctaagaaggatcctgacagattatggcttcgagggacatcctttccggaaagactttcctctatctggctatgttgagttacgttatgatgatgaagtgaagcgggtggtggcagagccggtggagttggcccaagagttccgcaaatttgacctgaacagcccctgggaggctttcccagtctatcgccaacccccggagagtctcaagcttgaagccggagacaagaagcctgatgccaagtagctccagggaacgcatgtggatcctagacagcgccttatctatgattgagtgtccgtgtaaataaattcctacttagacttaaaaaaaaaaaaaaaaaaaaaaaaaaaaaaaaaacaaaaggggggggggggaaaaaatatcccccggggggggcaaaggtattagaggattaccacaggtttttttgagaaagggggccctatgaagggggcgatattaaaaggaagggaggggcggcggttaacaacgtttgtgcgtggaaacgtgctcgctggcaactcttgcacggaccattattgtcggcgggtgggaatattggaacatccaacagagtaacggctcgagggagatcaactttaagtgtacggtgttaacacgggattgtgcgctagaaatagtatcggatgtttgaatc

SEQ ID NO: 62716 - DNA, 1218 bp, Homo sapiens
tatgggctagtacgggcctggggtcaaatcggcgaggcgtgccttggggctccgtgtcctgctgtctttccgtccgctgcctagtctgcatctgagtaacatggcggcggcggcggtagccaggctgtggtggcgcgggatcttgggggcctcggcgctgaccagggggactgggcgaccctccgttctgttgctgccggtgaggcgggagagcgccggggccgacacgcgccccactgtcagaccacggaatgatgtggcccacaagcagctctcagcttttggagagtatgtggctgaaatcttgcccaagtatgtccaacaagttcaggtgtcctgcttcaatgagttagaggtctgtatccatcctgatggcgtcatcccagtgctgactttcctcagggatcacaccaatgcacagttcaaatctctggttgacttgacagcagtggacgtcccaactcggcaaaaccgttttgagattgtctacaacctgttgtctctgcgcttcaactcacggatccgtgtgaagacctacacagatgagctgacgcccattgagtctgctgtctctgtgttcaaggcagccaactggtatgaaagggagatctgggacatgtttggagtcttctttgctaaccaccctgatctaagaaggatcctgacagattatggcttcgagggacatcctttccggaaagactttcctctatctggctatgttgagttacgttatgatgatgaagtgaagcgggtggtggcagagccggtggagttggcccaagagttccgcaaatttgacctgaacagcccctgggaggctttcccagtctatcgccaacccccggagagtctcaagcttgaagccggagacaagaagcctgatgccaagtagctccagggaacgcatgtggatcctagacagcgccttatctatgattgagtgtccgtgtaaataaattcctacttagacttaaaaaaaaaaaaaaaaaaaaaaaaaaaaaaaaaaacaaaacaaaaaaaaaaaaaaaaaaaaaaaaaaaaaaaaaaaaaaaaaaaaggagggggggccgcgcccaaaaaaaaacctcccccgccgaggagcccccacagacacgcccagcccgcacccattctcttcgttgtcaacaaacagggcggcctcccactaaatgaggcgcgggcgccgatatataatacgacgagccagagcaggcg

SEQ ID NO: 62717 - DNA, 1164 bp, Homo sapiens
tatgggctagtacgggcctggggtcaaatcggcgaggcgtgccttggggctccgtgtcctgctgtctttccgtccgctgcctagtctgcatctgagtaacatggcggcggcggcggtagccaggctgtggtggcgcgggatcttgggggcctcggcgctgaccagggggactgggcgaccctccgttctgttgctgccggtgaggcgggagagcgccggggccgacacgcgccccactgtcagaccacggaatgatgtggcccacaagcagctctcagcttttggagagtatgtggctgaaatcttgcccaagtatgtccaacaagttcaggtgtcctgcttcaatgagttagaggtctgtatccatcctgatggcgtcatcccagtgctgactttcctcagggatcacaccaatgcacagttcaaatctctggttgacttgacagcagtggacgtcccaactcggcaaaaccgttttgagattgtctacaacctgttgtctctgcgcttcaactcacggatccgtgtgaagacctacacagatgagctgacgcccattgagtctgctgtctctgtgttcaaggcagccaactggtatgaaagggagatctgggacatgtttggagtcttctttgctaaccaccctgatctaagaaggatcctgacagattatggcttcgagggacatcctttccggaaagactttcctctatctggctatgttgagttacgttatgatgatgaagtgaagcgggtggtggcagagccggtggagttggcccaagagttccgcaaatttgacctgaacagcccctgggaggctttcccagtctatcgccaacccccggagagtctcaagcttgaagccggagacaagaagcctgatgccaagtagctccagggaacgcatgtggatcctagacagcgccttatctatgattgagtgtccgtgtaaataaattcctacttagacttaaaaaaaacaaaagggggggggcataaaataccgcgggggcaagatagcgatccacctcgtggcaacgggccaggggggtataacgagcgggggggcacacgcgtgggaaccacggtctggaagcacacactcggggcatggcacacaagacagagctaaacgctgtagacagcgagtgacgagagaac

SEQ ID NO: 62718 - DNA, 1015 bp, Homo sapiens
tatgggctagtacgggcctggggtcaaatcggcgaggcgtgccttggggctccgtgtcctgctgtctttccgtccgctgcctagtctgcatctgagtaacatggcggcggcggcggtagccaggctgtggtggcgcgggatcttgggggcctcggcgctgaccagggggactgggcgaccctccgttctgttgctgccggtgaggcgggagagcgccggggccgacacgcgccccactgtcagaccacggaatgatgtggcccacaagcagctctcagcttttggagagtatgtggctgaaatcttgcccaagtatgtccaacaagttcaggtgtcctgcttcaatgagttagaggtctgtatccatcctgatggcgtcatcccagtgctgactttcctcagggatcacaccaatgcacagttcaaatctctggttgacttgacagcagtggacgtcccaactcggcaaaaccgttttgagattgtctacaacctgttgtctctgcgcttcaactcacggatccgtgtgaagacctacacagatgagctgacgcccattgagtctgctgtctctgtgttcaaggcagccaactggtatgaaagggagatctgggacatgtttggagtcttctttgctaaccaccctgatctaagaaggatcctgacagattatggcttcgagggacatcctttccggaaagactttcctctatctggctatgttgagttacgttatgatgatgaagtgaagcgggtggtggcagagccggtggagttggcccaagagttccgcaaatttgacctgaacagcccctgggaggctttcccagtctatcgccaacccccggagagtctcaagcttgaagccggagacaagaagcctgatgccaagtagctccagggaacgcatgtggatcctagacagcgccttatctatgattgagtgtccgtgtaaataaattcctacttagacttaaaaacaaacaccacacaaaaaaccctcaaaaaacagggg

SEQ ID NO: 62719 - DNA, 970 bp, Homo sapiens
gggccaggctgtggtggcgcgagacgttcttcgccgagagtcgtcggggtttcctgcttcaacagtgcttggacggaacccggcgctcgttccccaccccggccggccgcccatagccagccctccgtcacctcttcaccgcaccctcggcgctgaccaggggactgggcgaccctccgttctgttgctgccggtgaggcgggagagcgccggggccgacacgcgccccactgtcagaccacggaatgatgtggcccacaagcagctctcagcttttggagagtatgtggctgaaatcttgcccaagtatgtccaacaagttcaggtgtcctgcttcaatgagttagaggtctgtatccatcctgatggcgtcatcccagtgctgactttcctcagggatcacaccaatgcacagttcaaatctctggttgacttgacagcagtggacgtcccaactcggcaaaaccgttttgagattgtctacaacctgttgtctctgcgcttcaactcacggatccgtgtgaagacctacacagatgagctgacgcccattgagtctgctgtctctgtgttcaaggcagccaactggtatgaaagggagatctgggacatgtttggagtcttctttgctaaccaccctgatctaagaaggatcctgacagattatggcttcgagggacatcctttccggaaagactttcctctatctggctatgttgagttacgttatgatgatgaagtgaagcgggtggtggcagagccggtggagttggcccaagagttccgcaaatttgacctgaacagcccctgggaggctttcccagtctatcgccaacccccggagagtctcaagcttgaagccggagacaagaagcctgatgccaagtagctccagggaacgcatgtggatcctagacagcgccttatctatgattgagtgtccgtgtaaataaattcctacttagactta

SEQ ID NO: 62720 - DNA, 1188 bp, Homo sapiens
tatgggctagtacgggcctggggtcaaatcggcgaggcgtgccttggggctccgtgtcctgctgtctttccgtccgctgcctagtctgcatctgagtaacatggcggcggcggcggtagccaggctgtggtggcgcgggatcttgggggcctcggcgctgaccagggggactgggcgaccctccgttctgttgctgccggtgaggcgggagagcgccggggccgacacgcgccccactgtcagaccacggaatgatgtggcccacaagcagctctcagcttttggagagtatgtggctgaaatcttgcccaagtatgtccaacaagttcaggtaatacttactaatgttatttgggtctgggtcaagaaagaaccatgttcgcagggcatgtgggagtgggcagacttgtttcaaagaaactacagattcctccatcccaagcttggacttttctctcagcattaaaccaggtgactccagctgaagttagctgttccctcagtagctctttgttccctctcccctcactttcatgtgtgcaggtgtcctgcttcaatgagttagaggtctgtatccatcctgatggcgtcatcccagtgctgactttcctcagggatcacaccaatgcacagttcaaatctctggttgacttgacagcagtggacgtcccaactcggcaaaaccgttttgagattgtctacaacctgttgtctctgcgcttcaactcacggatccgtgtgaagacctacacagatgagctgacgcccattgagtctgctgtctctgtgttcaaggcagccaactggtatgaaagggagatctgggacatgtttggagtcttctttgctaaccaccctgatctaagaaggatcctgacagattatggcttcgagggacatcctttccggaaagactttcctctatctggctatgttgagttacgttatgatgatgaagtgaagcgggtggtggcagagccggtggagttggcccaagagttccgcaaatttgacctgaacagcccctgggaggctttcccagtctatcgccaacccccggagagtctcaagcttgaagccggagacaagaagcctgatgccaagtagctccagggaacgcatgtggatcctagacagcgccttatctatgattgagtgtccgtgtaaataaattcctacttagactta

SEQ ID NO: 62721 - DNA, 693 bp, Homo sapiens
tgcggccgctccaacatcagaatggatacagacctctaactcattgaagcaggacacctgaacttgttagaggtctgtatccatcctgatggcgtcatcccagtgctgactttcctcagggatcacaccaatgcacagttcaaatctctggttgacttgacagcagtggacgtcccaactcggcaaaaccgttttgagattgtctacaacctgttgtctctgcgcttcaactcacggatccgtgtgaagacctacacagatgagctgacgcccattgagtctgctgtctctgtgttcaaggcagccaactggtatgaaagggagatctgggacatgtttggagtcttctttgctaaccaccctgatctaagaaggatcctgacagattatggcttcgagggacatcctttccggaaagactttcctctatctggctatgttgagttacgttatgatgatgaagtgaagcgggtggtggcagagccggtggagttggcccaagagttccgcaaatttgacctgaacagcccctgggaggctttcccagtctatcgccaacccccggagagtctcaagcttgaagccggagacaagaagcctgatgccaagtagctccagggaacgcatgtggatcctagacagcgccttatctatgattgagtgtccgtgtaaataaattcctacttagactta

SEQ ID NO: 62722 - DNA, 663 bp, Homo sapiens
tatgggctagtacgggcctggggtcaaatcggcgaggcgtgccttggggctccgtgtcctgctgtctttccgtccgctgcctagtctgcatctgagtaacatggcggcggcggcggtagccaggctgtggtggcgcgggatcttgggggcctcggcgctgaccagggggactgggcgaccctccgttctgttgctgccggtgaggcgggagagcgccggggccgacacgcgccccactgtcagaccacggaatgatgtggcccacaagcagctctcagcttttggagagtatgtggctgaaatcttgcccaagtatgtccaacaagttcaggtgtcctgcttcaatgagttagaggtctgtatccatcctgatggcgtcatcccagtgctgactttcctcagggatcacaccaatgcacagttcaaatctctggttgacttgacagcagtggacgtcccaactcggcaaaaccgttttgagggtgtttatcgatgccaccattcttcaggtggagaaacgctgacagtgaggtcgattctcaccaacagcatttcccttggcccctaggacatggcgttttgaaaaacagttttcctggagttgttggacaagctggttggcagcatgtttagctcctcggtaactgctgaaggtaaagtgaa

SEQ ID NO: 62723 - DNA, 678 bp, Homo sapiens
gattcccgctgcactcaatagacagtctgttataaactcaccatctgtaaaagattttgaagcacggacaattttttcacttattatgtaactgcatttcacagcagcatcacttattttatttgtattcgatgattaatgctgtagaaagtttagtccttttctaagttcattgagtttttcatcatgcatcttttctgtaaactagtcaaaattctcaccatggtttgtttcataatggcatcttcacttgtattcttttgacacagaccaagtttggttacatattaaacacatgggactatacttccacaaagaaatatgcttgctcccacttctcttgaaacacgcggcgctatcaatccatctttcattttcccacttttgatagagacataggaacaaaaagagaattcacttttctttaagagaaacaacagcgcaagcctgatgataaatggtggctggccggtggagttggcccaagagttccgcaaatttgacctgaacagcccctgggaggctttcccagtctatcgccaacccccggagagtctcaagcttgaagccggagacaagaagcctgatgccaagtagctccagggaacgcatgtggatcctagacagcgccttatctatgattgagtgtccgtgtaaataaattcctacttagactta

SEQ ID NO: 62724 - DNA, 617 bp, Homo sapiens
tatgggctagtacgggcctggggtcaaatcggcgaggcgtgccttggggctccgtgtcctgctgtctttccgtccgctgcctagtctgcatctgagtaacatggcggcggcggcggtagccaggctgtggtggcgcgggatcttgggggcctcggcgctgaccaggggtgagcacgggcagccagctgagaccggggtcaggcgcagcggcgtgcccagtgcagagagctcctcagggctcatcccgcgcgtctgtgccttttatctccctgtgcagggactgggcgaccctccgttctgttgctgccggtgaggcgggagagcgccggggccgacacgcgccgtgagtatgtgcgggcagcgctcttctctgaactatcggcggggccccttagatgcctgtccttgccctaggatgcccttccctacgtcctcctggcaaatcttggagatctgacttgcagtggtcttcaccctgcatgcagaatcgagccctccctgtgcccttaggcctgttatggccctgattgttccttgtccatttcaatcatcccctttttgtctgattaaactgtcagctctttgaaagcaagcaatataacctttaggcctcagag

SEQ ID NO: 62725 - DNA, 1086 bp, Homo sapiens
tatgggctagtacgggcctggggtcaaatcggcgaggcgtgccttggggctccgtgtcctgctgtctttccgtccgctgcctagtctgcatctgagtaacatggcggcggcggcggtagccaggctgtggtggcgcgggatcttgggggcctcggcgctgaccaggggtgagcacgggcagccagctgagaccggggtcaggcgcagcggcgtgcccagtgcagagagctcctcagggctcatcccgcgcgtctgtgccttttatctccctgtgcagggactgggcgaccctccgttctgttgctgccggtgaggcgggagagcgccggggccgacacgcgccccactgtcagaccacggaatgatgtggcccacaagcagctctcagcttttggagagtatgtggctgaaatcttgcccaagtatgtccaacaagttcaggtgtcctgcttcaatgagttagaggtctgtatccatcctgatggcgtcatcccagtgctgactttcctcagggatcacaccaatgcacagttcaaatctctggttgacttgacagcagtggacgtcccaactcggcaaaaccgttttgagattgtctacaacctgttgtctctgcgcttcaactcacggatccgtgtgaagacctacacagatgagctgacgcccattgagtctgctgtctctgtgttcaaggcagccaactggtatgaaagggagatctgggacatgtttggagtcttctttgctaaccaccctgatctaagaaggatcctgacagattatggcttcgagggacatcctttccggaaagactttcctctatctggctatgttgagttacgttatgatgatgaagtgaagcgggtggtggcagagccggtggagttggcccaagagttccgcaaatttgacctgaacagcccctgggaggctttcccagtctatcgccaacccccggagagtctcaagcttgaagccggagacaagaagcctgatgccaagtagctccagggaacgcatgtggatcctagacagcgccttatctatgattgagtgtccgtgtaaataaattcctacttagactta

SEQ ID NO: 62726 - DNA, 939 bp, Homo sapiens
tatgggctagtacgggcctggggtcaaatcggcgaggcgtgccttggggctccgtgtcctgctgtctttccgtccgctgcctagtctgcatctgagtaacatggcggcggcggcggtagccaggctgtggtggcgcgggatcttgggggcctcggcgctgaccagggggactgggcgaccctccgttctgttgctgccggtgaggcgggagagcgccggggccgacacgcgccccactgtcagaccacggaatgatgtggcccacaagcagctctcagcttttggagagtatgtggctgaaatcttgcccaagtatgtccaacaagttcaggtgtcctgcttcaatgagttagaggtctgtatccatcctgatggcgtcatcccagtgctgactttcctcagggatcacaccaatgcacagttcaaatctctggttgacttgacagcagtggacgtcccaactcggcaaaaccgttttgagggatccgtgtgaagacctacacagatgagctgacgcccattgagtctgctgtctctgtgttcaaggcagccaactggtatgaaagggagatctgggacatgtttggagtcttctttgctaaccaccctgatctaagaaggatcctgacagattatggcttcgagggacatcctttccggaaagactttcctctatctggctatgttgagttacgttatgatgatgaagtgaagcgggtggtggcagagccggtggagttggcccaagagttccgcaaatttgacctgaacagcccctgggaggctttcccagtctatcgccaacccccggagagtctcaagcttgaagccggagacaagaagcctgatgccaagtagctccagggaacgcatgtggatcctagacagcgccttatctatgattgagtgtccgtgtaaataaattcctacttagactta

SEQ ID NO: 62727 - DNA, 593 bp, Homo sapiens
tatgggctagtacgggcctggggtcaaatcggcgaggcgtgccttggggctccgtgtcctgctgtctttccgtccgctgcctagtctgcatctgagtaacatggcggcggcggcggtagccaggctgtggtggcgcgggatcttgggggcctcggcgctgaccagggggactgggcgaccctccgttctgttgctgccggtgaggcgggagagcgccggggccgacacgcgccccactgtcagaccacggaatgatgtggcccacaagcagctctcagcttttggagagtatgtggctgaaatcttgcccaagtgtcctgcttcaatgagttagaggtctgtatccatcctgatggcgtcatcccagtgctgactttcctcagggatcacaccaatgcacagttcaaatctctggttgacttgacagcagtggacgtcccaactcggcaaaaccgttttgagtgaggtcagttgggagatctgagaaggttttgggggtaaggatattaatttcagtttgtaacatacaatagaacacagcagttaaactggaacttcagagtcaagtagatctgaagttggatcttggttct

SEQ ID NO: 62728 - DNA, 1090 bp, Homo sapiens
ggtgggcaaaggcatcttcctctgggaaggactggcacaagcacttggtccctgggttgtgtgcctgggaggccgggatcagggctggccctctttctccctggcaaagcaaaacctcccttttactactatcaaggggaagtaacttgaaggtgcctgtggcaggcagcaccttgagccaacaggaaccattgacatgcgaggcccagggcaggcagactgtgcagtggccattgggcggcccctcggggaggtggtgaccctccgcgtccttgagagttctctcaactgcagtgcgggggacatgttgctgctttggggccggctcacctggaggaagatgtgcaggaagctgttggacatgactttcagctccaagaccaacacgctggtggtgaggcagcgctgcgggcggccaggaggtggggtgctgctgcggtatgggagccagcttgctcctgaaaccttctacagagaatgtgacatgcagctctttgggccctggggtgaaatcgtgagcccctcgctgagtccagccacgagtaatgcagggggctgccggctcttcattaatgtggctccgcacgcacggattgccatccatgccctggccaccaacatgggcgctgggaccgagggagccaatgccagctacatcttgatccgggacacccacagcttgaggaccacagcgttccatgggcagcaggtgctctactgggagtcagagagcagccaggctgagatggagttcagcgagggcttcctgaaggctcaggccagcctgcggggccagtactggaccctccaatcatgggtaccggagatgcaggaccctcagtcctggaagggaaaggaaggaacctgagggtcattgaacatttgttccgtgtctggccagccctggagggttgacccctggtctcagtgctttccaattcgaactttttccaatcttaggtatctactttagagtcttctccaatgtccaaaaggctagggggttggaggtggggactctggaaaagcagcccccatttcctcgggtaccaataaataaaacatgcaggctgaccggcgtttttttctt

SEQ ID NO: 62729 - DNA, 783 bp, Homo sapiens
caactggcgagaagcagggacaggcctcatacttgggtctttctggcttcagcacgctttccttccacacacgtgtactggcacccactaaatgctgagctctgctcaacgctcggaagaagcaggcccctctttctccctggcaaagcaaaacctcccttttactactatcaaggggaagtaacttgaaggtgcctgtggcaggcagcaccttgagccaacaggaaccattgacatgcgaggcccagggcaggcagactgtgcagtggccattgggcggcccctcggggaggtggtgaccctccgcgtccttgagagttctctcaactgcagtgcgggggacatgttgctgctttggggccggctcacctggaggaagatgtgcaggaagctgttggacatgactttcagctccaagaccaacacgctggtggtgaggcagcgctgcgggcggccaggaggtggggtgctgctgcggtatgggagccagcttgctcctgaaaccttctacagaggtatggccaggccttctccacctcccttgggtgctccagtcctggcagggaggctgggtgggtgctgctggggatggggccagtcccagtggggcagtgggaagatacggagggaactgactgagatggaaggaactggggttggccagtgtcagtctgcacgtgccagggaggggtcacaggatgaatgctatatccctcctttttgggaccgtgcagcaagatggacggatgtgggacatggtccacatcctcagtcagtccctca

SEQ ID NO: 62730 - DNA, 4555 bp, Homo sapiens
caactggcgagaagcagggacaggcctcatacttgggtctttctggcttcagcacgctttccttccacacacgtgtactggcacccactaaatgctgagctctgctcaacgctcggaagaagcaggccctgccttatcatgcgcacactctaggggaaaacaagtaacagcgagtaaacaaaggaacagacgacatcagggtaaagtgatggagagactgcggtgaggccaccagcctccataaggagacaggccttggtgaagtcgctgtgcctcggttctcagtgagttgtcttcaggctttggagccacaggccgtgtcttcttacttgagccctggtgctcccttaaaaggccgccctccttcccctggcttccagaggcagaggcagaggcagaggcgggctgcaggcggcatcctacacctggagctgctggtggccgtgggccccgatgtcttccaggctcaccaggaggacacagagcgctatgtgctcaccaacctcaacatcggggcagaactgcttcgggacccgtccctgggggctcagtttcgggtgcacctggtgaagatggtcattctgacagagcctgagggtgctccaaatatcacagccaacctcacctcgtccctgctgagcgtctgtgggtggagccagaccatcaaccctgaggacgacacggatcctggccatgctgacctggtcctctatatcactaggtttgacctggagttgcctgatggtaaccggcaggtgcggggcgtcacccagctgggcggtgcctgctccccaacctggagctgcctcattaccgaggacactggcttcgacctgggagtcaccattgcccatgagattgggcacagcttcggcctggagcacgacggcgcgcccggcagcggctgcggccccagcggacacgtgatggcttcggacggcgccgcgccccgcgccggcctcgcctggtccccctgcagccgccggcagctgctgagcctgctcagacccgtccctccgtcgccgctccctctgctggccacccacctctgcgccggcaggagccttagtcttggtcccagccaagagccggctcctggtggggggcgcgggccgagaactcctgttcccactcacaaaaggccacgcttccaaacgcttccatcctcgtgcccactcctccgtcccgcctcctcccggtgtacaccccgggactgagccgggcctgagccgggccttgtcgcagcgcaggacgggcgcgctgcgtgtgggacccgccgcggcctcaacccgggtccgcggggcacccgccggatgcgcagcctggcctctactacagcgccaacgagcagtgccgcgtggccttcggccccaaggctgtcgcctgcaccttcgccagggagcacctggtgagtctgccggcggtggcctgggattggctgtgaggtccctccgcatcacccagctcacgtccccccaaacgtgcatggatatgtgccaggccctctcctgccacacagacccgctggaccaaagcagctgcagccgcctcctcgttcctctcctggatgggacagaatgtggcgtggagaagtggtgctccaagggtcgctgccgctccctggtggagctgacccccatagcagcagtgcatgggcgctggtctagctggggtccccgaagtccttgctcccgctcctgcggaggaggtgtggtcaccaggaggcggcagtgcaacaaccccagacctgcctttggggggcgtgcatgtgttggtgctgacctccaggccgagatgtgcaacactcaggcctgcgagaagacccagctggagttcatgtcgcaacagtgcgccaggaccgacggccagccgctgcgctcctcccctggcggcgcctccttctaccactggggtgctgctgtaccacacagccaaggggatgctctgtgcagacacatgtgccgggccattggcgagagcttcatcatgaagcgtggagacagcttcctcgatgggacccggtgtatgccaagtggcccccgggaggacgggaccctgagcctgtgtgtgtcgggcagctgcaggacatttggctgtgatggtaggatggactcccagcaggtatgggacaggtgccaggtgtgtggtggggacaacagcacgtgcagcccacggaagggctctttcacagctggcagagcgagagaatatgtcacgtttctgacagttacccccaacctgaccagtgtctacattgccaaccacaggcctctcttcacacacttggcggtgaggatcggagggcgctatgtcgtggctgggaagatgagcatctcccctaacaccacctacccctccctcctggaggatggtcgtgtcgagtacagagtggccctcaccgaggaccggctgccccgcctggaggagatccgcatctggggacccctccaggaagatgctgacatccaggtgggaggtgtcagagcccagctcatgcacatcagctggtggagcaggcctggccttggagaacgagacctgtgtgccaggggcagatggcctggaggctccagtgactgaggggcctggctccgtagatgagaagctgcctgcccctgagccctgtgtcgggatgtcatgtcctccaggctggggccatctggatgccacctctgcaggggagaaggctccctccccatggggcagcatcaggacgggggctcaagctgcacacgtgtggacccctgcggcagggtcgtgctccgtctcctgcgggcgaggtctgatggagctgcgtttcctgtgcatggactctgccctcagggtgcctgtccaggaagagctgtgtggcctggcaagcaagcctgggagccggcgggaggtctgccaggctgtcccgtgccctgctcggtggcagtacaagctggcggcctgcagcgtgagctgtgggagaggggtcgtgcggaggatcctgtattgtgcccgggcccatggggaggacgatggtgaggagatcctgttggacacccagtgccaggggctgcctcgcccggaaccccaggaggcctgcagcctggagccctgcccacctaggtggaaagtcatgtcccttggcccatgttcggccagctgtggccttggcactgctagacgctcggtggcctgtgtgcagctcgaccaaggccaggacgtggaggtggacgaggcggcctgtgcggcgctggtgcggcccgaggccagtgtcccctgtctcattgccgactgcacctaccgctggcatgttggcacctggatggagtgctctgtttcctgtggggatggcatccagcgccggcgtgacacctgcctcggaccccaggcccaggcgcctgtgccagctgatttctgccagcacttgcccaagccggtgactgtgcgtggctgctgggctgggccctgtgtgggacagggtacgcccagcctggtgccccacgaagaagccgctgctccaggacggaccacagccacccctgctggtgcctccctggagtggtcccaggcccggggcctgctcttctccccggctccccagcctcggcggctcctgcccgggccccaggaaaactcagtgcagtccagtgcctgtggcaggcagcaccttgagccaacaggaaccattgacatgcgaggcccagggcaggcagactgtgcagtggccattgggcggcccctcggggaggtggtgaccctccgcgtccttgagagttctctcaactgcagtgcgggggacatgttgctgctttggggccggctcacctggaggaagatgtgcaggaagctgttggacatgactttcagctccaagaccaacacgctggtggtgaggcagcgctgcgggcggccaggaggtggggtgctgctgcggtatgggagccagcttgctcctgaaaccttctacagagaatgtgacatgcagctctttgggccctggggtgaaatcgtgagcccctcgctgagtccagccacgagtaatgcagggggctgccggctcttcattaatgtggctccgcacgcacggattgccatccatgccctggccaccaacatgggcgctgggaccgagggagccaatgccagctacatcttgatccgggacacccacagcttgaggaccacagcgttccatgggcagcaggtgctctactgggagtcagagagcagccaggctgagatggagttcagcgagggcttcctgaaggctcaggccagcctgcggggccagtactggaccctccaatcatgggtaccggagatgcaggaccctcagtcctggaagggaaaggaaggaacctgagggtcattgaacatttgttccgtgtctggccagccctggagggttgacccctggtctcagtgctttccaattcgaactttttccaatcttaggtatctactttagagtcttctccaatgtccaaaaggctagggggttggaggtggggactctggaaaagcagcccccatttcctcgggtaccaataaataaaacatgcaggctgaccggcgtttttttctt

SEQ ID NO: 62731 - DNA, 448 bp, Homo sapiens
gtgcactgtgctatccccagagcctggtacaggtcagtgttggtgattgcttcccgttatttttgtctttgttgtttttttagagagggtctcactgttggccaggctggagtgctatgttgcccaggctgctctgaaactcctgggctcaagtgatctgcctgcctcaggctcccaaagttttgggtttacaggcatgagctaccgtgcctggccagtgattgcttgctgagcgaaagattatagggatgcaagaagaagttggaaggcttcccaggggaggtggccatgacagtgaccctcagggaacccactggacaaggcctgaagctctttgtctgcaggtttacaggcggtatggcgaggagtatggcaacctcacccgcccagacatcaccttcacctacttccagcctaagccacggcaggcctgggtgtgggccgctgt

SEQ ID NO: 62732 - DNA, 4967 bp, Homo sapiens
gtggagagttgagccagaaccacgatgtctttggcacagcctctcatctgtcagatgggagcggggaccccggagagggagtcagccgaggtcctggcattccttgtgaacccccgtctgtgggtttctggtccagtgtcccttctccagattagatggcttaggcctcctctaagggggtgggcgtgcacatccggagagctgtctggtgtgcaggactgggctgcaggttaccctgaactgcaaccatcttagagcaaggcccagcttgcagcaggaggagctgcaggccgcccaccctagccacggcccctgccctggcaggaagcttccaagagtaaacactgcctaatcgtcccgcccagtagtgagcaggcctgtcccattccatactgaccagattcccagtcaccaaggccccctctcactccgctccactcctcgggctggctctcctgaggatgcaccagcgtcacccccgggcaagatgccctcccctctgtgtggccggaatccttgcctgtggctttctcctgggctgctggggaccctcccatttccagcagagttgtcttcaggctttggagccacaggccgtgtcttcttacttgagccctggtgctcccttaaaaggccgccctccttcccctggcttccagaggcagaggcagaggcagaggcgggctgcaggcggcatcctacacctggagctgctggtggccgtgggccccgatgtcttccaggctcaccaggaggacacagagcgctatgtgctcaccaacctcaacatcggggcagaactgcttcgggacccgtccctgggggctcagtttcgggtgcacctggtgaagatggtcattctgacagagcctgagggtgctccaaatatcacagccaacctcacctcgtccctgctgagcgtctgtgggtggagccagaccatcaaccctgaggacgacacggatcctggccatgctgacctggtcctctatatcactaggtttgacctggagttgcctgatggtaaccggcaggtgcggggcgtcacccagctgggcggtgcctgctccccaacctggagctgcctcattaccgaggacactggcttcgacctgggagtcaccattgcccatgagattgggcacagcttcggcctggagcacgacggcgcgcccggcagcggctgcggccccagcggacacgtgatggcttcggacggcgccgcgccccgcgccggcctcgcctggtccccctgcagccgccggcagctgctgagcctgctcagcgcaggacgggcgcgctgcgtgtgggacccgccgcggcctcaacccgggtccgcggggcacccgccggatgcgcagcctggcctctactacagcgccaacgagcagtgccgcgtggccttcggccccaaggctgtcgcctgcaccttcgccagggagcacctggatatgtgccaggccctctcctgccacacagacccgctggaccaaagcagctgcagccgcctcctcgttcctctcctggatgggacagaatgtggcgtggagaagtggtgctccaagggtcgctgccgctccctggtggagctgacccccatagcagcagtgcatgggcgctggtctagctggggtccccgaagtccttgctcccgctcctgcggaggaggtgtggtcaccaggaggcggcagtgcaacaaccccagacctgcctttggggggcgtgcatgtgttggtgctgacctccaggccgagatgtgcaacactcaggcctgcgagaagacccagctggagttcatgtcgcaacagtgcgccaggaccgacggccagccgctgcgctcctcccctggcggcgcctccttctaccactggggtgctgctgtaccacacagccaaggggatgctctgtgcagacacatgtgccgggccattggcgagagcttcatcatgaagcgtggagacagcttcctcgatgggacccggtgtatgccaagtggcccccgggaggacgggaccctgagcctgtgtgtgtcgggcagctgcaggacatttggctgtgatggtaggatggactcccagcaggtatgggacaggtgccaggtgtgtggtggggacaacagcacgtgcagcccacggaagggctctttcacagctggcagagcgagagaatatgtcacgtttctgacagttacccccaacctgaccagtgtctacattgccaaccacaggcctctcttcacacacttggcggtgaggatcggagggcgctatgtcgtggctgggaagatgagcatctcccctaacaccacctacccctccctcctggaggatggtcgtgtcgagtacagagtggccctcaccgaggaccggctgccccgcctggaggagatccgcatctggggacccctccaggaagatgctgacatccaggtttacaggcggtatggcgaggagtatggcaacctcacccgcccagacatcaccttcacctacttccagcctaagccacggcaggcctgggtgtgggccgctgtgcgtgggccctgctcggtgagctgtggggcagggctgcgctgggtaaactacagctgcctggaccaggccaggaaggagttggtggagactgtccagtgccaagggagccagcagccaccagcgtggccagaggcctgcgtgctcgaaccctgccctccctactgggcggtgggagacttcggcccatgcagcgcctcctgtgggggcggcctgcgggagcggccagtgcgctgcgtggaggcccagggcagcctcctgaagacattgcccccagcccggtgcagagcaggggcccagcagccagctgtggcgctggaaacctgcaacccccagccctgccctgccaggtgggaggtgtcagagcccagctcatgcacatcagctggtggagcaggcctggccttggagaacgagacctgtgtgccaggggcagatggcctggaggctccagtgactgaggggcctggctccgtagatgagaagctgcctgcccctgagccctgtgtcgggatgtcatgtcctccaggctggggccatctggatgccacctctgcaggggagaaggctccctccccatggggcagcatcaggacgggggctcaagctgcacacgtgtggacccctgcggcagggtcgtgctccgtctcctgcgggcgaggtctgatggagctgcgtttcctgtgcatggactctgccctcagggtgcctgtccaggaagagctgtgtggcctggcaagcaagcctgggagccggcgggaggtctgccaggctgtcccgtgccctgctcggtggcagtacaagctggcggcctgcagcgtgagctgtgggagaggggtcgtgcggaggatcctgtattgtgcccgggcccatggggaggacgatggtgaggagatcctgttggacacccagtgccaggggctgcctcgcccggaaccccaggaggcctgcagcctggagccctgcccacctaggtggaaagtcatgtcccttggcccatgttcggccagctgtggccttggcactgctagacgctcggtggcctgtgtgcagctcgaccaaggccaggacgtggaggtggacgaggcggcctgtgcggcgctggtgcggcccgaggccagtgtcccctgtctcattgccgactgcacctaccgctggcatgttggcacctggatggagtgctctgtttcctgtggggatggcatccagcgccggcgtgacacctgcctcggaccccaggcccaggcgcctgtgccagctgatttctgccagcacttgcccaagccggtgactgtgcgtggctgctgggctgggccctgtgtgggacagggtacgcccagcctggtgccccacgaagaagccgctgctccaggacggaccacagccacccctgctggtgcctccctggagtggtcccaggcccggggcctgctcttctccccggctccccagcctcggcggctcctgcccgggccccaggaaaactcagtgcagtccagtgcctgtggcaggcagcaccttgagccaacaggaaccattgacatgcgaggcccagggcaggcagactgtgcagtggccattgggcggcccctcggggaggtggtgaccctccgcgtccttgagagttctctcaactgcagtgcgggggacatgttgctgctttggggccggctcacctggaggaagatgtgcaggaagctgttggacatgactttcagctccaagaccaacacgctggtggtgaggcagcgctgcgggcggccaggaggtggggtgctgctgcggtatgggagccagcttgctcctgaaaccttctacagagaatgtgacatgcagctctttgggccctggggtgaaatcgtgagcccctcgctgagtccagccacgagtaatgcagggggctgccggctcttcattaatgtggctccgcacgcacggattgccatccatgccctggccaccaacatgggcgctgggaccgagggagccaatgccagctacatcttgatccgggacacccacagcttgaggaccacagcgttccatgggcagcaggtgctctactgggagtcagagagcagccaggctgagatggagttcagcgagggcttcctgaaggctcaggccagcctgcggggccagtactggaccctccaatcatgggtaccggagatgcaggaccctcagtcctggaagggaaaggaaggaacctgagggtcattgaacatttgttccgtgtctggccagccctggagggttgacccctggtctcagtgctttccaattcgaactttttccaatcttaggtatctactttagagtcttctccaatgtccaaaaggctagggggttggaggtggggactctggaaaagcagcccccatttcctcgggtaccaataaataaaacatgcaggctgaccggcgtttttttctt

SEQ ID NO: 62733 - DNA, 307 bp, Homo sapiens
aaaagttgacaaaacataaagtatctctagacagcaaggaaataatttcacgagattgctaaattgatgtcaacacctgcagtctaaaatttatacagttcaatatgtgtcatttgatcactggcatgtcaaatatagaacagctatgactttgctggccagtaaattatctagcagtgaaaatcactttttaggagagtcgcaatcaaacattgtttaacgtgggagcctataaagatgcaaattcctgaacaacagtgtctaagaaaagtacattgggtcactctgaacaggtggtatgaacatt

SEQ ID NO: 62734 - DNA, 2494 bp, Homo sapiens
  misc_feature (14)..(14): n is a, c, g, or t
  misc_feature (16)..(16): n is a, c, g, or t
  misc_feature (23)..(23): n is a, c, g, or t
  misc_feature (30)..(30): n is a, c, g, or t
ccccgccacaaccnangctagtncgaggcngggtgtgtaatcggccgagggaagccctggggcgctgccgccgctttccttaaccacaaatcaggccggacaggagagggaggggtgggggacagtgggtgggcattcagactgccagcactttgctatctacagccggggctcccgagcggcagaaagttccggccactctctgccgcttgggttgggcgaagccaggaccgtgccgcgccaccgccaggatatggagctactgtcgccaccgctccgcgacgtagacctgacggcccccgacggctctctctgctcctttgccacaacggacgacttctatgacgacccgtgtttcgactccccggacctgcgcttcttcgaagacctggacccgcgcctgatgcacgtgggcgcgctcctgaaacccgaagagcactcgcacttccccgcggcggtgcacccggccccgggcgcacgtgaggacgagcatgtgcgcgcgcccagcgggcaccaccaggcgggccgctgcctactgtgggcctgcaaggcgtgcaagcgcaagaccaccaacgccgaccgccgcaaggccgccaccatgcgcgagcggcgccgcctgagcaaagtaaatgaggcctttgagacactcaagcgctgcacgtcgagcaatccaaaccagcggttgcccaaggtggagatcctgcgcaacgccatccgctatatcgagggcctgcaggctctgctgcgcgaccaggacgccgcgccccctggcgccgcagccgccttctatgcgccgggcccgctgcccccgggccgcggcggcgagcactacagcggcgactccgacgcgtccagcccgcgctccaactgctccgacggcatgatggactacagcggcccccgagcggcgcccggcggcggaactgctacgaaggcgcctactacaacgaggcgcccagcgaacccaggcccgggaagagtgcggcggtgtcgagcctagactgcctgtccagcatcgtggagcgcatctccaccgagagccctgcggcgcccgccctcctgctggcggacgtgccttctgagtcgcctccgcgcaggcaagaggctgccgcccccagcgagggagagagcagcggcgaccccacccagtcaccggacgccgccccgcagtgccctgcgggtgcgaaccccaacccgatataccaggtgctctgagggggatggtggccgcccacccgcccgagggatggtgcccctagggtccctcgcgcccaaaagattgaacttaaatgcccccctcccaacagcgctttaaaagcgacctctcttgaggtaggagaggcgggagaactgaagtttccgcccccgccccacagggcaaggacacagcgcggttttttccacgcagcacccttctcggagacccattgcgatggccgctccgtgttcctcggtgggccagagctgaaccttgaggggctaggttcagctttctcgcgccctcccccatgggggtgagaccctcgcagacctaagccctgccccgggatgcaccggttatttgggggggcgtgagacccagtgcactccggtcccaaatgtagcaggtgtaaccgtaacccacccccaacccgtttcccggttcaggaccactttttgtaatacttttgtaatctattcctgtaaataagagttgctttgccagagcaggagcccctggggctgtatttatctctgaggcatggtgtgtggtgctacagggaatttgtacgtttataccgcaggcgggcgagccgcgggcgctcgctcaggtgatcaaaataaaggcgctaatttataccgcaaaaaaaaaaaaaaaaaaaactcgaggccattttctcttaaacaaaacaaaactttctaagtacagtcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtggtggggatggaagagcagagggagcatggcccaggggtgttgaggccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcg

SEQ ID NO: 62735 - DNA, 1583 bp, Homo sapiens
  misc_feature (14)..(14): n is a, c, g, or t
  misc_feature (16)..(16): n is a, c, g, or t
  misc_feature (23)..(23): n is a, c, g, or t
  misc_feature (30)..(30): n is a, c, g, or t
ccccgccacaaccnangctagtncgaggcngggtgtgtaatcggccgaggctctgctcctttgccacaacggacgacttctatgacgacccgtgtttcgactccccggacctgcgcttcttcgaagacctggacccgcgcctgatgcacgtgggcgcgctcctgaaacccgaagagcactcgcacttccccgcggcggtgcacccggccccgggcgcacgtgaggacgagcatgtgcgcgcgcccagcgggcaccaccaggcgggccgctgcctactgtgggcctgcaaggcgtgcaagcgcaagaccaccaacgccgaccgccgcaaggccgccaccatgcgcgagcggcgccgcctgagcaaagtaaatgaggcctttgagacactcaagcgctgcacgtcgagcaatccaaaccagcggttgcccaaggtggagatcctgcgcaacgccatccgctatatcgagggcctgcaggctctgctgcgcgaccaggacgccgcgccccctggcgccgcagccgccttctatgcgccgggcccgctgcccccgggccgcggcggcgagcactacagcggcgactccgacgcgtccagcccgcgctccaactgctccgacggcatgatggactacagcggcccccgagcggcgcccggcggcggaactgctacgaaggcgcctactacaacgaggcgcccagcgaacccaggcccgggaagagtgcggcggtgtcgagcctagactgcctgtccagcatcgtggagcgcatctccaccgagagccctgcggcgcccgccctcctgctggcggacgtgccttctgagtcgcctccgcgcaggcaagaggctgccgcccccagcgagggagagagcagcggcgaccccacccagtcaccggacgccgccccgcagtgccctgcgggtgcgaaccccaacccgatataccaggtgctctgagggggatggtggccgcccacccgcccgagggatggtgcccctagggtccctcgcgcccaaaagattgaacttaaatgcccccctcccaacagcgctttaaaagcgacctctcttgaggtaggagaggcgggagaactgaagtttccgcccccgccccacagggcaaggacacagcgcggttttttccacgcagcacccttctcggagacccattgcgatggccgctccgtgttcctcggtgggccagagctgaaccttgaggggctaggttcagctttctcgcgccctcccccatgggggtgagaccctcgcagacctaagccctgccccgggatgcaccggttatttgggggggcgtgagacccagtgcactccggtcccaaatgtagcaggtgtaaccgtaacccacccccaacccgtttcccggttcaggaccactttttgtaatacttttgtaatctattcctgtaaataagagttgctttgccagagcaggagcccctggggctgtatttatctctgaggcatggtgtgtggtgctacagggaatttgtacgtttataccgcaggcgggcgagccgcgggcgctcgctcaggtgatcaaaataaaggcgctaatttataccgc

SEQ ID NO: 62736 - DNA, 1671 bp, Homo sapiens
ttggtgtggggcgcgaggccaaggacgcggttgccggcgcggccgcctgggcatttggagcttacctggtcagccaccgtcttcctgggtacgtagagcgtgacggtcgcccggatcgtgcctcttcttcgtggcatctctttgtccactatatcggatcgagccttctatgacgacccgtgtttcgactccccggacctgcgcttcttcgaagacctggacccgcgcctgatgcacgtgggcgcgctcctgaaacccgaagagcactcgcacttccccgcggcggtgcacccggccccgggcgcacgtgaggacgagcatgtgcgcgcgcccagcgggcaccaccaggcgggccgctgcctactgtgggcctgcaaggcgtgcaagcgcaagaccaccaacgccgaccgccgcaaggccgccaccatgcgcgagcggcgccgcctgagcaaagtaaatgaggcctttgagacactcaagcgctgcacgtcgagcaatccaaaccagcggttgcccaaggtggagatcctgcgcaacgccatccgctatatcgagggcctgcaggctctgctgcgcgaccaggacgccgcgccccctggcgccgcagccgccttctatgcgccgggcccgctgcccccgggccgcggcggcgagcactacagcggcgactccgacgcgtccagcccgcgctccaactgctccgacggcatgatggactacagcggcccccgagcggcgcccggcggcggaactgctacgaaggcgcctactacaacgaggcgcccagcgaacccaggcccgggaagagtgcggcggtgtcgagcctagactgcctgtccagcatcgtggagcgcatctccaccgagagccctgcggcgcccgccctcctgctggcggacgtgccttctgagtcgcctccgcgcaggcaagaggctgccgcccccagcgagggagagagcagcggcgaccccacccagtcaccggacgccgccccgcagtgccctgcgggtgcgaaccccaacccgatataccaggtgctctgagggggatggtggccgcccacccgcccgagggatggtgcccctagggtccctcgcgcccaaaagattgaacttaaatgcccccctcccaacagcgctttaaaagcgacctctcttgaggtaggagaggcgggagaactgaagtttccgcccccgccccacagggcaaggacacagcgcggttttttccacgcagcacccttctcggagacccattgcgatggccgctccgtgttcctcggtgggccagagctgaaccttgaggggctaggttcagctttctcgcgccctcccccatgggggtgagaccctcgcagacctaagccctgccccgggatgcaccggttatttgggggggcgtgagacccagtgcactccggtcccaaatgtagcaggtgtaaccgtaacccacccccaacccgtttcccggttcaggaccactttttgtaatacttttgtaatctattcctgtaaataagagttgctttgccagagcaggagcccctggggctgtatttatctctgaggcatggtgtgtggtgctacagggaatttgtacgtttataccgcaggcgggcgagccgcgggcgctcgctcaggtgatcaaaataaaggcgctaatttataccgc

SEQ ID NO: 62737 - DNA, 687 bp, Homo sapiens
  misc_feature (16)..(16): n is a, c, g, or t
tcctggtatatcgggntggggttcgcacccgcagggcactgcggggcggcgtccggtgactgggatggtggccgcccacccgcccgagggatggtgcccctagggtccctcgcgcccaaaagattgaacttaaatgcccccctcccaacagcgctttaaaagcgacctctcttgaggtaggagaggcgggagaactgaagtttccgcccccgccccacagggcaaggacacagcgcggttttttccacgcagcacccttctcggagacccattgcgatggccgctccgtgttcctcggtgggccagagctgaaccttgaggggctaggttcagctttctcgcgccctcccccatgggggtgagaccctcgcagacctaagccctgccccgggatgcaccggttatttgggggggcgtgagacccagtgcactccggtcccaaatgtagcaggtgtaaccgtaacccacccccaacccgtttcccggttcaggaccactttttgtaatacttttgtaatctattcctgtaaataagagttgctttgccagagcaggagcccctggggctgtatttatctctgaggcatggtgtgtggtgctacagggaatttgtacgtttataccgcaggcgggcgagccgcgggcgctcgctcaggtgatcaaaataaaggcgctaatttataccgc

SEQ ID NO: 62738 - DNA, 1843 bp, Homo sapiens
  misc_feature (14)..(14): n is a, c, g, or t
  misc_feature (16)..(16): n is a, c, g, or t
  misc_feature (23)..(23): n is a, c, g, or t
  misc_feature (30)..(30): n is a, c, g, or t
ccccgccacaaccnangctagtncgaggcngggtgtgtaatcggccgagggaagccctggggcgctgccgccgctttccttaaccacaaatcaggccggacaggagagggaggggtgggggacagtgggtgggcattcagactgccagcactttgctatctacagccggggctcccgagcggcagaaagttccggccactctctgccgcttgggttgggcgaagccaggaccgtgccgcgccaccgccaggatatggagctactgtcgccaccgctccgcgacgtagacctgacggcccccgacggctctctctgctcctttgccacaacggacgacttctatgacgacccgtgtttcgactccccggacctgcgcttcttcgaagacctggacccgcgcctgatgcacgtgggcgcgctcctgaaacccgaagagcactcgcacttccccgcggcggtgcacccggccccgggcgcacgtgaggacgagcatgtgcgcgcgcccagcgggcaccaccaggcgggccgctgcctactgtgggcctgcaaggcgtgcaagcgcaagaccaccaacgccgaccgccgcaaggccgccaccatgcgcgagcggcgccgcctgagcaaagtaaatgaggcctttgagacactcaagcgctgcacgtcgagcaatccaaaccagcggttgcccaaggtggagatcctgcgcaacgccatccgctatatcgagggcctgcaggctctgctgcgcgaccaggacgccgcgccccctggcgccgcagccgccttctatgcgccgggcccgctgcccccgggccgcggcggcgagcactacagcggcgactccgacgcgtccagcccgcgctccaactgctccgacggcatgatggactacagcggcccccgagcggcgcccggcggcggaactgctacgaaggcgcctactacaacgaggcgcccagcgaacccaggcccgggaagagtgcggcggtgtcgagcctagactgcctgtccagcatcgtggagcgcatctccaccgagagccctgcggcgcccgccctcctgctggcggacgtgccttctgagtcgcctccgcgcaggcaagaggctgccgcccccagcgagggagagagcagcggcgaccccacccagtcaccggacgccgccccgcagtgccctgcgggtgcgaaccccaacccgatataccaggtgctctgagggggatggtggccgcccacccgcccgagggatggtgcccctagggtccctcgcgcccaaaagattgaacttaaatgcccccctcccaacagcgctttaaaagcgacctctcttgaggtaggagaggcgggagaactgaagtttccgcccccgccccacagggcaaggacacagcgcggttttttccacgcagcacccttctcggagacccattgcgatggccgctccgtgttcctcggtgggccagagctgaaccttgaggggctaggttcagctttctcgcgccctcccccatgggggtgagaccctcgcagacctaagccctgccccgggatgcaccggttatttgggggggcgtgagacccagtgcactccggtcccaaatgtagcaggtgtaaccgtaacccacccccaacccgtttcccggttcaggaccactttttgtaatacttttgtaatctattcctgtaaataagagttgctttgccagagcaggagcccctggggctgtatttatctctgaggcatggtgtgtggtgctacagggaatttgtacgtttataccgcaggcgggcgagccgcgggcgctcgctcaggtgatcaaaataaaggcgctaatttataccgc

SEQ ID NO: 62739 - DNA, 1411 bp, Homo sapiens
  misc_feature (14)..(14): n is a, c, g, or t
  misc_feature (16)..(16): n is a, c, g, or t
  misc_feature (23)..(23): n is a, c, g, or t
  misc_feature (30)..(30): n is a, c, g, or t
ccccgccacaaccnangctagtncgaggcngggtgtgtaatcggccgagggaagccctggggcgctgccgccgctttccttaaccacaaatcaggccggacaggagagggaggggtgggggacagtgggtgggcattcagactgccagcactttgctatctacagccggggctcccgagcggcagaaagttccggccactctctgccgcttgggttgggcgaagccaggaccgtgccgcgccaccgccaggatatggagctactgtcgccaccgctccgcgacgtagacctgacggcccccgacggctctctctgctcctttgccacaacggacgacttctatgacgacccgtgtttcgactccccggacctgcgcttcttcgaagacctggacccgcgcctgatgcacgtgggcgcgctcctgaaacccgaagagcactcgcacttccccgcggcggtgcacccggccccgggcgcacgtgaggacgagcatgtgcgcgcgcccagcgggcaccaccaggcgggccgctgcctactgtgggcctgcaaggcgtgcaagcgcaagaccaccaacgccgaccgccgcaaggccgccaccatgcgcgagcggcgccgcctgagcaaagtaaatgaggcctttgagacactcaagcgctgcacgtcgagcaatccaaaccagcggttgcccaaggtggagatcctgcgcaacgccatccgctatatcgagggcctgcaggctctgctgcgcgaccaggacgccgcgccccctggcgccgcagccgccttctatgcgccgggcccgctgcccccgggccgcggcggcgagcactacagcggcgactccgacgcgtccagcccgcgctccaactgctccgacggcatgatggactacagcggcccccgagcggcgcccggcggcggaactgctacgaaggcgcctactacaacgaggcgcccagcgaacccaggcccgggaagagtgcggcggtgtcgagcctagactgcctgtccagcatcgtggagcgcatctccaccgagagccctgcggcgcccgccctcctgctggcggacgtgccttctgagtcgcctccgcgcaggcaagaggctgccgcccccagcgagggagagagcagcggcgaccccaacccagtgcactccggtcccaaatgtagcaggtgtaaccgtaacccacccccaacccgtttcccggttcaggaccactttttgtaatacttttgtaatctattcctgtaaataagagttgctttgccagagcaggagcccctggggctgtatttatctctgaggcatggtgtgtggtgctacagggaatttgtacgtttataccgcaggcgggcgagccgcgggcgctcgctcaggtgatcaaaataaaggcgctaatttataccgc

SEQ ID NO: 62740 - DNA, 1729 bp, Homo sapiens
  misc_feature (14)..(14): n is a, c, g, or t
  misc_feature (16)..(16): n is a, c, g, or t
  misc_feature (23)..(23): n is a, c, g, or t
  misc_feature (30)..(30): n is a, c, g, or t
ccccgccacaaccnangctagtncgaggcngggtgtgtaatcggccgagggaagccctggggcgctgccgccgctttccttaaccacaaatcaggccggacaggagagggaggggtgggggacagtgggtgggcattcagactgccagcactttgctatctacagccggggctcccgagcggcagaaagttccggccactctctgccgcttgggttgggcgaagccaggaccgtgccgcgccaccgccaggatatggagctactgtcgccaccgctccgcgacgtagacctgacggcccccgacggctctctctgctcctttgccacaacggacgacttctatgacgacccgtgtttcgactccccggacctgcgcttcttcgaagacctggacccgcgcctgatgcacgtgggcgcgctcctgaaacccgaagagcactcgcacttccccgcggcggtgcacccggccccgggcgcacgtgaggacgagcatcggcgccgcctgagcaaagtaaatgaggcctttgagacactcaagcgctgcacgtcgagcaatccaaaccagcggttgcccaaggtggagatcctgcgcaacgccatccgctatatcgagggcctgcaggctctgctgcgcgaccaggacgccgcgccccctggcgccgcagccgccttctatgcgccgggcccgctgcccccgggccgcggcggcgagcactacagcggcgactccgacgcgtccagcccgcgctccaactgctccgacggcatgatggactacagcggcccccgagcggcgcccggcggcggaactgctacgaaggcgcctactacaacgaggcgcccagcgaacccaggcccgggaagagtgcggcggtgtcgagcctagactgcctgtccagcatcgtggagcgcatctccaccgagagccctgcggcgcccgccctcctgctggcggacgtgccttctgagtcgcctccgcgcaggcaagaggctgccgcccccagcgagggagagagcagcggcgaccccacccagtcaccggacgccgccccgcagtgccctgcgggtgcgaaccccaacccgatataccaggtgctctgagggggatggtggccgcccacccgcccgagggatggtgcccctagggtccctcgcgcccaaaagattgaacttaaatgcccccctcccaacagcgctttaaaagcgacctctcttgaggtaggagaggcgggagaactgaagtttccgcccccgccccacagggcaaggacacagcgcggttttttccacgcagcacccttctcggagacccattgcgatggccgctccgtgttcctcggtgggccagagctgaaccttgaggggctaggttcagctttctcgcgccctcccccatgggggtgagaccctcgcagacctaagccctgccccgggatgcaccggttatttgggggggcgtgagacccagtgcactccggtcccaaatgtagcaggtgtaaccgtaacccacccccaacccgtttcccggttcaggaccactttttgtaatacttttgtaatctattcctgtaaataagagttgctttgccagagcaggagcccctggggctgtatttatctctgaggcatggtgtgtggtgctacagggaatttgtacgtttataccgcaggcgggcgagccgcgggcgctcgctcaggtgatcaaaataaaggcgctaatttataccgc

SEQ ID NO: 62741 - DNA, 3163 bp, Homo sapiens
tgcaatccccagcccccgggcctgtcagaggctgagccattaacgacagagctcggggagagaagctggactgcagctggtttcaggaacttctcttgacgagaagagagaccaaggaggccaagcaggggctgggccagaggtgccaacatggggaaactgaggctcggctcggaaaggtgaagtaacttgtccaagatcacaaagctggtgaacatcaagttggtgctatggcaaggctgggaaactgcagcctgacttgggctgccctgatcatcctgctgctccccggaagtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttgtgaaactggagccccccatgctgcggaccatggaccccagccctgaagcggcccctccccaggcaggctgcctacagctgtgctgggagccatggcagccaggcctgcacataaatcagaagtgtgagctgcgccacaagccgcagcgtggagaagccagctgggcactggtgggccccctccccttggaggcccttcagtatgagctctgcgggctcctcccagccacggcctacaccctgcagatacgctgcatccgctggcccctgcctggccactggagcgactggagccccagcctggagctgagaactaccgaacgggcccccactgtcagactggacacatggtggcggcagaggcagctggaccccaggacagtgcagctgttctggaagccagtgcccctggaggaagacagcggacggatccaaggttatgtggtttcttggagaccctcaggccaggctggggccatcctgcccctctgcaacaccacagagctcagctgcaccttccacctgccttcagaagcccaggaggtggcccttgtggcctataactcagccgggacctctcgtcccaccccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctcaccctgatgaccttgaccccagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttctagggcttcctggggttcccttcttgggcctgcctcttaaaggcctgagctagctggagaagaggggagggtccataagcccatgactaaaaactaccccagcccaggctctcaccatctccagtcaccagcatctccctctcctcccaatctccataggctgggcctcccaggcgatctgcatactttaaggaccagatcatgctccatccagccccacccaatggccttttgtgcttgtttcctataacttcagtattgtaaactagtttttggtttgcagtttttgttgttgtttatagacactcttgggtgtacctgagtctctgttatttatttttcagggcccagcagtcagggggaaacttctcagagttggtcctttcttcctccctcccttccttcctccctcccttccttccccc

SEQ ID NO: 62742 - DNA, 3244 bp, Homo sapiens
tgcaatccccagcccccgggcctgtcagaggctgagccattaacgacagagctcggggagagaagctggactgcagctggtttcaggaacttctcttgacgagaagagagaccaaggaggccaagcaggggctgggccagaggtgccaacatggggaaactgaggctcggctcggaaaggtgaagtaacttgtccaagatcacaaagctggtgaacatcaagttggtgctatggcaaggctgggaaactgcagcctgacttgggctgccctgatcatcctgctgctccccggaagtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttgtgaaactggagccccccatgctgcggaccatggaccccagccctgaagcggcccctccccaggcaggctgcctacagctgtgctgggagccatggcagccaggcctgcacataaatcagaagtgtgagctgcgccacaagccgcagcgtggagaagccagctgggcactggtgggccccctccccttggaggcccttcagtatgagctctgcgggctcctcccagccacggcctacaccctgcagatacgctgcatccgctggcccctgcctggccactggagcgactggagccccagcctggagctgagaactaccgaacgggcccccactgtcagactggacacatggtggcggcagaggcagctggaccccaggacagtgcagctgttctggaagccagtgcccctggaggaagacagcggacggatccaaggttatgtggtttcttggagaccctcaggccaggctggggccatcctgcccctctgcaacaccacagagctcagctgcaccttccacctgccttcagaagcccaggaggtggcccttgtggcctataactcagccgggacctctcgtcccaccccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctcaccctgatgaccttgaccccagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggagctgcccggacccagacagggacagtggctggggcagacatctgaaatgagccgtgctctcaccccacatccttgtgtgcaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttctagggcttcctggggttcccttcttgggcctgcctcttaaaggcctgagctagctggagaagaggggagggtccataagcccatgactaaaaactaccccagcccaggctctcaccatctccagtcaccagcatctccctctcctcccaatctccataggctgggcctcccaggcgatctgcatactttaaggaccagatcatgctccatccagccccacccaatggccttttgtgcttgtttcctataacttcagtattgtaaactagtttttggtttgcagtttttgttgttgtttatagacactcttgggtgtacctgagtctctgttatttatttttcagggcccagcagtcagggggaaacttctcagagttggtcctttcttcctccctcccttccttcctccctcccttccttccccc

SEQ ID NO: 62743 - DNA, 3069 bp, Homo sapiens
tgcaatccccagcccccgggcctgtcagaggctgagccattaacgacagagctcggggagagaagctggactgcagctggtttcaggaacttctcttgacgagaagagagaccaaggaggccaagcaggggctgggccagaggtgccaacatggggaaactgaggctcggctcggaaaggtgaagtaacttgtccaagatcacaaagctggtgaacatcaagttggtgctatggcaaggctgggaaactgcagcctgacttgggctgccctgatcatcctgctgctccccggaagtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttgtgaaactggagccccccatgctgcggaccatggaccccagccctgaagcggcccctccccaggcaggctgcctacagctgtgctgggagccatggcagccaggcctgcacataaatcagaagtgtgagctgcgccacaagccgcagcgtggagaagccagctgggcactggtgggccccctccccttggaggcccttcagtatgagctctgcgggctcctcccagccacggcctacaccctgcagatacgctgcatccgctggcccctgcctggccactggagcgactggagccccagcctggagctgagaactaccgaacgggcccccactgtcagactggacacatggtggcggcagaggcagctggaccccaggacagtgcagctgttctggaagccagtgcccctggaggaagacagcggacggatccaaggttatgtggtttcttggagaccctcaggccaggctggggccatcctgcccctctgcaacaccacagagctcagctgcaccttccacctgccttcagaagcccaggaggtggcccttgtggcctataactcagccgggacctctcgtcccaccccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctcaccctgatgaccttgaccccagcaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttctagggcttcctggggttcccttcttgggcctgcctcttaaaggcctgagctagctggagaagaggggagggtccataagcccatgactaaaaactaccccagcccaggctctcaccatctccagtcaccagcatctccctctcctcccaatctccataggctgggcctcccaggcgatctgcatactttaaggaccagatcatgctccatccagccccacccaatggccttttgtgcttgtttcctataacttcagtattgtaaactagtttttggtttgcagtttttgttgttgtttatagacactcttgggtgtacctgagtctctgttatttatttttcagggcccagcagtcagggggaaacttctcagagttggtcctttcttcctccctcccttccttcctccctcccttccttccccc

SEQ ID NO: 62744 - DNA, 2743 bp, Homo sapiens
tgcaatccccagcccccgggcctgtcagaggctgagccattaacgacagagctcggggagagaagctggactgcagctggtttcaggaacttctcttgacgagaagagagaccaaggaggccaagcaggggctgggccagaggtgccaacatggggaaactgaggctcggctcggaaaggtgaagtaacttgtccaagatcacaaagctggtgaacatcaagttggtgctatggcaaggctgggaaactgcagcctgacttgggctgccctgatcatcctgctgctccccggaagtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttgtgaaactggagccccccatgctgcggaccatggaccccagccctgaagcggcccctccccaggcaggctgcctacagctgtgctgggagccatggcagccaggcctgcacataaatcagaagtgtgagctgcgccacaagccgcagcgtggagaagccagctgggcactggtgggccccctccccttggaggcccttcagtatgagctctgcgggctcctcccagccacggcctacaccctgcagatacgctgcatccgctggcccctgcctggccactggagcgactggagccccagcctggagctgagaactaccgaacgggcccccactgtcagactggacacatggtggcggcagaggcagctggaccccaggacagtgcagctgttctggaagccagtgcccctggaggaagacagcggacggatccaaggttatgtggtttcttggagaccctcaggccaggctggggccatcctgcccctctgcaacaccacagagctcagctgcaccttccacctgccttcagaagcccaggaggtggcccttgtggcctataactcagccgggacctctcgtcccaccccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctcaccctgatgaccttgaccccagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggctgggcctcccaggcgatctgcatactttaaggaccagatcatgctccatccagccccacccaatggccttttgtgcttgtttcctataacttcagtattgtaaactagtttttggtttgcagtttttgttgttgtttatagacactcttgggtgtacctgagtctctgttatttatttttcagggcccagcagtcagggggaaacttctcagagttggtcctttcttcctccctcccttccttcctccctcccttccttccccc

SEQ ID NO: 62745 - DNA, 485 bp, Homo sapiens
tagctggcccgagttgtgggacacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctcaccctgatgaccttgaccccagagggtcggagctacacatatccgaagcagtgcacagggatcctcagagtactag

SEQ ID NO: 62746 - DNA, 625 bp, Homo sapiens
  misc_feature (358)..(358): n is a, c, g, or t
gacaggaagagacacagaggcaaagagacacattcagtcatgctttcagcgtgtttcctaaagcacccactacatgttaggcactgctctaggtactggggatacaaagcatcaaaaatgccctcagaatgttagattcaagtgggggggaaaataagatagaatttcagatagcaataagcagaaaggagaaattaaaggaggagaagggcatagagagagaggggggaaggggagcactggctattttaatatgctggtcaagaaaggcctcactaagagggtgacaattgagcagatccttgaaggaaatgagggagcaagccgctggatatctggagggaggggatccccaaantgggcagacactgagaggaatggagagggaaacacagaactagcgacagacaagaagacactggaagacctagagacagaggcacagaagagggacagagactaagaaaggtgcagctggagacagagaaatggggacacagacccagagacggcaagagacacagaggcaaagagacacattcacgtcatgctttcagcgtgtttcctaaagcacccactactgttagcactgctctaggtactgggacacttgcatcaagaggtc

SEQ ID NO: 62747 - DNA, 3763 bp, Homo sapiens
aagaatgagccagaatagctggagctgagagaccggtataagctggaactgagagggtcaggcaggggccaggccacaggagctattgaaggatttgagtgtttatcctaatgatggcagcaaatactcacatgccagacactgctctaaatgccttccatatgttatcgcatgtaatccttccagcaacactaaggtagggacgatttttatccccattttacagatgagaaaactgaggcacaggaagtcttagaaatataccaggatcatgtaattaataagcaatagaaccagaatttaaacctaggcagtctagttccaacatccacactcatccatcacaccacactgcctttcagagcaataatgtgccattgaagtgctgcgatggagatggggtagcagaatcagatttgaattgtgaaaagattgctgtggctatgggttcttatcactctaatcactgcttgcaccatccttggggagggcactggggagttaacagtctccatctggtggtgtgctggtgctggcttgcaaaaactaattgtgcacatctcttcccaactccccgatcaatgatgtcacatcaataggctgaaatcagctacagtgagagcacttaacaccgcggaaaggcacacactacaaaccagggtctgcttttctctgccaagctggctgataaacggttaccagcacatcactatctctgtgtcacccccgtagcctctcgaagtctccgtccccatccttccatttccagcccccatatcttgaagggtgagacaggaaggtgaggcctctgagtctaggagtacaaaggcctagattatagcccagctctgctaggcagaggcgtcgttcctggcccattctcttccaccccaggtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttgtgaaactggagccccccatgctgcggaccatggaccccagccctgaagcggcccctccccaggcaggctgcctacagctgtgctgggagccatggcagccaggcctgcacataaatcagaagtgtgagctgcgccacaagccgcagcgtggagaagccagctgggcactggtgggccccctccccttggaggcccttcagtatgagctctgcgggctcctcccagccacggcctacaccctgcagatacgctgcatccgctggcccctgcctggccactggagcgactggagccccagcctggagctgagaactaccgaacgggcccccactgtcagactggacacatggtggcggcagaggcagctggaccccaggacagtgcagctgttctggaagccagtgcccctggaggaagacagcggacggatccaaggttatgtggtttcttggagaccctcaggccaggctggggccatcctgcccctctgcaacaccacagagctcagctgcaccttccacctgccttcagaagcccaggaggtggcccttgtggcctataactcagccgggacctctcgtcccaccccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctcaccctgatgaccttgaccccagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttctagggcttcctggggttcccttcttgggcctgcctcttaaaggcctgagctagctggagaagaggggagggtccataagcccatgactaaaaactaccccagcccaggctctcaccatctccagtcaccagcatctccctctcctcccaatctccataggctgggcctcccaggcgatctgcatactttaaggaccagatcatgctccatccagccccacccaatggccttttgtgcttgtttcctataacttcagtattgtaaactagtttttggtttgcagtttttgttgttgtttatagacactcttgggtgtacctgagtctctgttatttatttttcagggcccagcagtcagggggaaacttctcagagttggtcctttcttcctccctcccttccttcctccctcccttccttccccc

SEQ ID NO: 62748 - DNA, 3140 bp, Homo sapiens
tgcaatccccagcccccgggcctgtcagaggctgagccattaacgacagagctcggggagagaagctggactgcagctggtttcaggaacttctcttgacgagaagagagaccaaggaggccaagcaggggctgggccagaggtgccaacggaaaggtgaagtaacttgtccaagatcacaaagctggtgaacatcaagttggtgctatggcaaggctgggaaactgcagcctgacttgggctgccctgatcatcctgctgctccccggaagtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttgtgaaactggagccccccatgctgcggaccatggaccccagccctgaagcggcccctccccaggcaggctgcctacagctgtgctgggagccatggcagccaggcctgcacataaatcagaagtgtgagctgcgccacaagccgcagcgtggagaagccagctgggcactggtgggccccctccccttggaggcccttcagtatgagctctgcgggctcctcccagccacggcctacaccctgcagatacgctgcatccgctggcccctgcctggccactggagcgactggagccccagcctggagctgagaactaccgaacgggcccccactgtcagactggacacatggtggcggcagaggcagctggaccccaggacagtgcagctgttctggaagccagtgcccctggaggaagacagcggacggatccaaggttatgtggtttcttggagaccctcaggccaggctggggccatcctgcccctctgcaacaccacagagctcagctgcaccttccacctgccttcagaagcccaggaggtggcccttgtggcctataactcagccgggacctctcgtcccaccccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctcaccctgatgaccttgaccccagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttctagggcttcctggggttcccttcttgggcctgcctcttaaaggcctgagctagctggagaagaggggagggtccataagcccatgactaaaaactaccccagcccaggctctcaccatctccagtcaccagcatctccctctcctcccaatctccataggctgggcctcccaggcgatctgcatactttaaggaccagatcatgctccatccagccccacccaatggccttttgtgcttgtttcctataacttcagtattgtaaactagtttttggtttgcagtttttgttgttgtttatagacactcttgggtgtacctgagtctctgttatttatttttcagggcccagcagtcagggggaaacttctcagagttggtcctttcttcctccctcccttccttcctccctcccttccttccccc

SEQ ID NO: 62749 - DNA, 3074 bp, Homo sapiens
ggtgatctagaggatcttcagaggcacaaggaggcaagcaggggctggccagaggtgcaacatggggaaactgaggctcggctcggaaaggtgaagtaacttgtccaagatcacaaagctggtgaacatcaagttggtgctatggcaaggctgggaaactgcagcctgacttgggctgccctgatcatcctgctgctccccggaagtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttgtgaaactggagccccccatgctgcggaccatggaccccagccctgaagcggcccctccccaggcaggctgcctacagctgtgctgggagccatggcagccaggcctgcacataaatcagaagtgtgagctgcgccacaagccgcagcgtggagaagccagctgggcactggtgggccccctccccttggaggcccttcagtatgagctctgcgggctcctcccagccacggcctacaccctgcagatacgctgcatccgctggcccctgcctggccactggagcgactggagccccagcctggagctgagaactaccgaacgggcccccactgtcagactggacacatggtggcggcagaggcagctggaccccaggacagtgcagctgttctggaagccagtgcccctggaggaagacagcggacggatccaaggttatgtggtttcttggagaccctcaggccaggctggggccatcctgcccctctgcaacaccacagagctcagctgcaccttccacctgccttcagaagcccaggaggtggcccttgtggcctataactcagccgggacctctcgtcccaccccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctcaccctgatgaccttgaccccagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttctagggcttcctggggttcccttcttgggcctgcctcttaaaggcctgagctagctggagaagaggggagggtccataagcccatgactaaaaactaccccagcccaggctctcaccatctccagtcaccagcatctccctctcctcccaatctccataggctgggcctcccaggcgatctgcatactttaaggaccagatcatgctccatccagccccacccaatggccttttgtgcttgtttcctataacttcagtattgtaaactagtttttggtttgcagtttttgttgttgtttatagacactcttgggtgtacctgagtctctgttatttatttttcagggcccagcagtcagggggaaacttctcagagttggtcctttcttcctccctcccttccttcctccctcccttccttccccc

SEQ ID NO: 62750 - DNA, 3275 bp, Homo sapiens
tgcaatccccagcccccgggcctgtcagaggctgagccattaacgacagagctcggggagagaagctggactgcagctggtttcaggaacttctcttgacgagaagagagaccaaggaggccaagcaggggctgggccagaggtgccaacatggggaaactgaggctcggctcggaaaggtgaagtaacttgtccaagatcacaaagctggtgaacatcaagttggtgctatggcaaggctgggaaactgcagcctgacttgggctgccctgatcatcctgctgctccccggaagtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttgtgaaactggagccccccatgctgcggaccatggaccccagccctgaagcggcccctccccaggcaggctgcctacagctgtgctgggagccatggcagccaggcctgcacataaatcagaagtgtgagctgcgccacaagccgcagcgtggagaagccagctgggcactggtgggccccctccccttggaggcccttcagtatgagctctgcgggctcctcccagccacggcctacaccctgcagatacgctgcatccgctggcccctgcctggccactggagcgactggagccccagcctggagctgagaactaccgaacgggcccccactgtcagactggacacatggtggcggcagaggcagctggaccccaggacagtgcagctgttctggaagccagtgcccctggaggaagacagcggacggatccaaggttatgtggtttcttggagaccctcaggccaggctggggccatcctgcccctctgcaacaccacagagctcagctgcaccttccacctgccttcagaagcccaggaggtggcccttgtggcctataactcagccgggacctctcgtcccaccccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctgtgagtctatcctcagttcccccacagccccagaaggcctggaagggggtgctcagctgccacggaggcagctttaccatccaggcctatgctgaccgtacacccctcccagccgccatcctgaatgcctcctcccgtggctttgtcctccatggcctggagcccgccagtctgtatcacatccacctcatggctgccagccaggctggggccaccaacagtacagtcctcaccctgatgaccttgaccccagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttctagggcttcctggggttcccttcttgggcctgcctcttaaaggcctgagctagctggagaagaggggagggtccataagcccatgactaaaaactaccccagcccaggctctcaccatctccagtcaccagcatctccctctcctcccaatctccataggctgggcctcccaggcgatctgcatactttaaggaccagatcatgctccatccagccccacccaatggccttttgtgcttgtttcctataacttcagtattgtaaactagtttttggtttgcagtttttgttgttgtttatagacactcttgggtgtacctgagtctctgttatttatttttcagggcccagcagtcagggggaaacttctcagagttggtcctttcttcctccctcccttccttcctccctcccttccttccccc

SEQ ID NO: 62751 - DNA, 2079 bp, Homo sapiens
tgcaatccccagcccccgggcctgtcagaggctgagccattaacgacagagctcggggagagaagctggactgcagctggtttcaggaacttctcttgacgagaagagagaccaaggaggccaagcaggggctgggccagaggtgccaacatggggaaactgaggctcggctcggaaaggtgaagtaacttgtccaagatcacaaagctggtgaacatcaagttggtgctatggcaaggctgggaaactgcagcctgacttgggctgccctgatcatcctgctgctccccggaacatcctgcccctctgcaacaccacagagctcagctgcaccttccacctgccttcagaagcccaggaggtggcccttgtggcctataactcagccgggacctctcgtcccaccccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctcaccctgatgaccttgaccccagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttctagggcttcctggggttcccttcttgggcctgcctcttaaaggcctgagctagctggagaagaggggagggtccataagcccatgactaaaaactaccccagcccaggctctcaccatctccagtcaccagcatctccctctcctcccaatctccataggctgggcctcccaggcgatctgcatactttaaggaccagatcatgctccatccagccccacccaatggccttttgtgcttgtttcctataacttcagtattgtaaactagtttttggtttgcagtttttgttgttgtttatagacactcttgggtgtacctgagtctctgttatttatttttcagggcccagcagtcagggggaaacttctcagagttggtcctttcttcctccctcccttccttcctccctcccttccttccccc

SEQ ID NO: 62752 - DNA, 1531 bp, Homo sapiens
tcagcaccatggaggatgtcagcacctggaggatggaacagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctcaccctgatgaccttgaccccagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttctagggcttcctggggttcccttcttgggcctgcctcttaaaggcctgagctagctggagaagaggggagggtccataagcccatgactaaaaactaccccagcccaggctctcaccatctccagtcaccagcatctccctctcctcccaatctccataggctgggcctcccaggcgatctgcatactttaaggaccagatcatgctccatccagccccacccaatggccttttgtgcttgtttcctataacttcagtattgtaaactagtttttggtttgcagtttttgttgttgtttatagacactcttgggtgtacctgagtctctgttatttatttttcagggcccagcagtcagggggaaacttctcagagttggtcctttcttcctccctcccttccttcctccctcccttccttccccc

SEQ ID NO: 62753 - DNA, 1601 bp, Homo sapiens
cgatccgactacgcggctcgatctgactacgcggctcgatctgactacgcggctcgatctgactacgcggctcgatctgactacgcggctcgatctgactacgcggctcgatctgactacgcggctcaatctgactacgcggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctcaccctgatgaccttgaccccagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttctagggcttcctggggttcccttcttgggcctgcctcttaaaggcctgagctagctggagaagaggggagggtccataagcccatgactaaaaactaccccagcccaggctctcaccatctccagtcaccagcatctccctctcctcccaatctccataggctgggcctcccaggcgatctgcatactttaaggaccagatcatgctccatccagccccacccaatggccttttgtgcttgtttcctataacttcagtattgtaaactagtttttggtttgcagtttttgttgttgtttatagacactcttgggtgtacctgagtctctgttatttatttttcagggcccagcagtcagggggaaacttctcagagttggtcctttcttcctccctcccttccttcctccctcccttccttccccc

SEQ ID NO: 62754 - DNA, 1445 bp, Homo sapiens
ggtagactctagaggattctccgtagcacagatcaccggcacaacatgagaccctcttagcaagactatgcccactctcaagatatggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctcaccctgatgaccttgaccccagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttctagggcttcctggggttcccttcttgggcctgcctcttaaaggcctgagctagctggagaagaggggagggtccataagcccatgactaaaaactaccccagcccaggctctcaccatctccagtcaccagcatctccctctcctcccaatctccataggctgggcctcccaggcgatctgcatactttaaggaccagatcatgctccatccagccccacccaatggccttttgtgcttgtttcctataacttcagtattgtaaactagtttttggtttgcagtttttgttgttgtttatagacactcttgggtgtacctgagtctctgttatttatttttcagggcccagcagtcagggggaaacttctcagagttggtcctttcttcctccctcccttccttcctccctcccttccttccccc

SEQ ID NO: 62755 - DNA, 2194 bp, Homo sapiens
tgcaatccccagcccccgggcctgtcagaggctgagccattaacgacagagctcggggagagaagctggactgcagctggtttcaggaacttctcttgacgagaagagagaccaaggaggccaagcaggggctgggccagaggtgccaacatggggaaactgaggctcggctcggaaaggtgaagtaacttgtccaagatcacaaagctggtgaacatcaagttggtgctatggcaaggctgggaaactgcagcctgacttgggctgccctgatcatcctgctgctccccggaagtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttgtgaaactggagccccccatgctgcggaccatggaccccagccctgaagcggcccctccccaggcaggctgcctacagctgtgctgggagccatggcagccaggcctgcacataaatcagaagtgtgagctgcgccacaagccgcagcgtggagaagccagctgggcactggtgggccccctccccttggaggcccttcagtatgagctctgcgggctcctcccagccacggcctacaccctgcagatacgctgcatccgctggcccctgcctggccactggagcgactggagccccagcctggagctgagaactaccgaacgggcccccactgtcagactggacacatggtggcggcagaggcagctggaccccaggacagtgcagctgttctggaagccagtgcccctggaggaagacagcggacggatccaaggttatgtggtttcttggagaccctcaggccaggctggggccatcctgcccctctgcaacaccacagagctcagctgcaccttccacctgccttcagaagcccaggaggtggcccttgtggcctataactcagccgggacctctcgtcccaccccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctctctccactcgggagtggagagagaaggtcctgggcattggcctctggctggaaagtgaggctggtccaagtcccctgttggaacctccaatgccaagctcaagctgagatgcgttccctctaagcccccatactgtggttgagttacttgttattctttgatgataagatctggggaatttccgtgtgctggtggacaggaagccaggcccttgatggctgaaaggaatccagttgtctc

SEQ ID NO: 62756 - DNA, 2223 bp, Homo sapiens
tgcaatccccagcccccgggcctgtcagaggctgagccattaacgacagagctcggggagagaagctggactgcagctggtttcaggaacttctcttgacgagaagagagaccaaggaggccaagcaggggctgggccagaggtgccaacatggggaaactgaggctcggctcggaaaggtgaagtaacttgtccaagatcacaaagctggtgaacatcaagttggtgctatggcaaggctgggaaactgcagcctgacttgggctgccctgatcatcctgctgctccccggaagtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttgtgaaactggagccccccatgctgcggaccatggaccccagccctgaagcggcccctccccaggcaggctgcctacagctgtgctgggagccatggcagccaggcctgcacataaatcagaagtgtgagctgcgccacaagccgcagcgtggagaagccagctgggcactggtgggccccctccccttggaggcccttcagtatgagctctgcgggctcctcccagccacggcctacaccctgcagatacgctgcatccgctggcccctgcctggccactggagcgactggagccccagcctggagctgagaactaccgaacgggcccccactgtcagactggacacatggtggcggcagaggcagctggaccccaggacagtgcagctgttctggaagccagtgcccctggaggaagacagcggacggatccaaggttatgtggtttcttggagaccctcaggccaggctggggccatcctgcccctctgcaacaccacagagctcagctgcaccttccacctgccttcagaagcccaggaggtggcccttgtggcctataactcagccgggacctctcgtcccaccccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctctctccactcccaggccctgcgagtctgtccggagtgacctcgttttgtcagtgagagccagggggctgcctccagcacagggggccaggacctggggcgaggacccactacaccagacagggcctgtacctgcagccaagaggggctgagacccacccagtgtgttctgcgtgtgcacccgcgggcagggctgggcctgggagggtcttggcagtggtgagagcacagcgcctgcctgggctcagcctcagcctcactgctttctctcg

SEQ ID NO: 62757 - DNA, 1030 bp, Homo sapiens
gaaacccgaccacgggccattgtggaactgcctggctctgttgcagcccctatagcaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttctagggcttcctggggttcccttcttgggcctgcctcttaaaggcctgagctagctggagaagaggggagggtccataagcccatgactaaaaactaccccagcccaggctctcaccatctccagtcaccagcatctccctctcctcccaatctccataggctgggcctcccaggcgatctgcatactttaaggaccagatcatgctccatccagccccacccaatggccttttgtgcttgtttcctataacttcagtattgtaaactagtttttggtttgcagtttttgttgttgtttatagacactcttgggtgtacctgagtctctgttatttatttttcagggcccagcagtcagggggaaacttctcagagttggtcctttcttcctccctcccttccttcctccctcccttccttccccc

SEQ ID NO: 62758 - DNA, 1230 bp, Homo sapiens
tgcaatccccagcccccgggcctgtcagaggctgagccattaacgacagagctcggggagagaagctggactgcagctggtttcaggaacttctcttgacgagaagagagaccaaggaggccaagcaggggctgggccagaggtgccaacatggggaaactgaggctcggctcggaaaggtgaagtaacttgtccaagatcacaaagctggtgaacatcaagttggtgctatggcaaggctgggaaactgcagcctgacttgggctgccctgatcatcctgctgctccccggaagtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttgtgaaactggagccccccatgctgcggaccatggaccccagccctgaagcggcccctccccaggcaggctgcctacagctgtgctgggagccatggcagccaggcctgcacataaatcagaagtgtgagctgcgccacaagccgcagcgtggagaagccagctgggcactggtgggccccctccccttggaggcccttcagtatgagctctgcgggctcctcccagccacggcctacaccctgacagcacctaacggcatgtatccccctccaccacagcagcagccaccgccaccaccaccgcagatggggtccctccgcctcctgc

SEQ ID NO: 62759 - DNA, 1373 bp, Homo sapiens
aagaatgagccagaatagctggagctgagagaccggtataagctggaactgagagggtcaggcaggggccaggccacaggagctattgaaggatttgagtgtttatcctaatgatggcagcaaatactcacatgccagacactgctctaaatgccttccatatgttatcgcatgtaatccttccagcaacactaaggtagggacgatttttatccccattttacagatgagaaaactgaggcacaggaagtcttagaaatataccaggatcatgtaattaataagcaatagaaccagaatttaaacctaggcagtctagttccaacatccacactcatccatcacaccacactgcctttcagagcaataatgtgccattgaagtgctgcgatggagatggggtagcagaatcagatttgaattgtgaaaagattgctgtggctatgggttcttatcactctaatcactgcttgcaccatccttggggagggcactggggagttaacagtctccatctggtggtgtgctggtgctggcttgcaaaaactaattgtgcacatctcttcccaactccccgatcaatgatgtcacatcaataggctgaaatcagctacagtgagagcacttaacaccgcggaaaggcacacactacaaaccagggtctgcttttctctgccaagctggctgataaacggttaccagcacatcactatctctgtgtcacccccgtagcctctcgaagtctccgtccccatccttccatttccagcccccatatcttgaagggtgagacaggaaggtgaggcctctgagtctaggagtacaaaggcctagattatagcccagctctgctaggcagaggcgtcgttcctggcccattctcttccaccccaggtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctgtaagtccttccagccatccaactactctgcctccaacaccctcctgccaatactaataagaatattaccagccgggcacgttggctcacgcctgtattcccagcactttgggaggccgaggcaggcggatcacctgaggtcaggagttcatgattcagcctggccagcaaggcgaaacccc

SEQ ID NO: 62760 - DNA, 927 bp, Homo sapiens
tgcaatccccagcccccgggcctgtcagaggctgagccattaacgacagagctcggggagagaagctggactgcagctggtttcaggaacttctcttgacgagaagagagaccaaggaggccaagcaggggctgggccagaggtgccaacatggggaaactgaggctcggctcggaaaggtgaagtaacttgtccaagatcacaaagctggtgaacatcaagttggtgctatggcaaggctgggaaactgcagcctgacttgggctgccctgatcatcctgctgctccccggaagtgagtatggccaaggatgagggtgcagtggggaggggaagctacaaggagagatattgggaatttccttgcactgccacatggctcctgggattcccagagaatcccacaagattcaagtctgagccacagatgtggggtagctggtctcccacccacagacttccacaggcaaaccaccacccaagaggaatggtgagacgacccgggctggtcatcctggaaaaggccagtgaggcgcagatcttgtccgcaaatctctaccaagctgtcagaagcaacccatgggtcctatgcagccttggtgggcagcaaagggatcaggatggaagctacaaggggacaggtttcatcctgaaataaagaagcccaggcagagcttggtttccaaccatggaaactctgtcttgagaggtagagaacttcccatccccaggggtatgcaagctaaagccaggattgataaagatgctgtgcagcaggggttggcaaactttttctgacagtaatgtttaggctttgcaggccacatactgtctctgttccttgtttgtttgtttgtttgtttgtttgttcgtttgtgagacagggtctccactccagcctgagtgacagagcaagaacttgaagaaa

SEQ ID NO: 62761 - DNA, 295 bp, Homo sapiens
ctcagaatgttagattcaagtgggggggaaaataagatagaatttcagatagcaataagcagaaaggagaaattaaaggaggagaagggcatagagagagaggggggaaggggagcactggctattttaatatgctggtcaagaaaggcctcactaagagggtgacaattgagcagatccttgaaggaaatgagggagcaagccgctggatatctggagggaaaacatttcaagcagaagtaacaaccagtgcaaaggccctggggcaagagcggaaacagagacctagagagaa

SEQ ID NO: 62762 - DNA, 485 bp, Homo sapiens
catgaacctgtagtcccagctactcaggaggctgaggtgggaagatcacttgagcctaggaggtcaagggtgcactgagccgtgatcgtgccactgcactccagcctgagtgacagagcaagaacttgaagaaaaaaaagaaaagaaaaagaaaaccaaaacaaaacaacaacaacaaaaaaaaaaaaacagcagggacaaagatccagagattagaaagattttggagttttcaaagaatagcaagaatgagccagaatagctggagctgagagaccggtataagctggaactgagagggtcaggcaggggccaggccacaggagctattgaaggatttgagtgtttatcctaatgatggcagcaaatactcacatgccagacactgctctaaatgccttccatatgttatcgcatgtaatccttccagcaacactaaggtagggacgatttttatccccattttacagatgagaaaactgagg

SEQ ID NO: 62763 - DNA, 408 bp, Homo sapiens
ggccctagaatggcccagcgatccaaggctcagagtcctgtccacccctcaccaggtgggccccctccccttggaggcccttcagtatgagctctgcgggctcctcccagccacggcctacaccctgcagatacgctgcatccgctggcccctgcctggccactggagcgactggagccccagcctggagctgagaactaccgaacggggtaaggaggtgatgagaggctgggagcagccaacagtatccagtccaggccccaggcccctccccaactggcaccccctcttcttgttccatccacagcccccactgtcagactggacacatggtggcggcagaggcagctggaccccaggacagtgcagctgttctggaaggtgactccctctgaaggccatccctcc

SEQ ID NO: 62764 - DNA, 397 bp, Homo sapiens
gagtggagagagaacggggagtgggagagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccaacccatcgctgggtcaatagtacttgccgcagaactcttaaaactaggcggctatggtataatacgcctcacactcattctc

SEQ ID NO: 62765 - DNA, 2974 bp, Homo sapiens
tgcaatccccagcccccgggcctgtcagaggctgagccattaacgacagagctcggggagagaagctggactgcagctggtttcaggaacttctcttgacgagaagagagaccaaggaggccaagcaggggctgggccagaggtgccaacatggggaaactgaggctcggctcggaaaggtgaagtaacttgtccaagatcacaaagctggtgaacatcaagttggtgctatggcaaggctgggaaactgcagcctgacttgggctgccctgatcatcctgctgctccccggaagtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttgtgaaactggagccccccatgctgcggaccatggaccccagccctgaagcggcccctccccaggcaggctgcctacagctgtgctgggagccatggcagccaggcctgcacataaatcagaagtgtgagctgcgccacaagccgcagcgtggagaagccagctgggcactggtgggccccctccccttggaggcccttcagtatgagctctgcgggctcctcccagccacggcctacaccctgcagatacgctgcatccgctggcccctgcctggccactggagcgacatcctgcccctctgcaacaccacagagctcagctgcaccttccacctgccttcagaagcccaggaggtggcccttgtggcctataactcagccgggacctctcgtcccaccccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctcaccctgatgaccttgaccccagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttctagggcttcctggggttcccttcttgggcctgcctcttaaaggcctgagctagctggagaagaggggagggtccataagcccatgactaaaaactaccccagcccaggctctcaccatctccagtcaccagcatctccctctcctcccaatctccataggctgggcctcccaggcgatctgcatactttaaggaccagatcatgctccatccagccccacccaatggccttttgtgcttgtttcctataacttcagtattgtaaactagtttttggtttgcagtttttgttgttgtttatagacactcttgggtgtacctgagtctctgttatttatttttcagggcccagcagtcagggggaaacttctcagagttggtcctttcttcctccctcccttccttcctccctcccttccttccccc

SEQ ID NO: 62766 - DNA, 2597 bp, Homo sapiens
ggcgggccggagctcacagcctcggcacacagctcggtttctgcctggagctgctcctgcagctgcaatttctctgccatgagctgagactgcagcgtctccatccctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttgtgaaactggagccccccatgctgcggaccatggaccccagccctgaagcggcccctccccaggcaggctgcctacagctgtgctgggagccatggcagccaggcctgcacataaatcagaagtgtgagctgcgccacaagccgcagcgtggagaagccagctgggcactggtgggccccctccccttggaggcccttcagtatgagctctgcgggctcctcccagccacggcctacaccctgcagatacgctgcatccgctggcccctgcctggccactggagcgactggagccccagcctggagctgagaactaccgaacgggcccccactgtcagactggacacatggtggcggcagaggcagctggaccccaggacagtgcagctgttctggaagccagtgcccctggaggaagacagcggacggatccaaggttatgtggtttcttggagaccctcaggccaggctggggccatcctgcccctctgcaacaccacagagctcagctgcaccttccacctgccttcagaagcccaggaggtggcccttgtggcctataactcagccgggacctctcgtcccaccccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctcaccctgatgaccttgaccccagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttctagggcttcctggggttcccttcttgggcctgcctcttaaaggcctgagctagctggagaagaggggagggtccataagcccatgactaaaaactaccccagcccaggctctcaccatctccagtcaccagcatctccctctcctcccaatctccataggctgggcctcccaggcgatctgcatactttaaggaccagatcatgctccatccagccccacccaatggccttttgtgcttgtttcctataacttcagtattgtaaactagtttttggtttgcagtttttgttgttgtttatagacactcttgggtgtacctgagtctctgttatttatttttcagggcccagcagtcagggggaaacttctcagagttggtcctttcttcctccctcccttccttcctccctcccttccttccccc

SEQ ID NO: 62767 - DNA, 3332 bp, Homo sapiens
tgcaatccccagcccccgggcctgtcagaggctgagccattaacgacagagctcggggagagaagctggactgcagctggtttcaggaacttctcttgacgagaagagagaccaaggaggccaagcaggggctgggccagaggtgccaacatggggaaactgaggctcggctcggaaaggtgaagtaacttgtccaagatcacaaagctggtgaacatcaagttggtgctatggcaaggctgggaaactgcagcctgacttgggctgccctgatcatcctgctgctccccggaagtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttgtgaaactggagccccccatgctgcggaccatggaccccagccctgaagcggcccctccccaggcaggctgcctacagctgtgctgggagccatggcagccaggcctgcacataaatcagaagtgtgagctgcgccacaagccgcagcgtggagaagccagctgggcactggtgggccccctccccttggaggcccttcagtatgagctctgcgggctcctcccagccacggcctacaccctgcagatacgctgcatccgctggcccctgcctggccactggagcgactggagccccagcctggagctgagaactaccgaacgggcccccactgtcagactggacacatggtggcggcagaggcagctggaccccaggacagtgcagctgttctggaagccagtgcccctggaggaagacagcggacggatccaaggttatgtggtttcttggagaccctcaggccaggctggggccatcctgcccctctgcaacaccacagagctcagctgcaccttccacctgccttcagaagcccaggaggtggcccttgtggcctataactcagccgggacctctcgtcccaccccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctcaccctgatgaccttgaccccagtaaggggagacgggggctgggcagagatggctgtttggagggtaccccacccaaaggatgctgattttgagagtagctggggactgactttgaatcccctggtcggagggaggagacccagccttcccaacatgcattctaacttcttccggccctgccctcactgcagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttctagggcttcctggggttcccttcttgggcctgcctcttaaaggcctgagctagctggagaagaggggagggtccataagcccatgactaaaaactaccccagcccaggctctcaccatctccagtcaccagcatctccctctcctcccaatctccataggctgggcctcccaggcgatctgcatactttaaggaccagatcatgctccatccagccccacccaatggccttttgtgcttgtttcctataacttcagtattgtaaactagtttttggtttgcagtttttgttgttgtttatagacactcttgggtgtacctgagtctctgttatttatttttcagggcccagcagtcagggggaaacttctcagagttggtcctttcttcctccctcccttccttcctccctcccttccttccccc

SEQ ID NO: 62768 - DNA, 1500 bp, Homo sapiens
tagctggcccgagttgtgggacacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctcaccctgatgaccttgaccccagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttctagggcttcctggggttcccttcttgggcctgcctcttaaaggcctgagctagctggagaagaggggagggtccataagcccatgactaaaaactaccccagcccaggctctcaccatctccagtcaccagcatctccctctcctcccaatctccataggctgggcctcccaggcgatctgcatactttaaggaccagatcatgctccatccagccccacccaatggccttttgtgcttgtttcctataacttcagtattgtaaactagtttttggtttgcagtttttgttgttgtttatagacactcttgggtgtacctgagtctctgttatttatttttcagggcccagcagtcagggggaaacttctcagagttggtcctttcttcctccctcccttccttcctccctcccttccttccccc

SEQ ID NO: 62769 - DNA, 1519 bp, Homo sapiens
gagtggagagagaacggggagtgggagagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctcaccctgatgaccttgaccccagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttctagggcttcctggggttcccttcttgggcctgcctcttaaaggcctgagctagctggagaagaggggagggtccataagcccatgactaaaaactaccccagcccaggctctcaccatctccagtcaccagcatctccctctcctcccaatctccataggctgggcctcccaggcgatctgcatactttaaggaccagatcatgctccatccagccccacccaatggccttttgtgcttgtttcctataacttcagtattgtaaactagtttttggtttgcagtttttgttgttgtttatagacactcttgggtgtacctgagtctctgttatttatttttcagggcccagcagtcagggggaaacttctcagagttggtcctttcttcctccctcccttccttcctccctcccttccttccccc

SEQ ID NO: 62770 - DNA, 2108 bp, Homo sapiens
tgcaatccccagcccccgggcctgtcagaggctgagccattaacgacagagctcggggagagaagctggactgcagctggtttcaggaacttctcttgacgagaagagagaccaaggaggccaagcaggggctgggccagaggtgccaacatggggaaactgaggctcggctcggaaaggtgaagtaacttgtccaagatcacaaagctggtgaacatcaagttggtgctatggcaaggctgggaaactgcagcctgacttgggctgccctgatcatcctgctgctccccggaagtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttgtgaaactggagccccccatgctgcggaccatggaccccagccctgaagcggcccctccccaggcaggctgcctacagctgtgctgggagccatggcagccaggcctgcacataaatcagaagtgtgagctgcgccacaagccgcagcgtggagaagccagctgggcactggtgggccccctccccttggaggcccttcagtatgagctctgcgggctcctcccagccacggcctacaccctgcagatacgctgcatccgctggcccctgcctggccactggagcgactggagccccagcctggagctgagaactaccgaacgggcccccactgtcagactggacacatggtggcggcagaggcagctggaccccaggacagtgcagctgttctggaagccagtgcccctggaggaagacagcggacggatccaaggttatgtggtttcttggagaccctcaggccaggctggggccatcctgcccctctgcaacaccacagagctcagctgcaccttccacctgccttcagaagcccaggaggtggcccttgtggcctataactcagccgggacctctcgtcccaccccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctctgtagttggccaggcctctggagttggggagttggg

SEQ ID NO: 62771 - DNA, 1383 bp, Homo sapiens
gtaaagctgcctccgtggcagctgagcacccccttccagcccttctgggtctgtgggggaactgaggatagactcacagaaggactggttctgagcgttggtccagaagatggtgtagtgggtaagggggctcttccccagctcataaggggagacgggggctgggcagagatggctgtttggagggtaccccacccaaaggatgctgattttgagagtagctggggactgactttgaatcccctggtcggagggaggagacccagccttcccaacatgcattctaacttcttccggccctgccctcactgcagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttctagggcttcctggggttcccttcttgggcctgcctcttaaaggcctgagctagctggagaagaggggagggtccataagcccatgactaaaaactaccccagcccaggctctcaccatctccagtcaccagcatctccctctcctcccaatctccataggctgggcctcccaggcgatctgcatactttaaggaccagatcatgctccatccagccccacccaatggccttttgtgcttgtttcctataacttcagtattgtaaactagtttttggtttgcagtttttgttgttgtttatagacactcttgggtgtacctgagtctctgttatttatttttcagggcccagcagtcagggggaaacttctcagagttggtcctttcttcctccctcccttccttcctccctcccttccttccccc

SEQ ID NO: 62772 - DNA, 2048 bp, Homo sapiens
tgcaatccccagcccccgggcctgtcagaggctgagccattaacgacagagctcggggagagaagctggactgcagctggtttcaggaacttctcttgacgagaagagagaccaaggaggccaagcaggggctgggccagaggtgccaacatggggaaactgaggctcggctcggaaaggtgaagtaacttgtccaagatcacaaagctggtgaacatcaagttggtgctatggcaaggctgggaaactgcagcctgacttgggctgccctgatcatcctgctgctccccggaagtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttgtgaaactggagccccccatgctgcggaccatggaccccagccctgaagcggcccctccccaggcaggctgcctacagctgtgctgggagccatggcagccaggcctgcacataaatcagaagtgtgagctgcgccacaagccgcagcgtggagaagccagctgggcactggtgggccccctccccttggaggcccttcagtatgagctctgcgggctcctcccagccacggcctacaccctgcagatacgctgcatccgctggcccctgcctggccactggagcgactggagccccagcctggagctgagaactaccgaacgggcccccactgtcagactggacacatggtggcggcagaggcagctggaccccaggacagtgcagctgttctggaagccagtgcccctggaggaagacagcggacggatccaaggttatgtggtttcttggagaccctcaggccaggctggggccatcctgcccctctgcaacaccacagagctcagctgcaccttccacctgccttcagaagcccaggaggtggcccttgtggcctataactcagccgggacctctcgtcccaccccggtggtcttctcagaaagcagaggcccagctctgaccagactccatgccatggcccgagaccctcacagcctctgggtaggctgggagccccccaatccatggcctcagggctatgtgatttgacgttgggtggcctgtgtgcccccccccaagctgccggacgccaaaattaaggccaaaccaaaaggaacccccttggtgcaagggggacttgggaaacaccaatggacacacttgcggtggaacggaaggccccaacacgggctgggtgtatttacattaggcccttcgaaaacgcggggaccgaacaaccgactttcaagggacccccatttttttccaaaggccttccctaatcaggaagaattcccattcaggtgtggaaaccttcccccctttagtttaaacccacacgttggaaaccacgcgcccaatgttgggggggaaaccccccttacgaccccaagggaccaattgggttcccgttaaatttggccccttaaatcgttcctgtccaacagggcacacaattgggggcctccccctttcccccac

SEQ ID NO: 62773 - DNA, 1048 bp, Homo sapiens
tgcaatccccagcccccgggcctgtcagaggctgagccattaacgacagagctcggggagagaagctggactgcagctggtttcaggaacttctcttgacgagaagagagaccaaggaggccaagcaggggctgggccagaggtgccaacatggggaaactgaggctcggctcggaaaggtgaagtaacttgtccaagatcacaaagctggtgaacatcaagttggtgctatggcaaggctgggaaactgcagcctgacttgggctgccctgatcatcctgctgctccccggaagtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttggtgggtgatgcaggggagggaggggatccccaaaatgggcagacactgagaggaatggagagggaaacacagaactagcgacagacaagaagacactggaagacctagagacagaggcacagaagagggacagagacaaagaaag

SEQ ID NO: 62774 - DNA, 901 bp, Homo sapiens
caggcagctggagggaaggaagcgatggcggaggagcgggagcctgaattgtacctgaagtggaagcactgcgagacgccaggcgtgaagaccctgtgtaatctgaagcactgcgagacgccaggagtgaagaccctgtgtaatctgaagaaacttctgaatcggcttcagaaagaccaccgggaggacgtctacctctacatctctggacacctgaaccccaacaagctctaccagcctccggagacgatcttacagcactggcccaatgcccaccggcccaagggggagcgcgcctctgaggtgggagagccgcccgcagggaaggtggcgaggatgaaggaggccctggcccacttcaccatccacacggccctggtccccagtgaggcccaggacaccccgctgttcaggtacctgaacccccaggcctctctttcccacacttcagaggaggatttccttccagtggaggctgtcagagaggggaaggaagaaaagaaaggaggccctcctggacggggccctcctggatggcgcaggagggaagaactccggctgcccgacttgaaggtgctgtgctaccaggaggccgggtccagaggcaccagggaccggcaccactatgtcagctcctacctggccggagccaccagcgcagacaggtacaggatgttcctgcgtttccagaaggaagtgctcgccaagcaagatctcctgaagaatgacttcactgggagcaaggcggccgcgggccacgagagaaagctgcagcaggagctccagaaaaattgttgcacgttgcgcccccagagttcacagactggccgtctttggcacagttctcgacagattttgggacagtcttggaatggggagccctgaacaagtaggcagaatg

SEQ ID NO: 62775 - DNA, 1113 bp, Homo sapiens
agcgtggggttggagtctccggaagcctgaagaggaggaggaggaggagggacgaagcggcaggttgcaggctgttcagagggtgattttaaaaagccgcacttcagagcattccctggcatgctgcctttccgcgctcctataaatgaccacaaagctcagcgcgtccacattcatcaagtcagaagtcctttattttgtctctgtgaccctgaaggctggtgctattaatgtgatttacgcatgggagtctgtggggagtgtacctgaagtggaagcactgcgagacgccaggcgtgaagaccctgtgtaatctgaagcactgcgagacgccaggagtgaagaccctgtgtaatctgaagaaacttctgaatcggcttcagaaagaccaccgggaggacgtctacctctacatctctggacacctgaaccccaacaagctctaccagcctccggagacgatcttacagcactggcccaatgcccaccggcccaagggggagcgcgcctctgaggtgggagagccgcccgcagggaaggtggcgaggatgaaggaggccctggcccacttcaccatccacacggccctggtccccagtgaggcccaggacaccccgctgttcaggtacctgaacccccaggcctctctttcccacacttcagaggaggatttccttccagtggaggctgtcagagaggggaaggaagaaaagaaaggaggccctcctggacggggccctcctggatggcgcaggagggaagaactccggctgcccgacttgaaggtgctgtgctaccaggaggccgggtccagaggcaccagggaccggcaccactatgtcagctcctacctggccggagccaccagcgcagacaggtacaggatgttcctgcgtttccagaaggaagtgctcgccaagcaagatctcctgaagaatgacttcactgggagcaaggcggccgcgggccacgagagaaagctgcagcaggagctccagaaaaattgttgcacgttgcgcccccagagttcacagactggccgtctttggcacagttctcgacagattttgggacagtcttggaatggggagccctgaacaagtaggcagaatg

SEQ ID NO: 62776 - DNA, 707 bp, Homo sapiens
ataaggtcatcttttttccatgatgagtgtaacatctttgccccatcctgggattcaggagcctctggaatgtctatggagacagagtctcatacaagtgaatgtttttagttccattttggaaaaatgcaaagataagaatctctgaaagttaccagtatcaaacacattatttacacattatttacaatgcaccattggtggtgagtagaattccccgtgttaggtttactaagtcctggagaaaactgctctgagattggcagtgctatggaaaattacaacatctgcaatttataaagatggtccgcccatctagactaataatgacattggaaaatgctgtgatgtgtgagacaagaagcatctggtgtgtgacaaacacaaatacatcacatatcgagaaagaaggaggtgacacagcttgaagacctcccacgccagagctgaaagcctgagtcaactgccagtggtgttttgaatcattttttaaatagactatgctacaagaaaatcttacttcttccaaacagtgtgatattgctactttcattaaatgaatgtcctttttgtgtgttttgtggtagaagtggttaaggcagtggtgttcagtctttgggcttccctgggccacactggaaaaaagaagaattgtcttgggctacacataaaatactctaacgatcgctggtgagctaaaaaaaaaa

SEQ ID NO: 62777 - DNA, 509 bp, Homo sapiens
taatttatttacataactacagaatcctttaacatcttatggaaatgggattggattttagaagatagtaatgatggtgggaagttgttctggaaggttttaggaaacactgtagtattataaggatttcttctgaacttgtgttggtctctggtcatcgttgtggagaacagaatccacagagtagctagattaagcacaaaagaatgcattgaggtatatagatagatcacagaattgtcgggacaggctgaagaaacagggctgcgggtgggagcttcttgatagtctgcagaactggtctgccaagagagctgttgcctatgccaccatcgagaagcttctcccacaactgcctctgccagattgggaagccactgggtccacagttgtgtgtctctatcctagcaggaagtggggctgggcagtttgttttcagtcctattttaggaaggagggactttacactaaggtgaactatcaaatgtggagagaatgtctaaaagacg

SEQ ID NO: 62778 - DNA, 213 bp, Homo sapiens
ttgttatgtgagagaaataacccaatatagtaaggctatcatcagcagattccattacatgtggccaagtgcaattcctaatcaatgctcttgatctctacatttcctcatcttccactcactctcaagccatgtcattctggcttctggcctgtcattccactgagctcactgatgatctacatgttgtgaaatccaggagacatttttagg

SEQ ID NO: 62779 - DNA, 485 bp, Homo sapiens
agtagcacagagctgaaggctttttgaaccaggagtctgggttgtggcttgggtcgcagtaagggcttagcctatcaatgcagaattcacattgaaaaagactttcctctcttgtcccaacacaaaaaagcaagccaagatctgatgcccatatcactgcctcctctgacttgggctacaggagtttcctgaaggaaaccaaattttacatctctgtcacattccagatcaccttagaggccacgctcccaagattagttatcaccctggcagtatgaatacttccctaaggcctcccatccatggaggggaagagtgggaaccagctgttacactcagcatctactgagcactgatgggagccctgcctgggccatgtgctgtggggccaaatggacatcactccctaacttcttgaggtctgtctcctctgtggattcacgcatgtatcaacctcattaaactatgccaaacttttacctcct

SEQ ID NO: 62780 - DNA, 1698 bp, Homo sapiens
gattgggggaatgcaggaaaaaccccatccctccctacagagcctcagcagtgacagctacttcccggatgagaagggcggccgtgaagccagcagggaagccagccccacagccaagggccccccagcctcctcacagctccccatagcctggacctgccggccctccctccaggaccgaggggctcccaagggaaactcaggcgtgtgctggtcccaatgtcagtgaaacccagctgggggcctggcccctcggagggggtcaccgcagtgcctaccagtgaccttggagagatccacaactggaccgagctgcttgacctcttcaaccacactttgtctgagtgccacgtggagctcagccagagcaccaagcgcgtggtcctctttgccctctacctggccatgtttgtggttgggctggtggagaacctcctggtgatatgcgtcaactggcgcggctcaggccgggcagggctgatgaacctctacatcctcaacatggccatcgcggacctgggcattgtcctgtctctgcccgtgtggatgctggaggtcacgctggactacacctggctctggggcagcttctcctgccgcttcactcactacttctactttgtcaacatgtatagcagcatcttcttcctggtgtgcctcagtgtcgaccgctatgtcaccctcaccagcgcctccccctcctggcagcgttaccagcaccgagtgcggcgggccatgtgtgcaggcatctgggtcctctcggccatcatcccgctgcctgaggtggtccacatccagctggtggagggccctgagcccatgtgcctcttcatggcaccttttgaaacgtacagcacctgggccctggcggtggccctgtccaccaccatcctgggcttcctgctgcccttccctctcatcacagtcttcaatgtgctgacagcctgccggctgcggcagccaggacaacccaagagccggcgccactgcttgctgctgtgcgcctacgtggccgtctttgtcatgtgctggctgccctatcatgtgaccctgctgctgctcacactgcatgggacccacatctccctccactgccacctggtccacctgctctacttcttctatgatgtcattgactgcttctccatgctgcactgtgtcatcaaccccatcctttacaactttctcagcccacacttccggggccggctcctgaatgctgtagtccattaccttcctaaggaccagaccaaggcgggcacatgcgcctcctcttcctcctgttccacccagcattccatcatcatcaccaagggtgatagccagcctgctgcagcagccccccaccctgagccaagcctgagctttcaggcacaccatttgcttccaaatacttcccccatctctcccactcagcctcttacacccagctgaggtagaggccagactcctccaacagtgaaggaaaaggcacaggtgagagtataggtgggagatttggggggatgtagaggggagggtcaaagcactcgtggtcaattttgaatctatcttaaaatactgaggtgtggagagagagacaggatcaggagcgatagagagcaggccctcagtgttgtactatttgtctcggtccttgtgtctaaggagcaatgcagaaaaaaaggtgaaataaatggaagagatagccatggactc

SEQ ID NO: 62781 - DNA, 1466 bp, Homo sapiens
gattgggggaatgcaggaaaaaccccatccctccctacagagcctcagcagtgacagctacttcccggatgagaagggcggccgtgaagccagcagggaagccagccccacagccaagggccccccagcctcctcacagctccccatagcctggacctgccggccctccctccaggaccgaggggctcccaagggaaactcaggcgtgtgctggtcccaatgtcagtgaaacccagctgggggcctggcccctcggagggggtcaccgcagtgcctaccagtgaccttggagagatccacaactggaccgagctgcttgacctcttcaaccacactttgtctgagtgccacgtggagctcagccagagcaccaagcgcgtggtcctctttgccctctacctggccatgtttgtggttgggctggtggagaacctcctggtgatatgcgtcaactggcgcggctcaggccgggcagggctgatgaacctctacatcctcaacatggccatcgcggacctgggcattgtcctgtctctgcccgtgtggatgctggaggtcacgctggactacacctggctctggggcagcttctcctgccgcttcactcactacttctactttgtcaacatgtatagcagcatcttcttcctggtgtgcctcagtgtcgaccgctatgtcaccctcaccagcgcctccccctcctggcagcgttaccagcaccgagtgcggcgggccatgtgtgcaggcatctgggtcctctcggccatcatcccgctgcctgaggtggtccacatccagctggtggagggccctgagcccatgtgcctcttcatggcaccttttgaaacgtacagcacctgggccctggcggtggccctgtccaccaccatcctgggcttcctgctgcccttccctctcatcacagtcttcaatgtgctgacagcctgccggctgcggcagccaggacaacccaagagccggcgccactgcttgctgctgtgcgcctacgtggccgtctttgtcatgtgctggctgccctatcatgtgaccctgctgctgctcacactgcatgggacccacatctccctccactgccacctggtccacctgctctacttcttctatgatgtcattgactgcttctccatgctgcactgtgtcatcaaccccatcctttacaactttctcagcccacacttccggggccggctcctgaatgctgtagtccattaccttcctaaggaccagaccaaggcgggcacatgcgcctcctcttcctcctgttccacccagcattccatcatcatcaccaagggtgatagccagcctgctgcagcagccccccaccctgagccaagcctgagctttcaggcacaccatttgcttccaaatacttcccccatctctcccactcagcctcttacacccagctgaggtactagaattcagcggccgctgaattctag

SEQ ID NO: 62782 - DNA, 1734 bp, Homo sapiens
gattgggggaatgcaggaaaaaccccatccctccctacagagcctcagcagtgacagctacttcccggatgagaagggcggccgtgaagccagcagggaagccagccccacagccaagggccccccagcctcctcacagctccccatagcctggacctgccggccctccctccaggaccgaggggctcccaagggaaactcaggcgtgtgctggtcccaatgtcagtgaaacccagctgggggcctggcccctcggagggggtcaccgcagtgcctaccagtgaccttggagagatccacaactggaccgagctgcttgacctcttcaaccacactttgtctgagtgccacgtggagctcagccagagcaccaagcgcgtggtcctctttgccctctacctggccatgtttgtggttgggctggtggagaacctcctggtgatatgcgtcaactggcgcggctcaggccgggcagggctgatgaacctctacatcctcaacatggccatcgcggacctgggcattgtcctgtctctgcccgtgtggatgctggaggtcacgctggactacacctggctctggggcagcttctcctgccgcttcactcactacttctactttgtcaacatgtatagcagcatcttcttcctggtgtgcctcagtgtcgaccgctatgtcaccctcaccagcgcctccccctcctggcagcgttaccagcaccgagtgcggcgggccatgtgtgcaggcatctgggtcctctcggccatcatcccgctgcctgaggtggtccacatccagctggtggagggccctgagcccatgtgcctcttcatggcaccttttgaaacgtacagcacctgggccctggcggtggccctgtccaccaccatcctgggcttcctgctgcccttccctctcatcacagtcttcaatgtgctgacagcctgccggctgcggcagccaggacaacccaagagccggcgccactgcttgctgctgtgcgcctacgtggccgtctttgtcatgtgctggctgccctatcatgtgaccctgctgctgctcacactgcatgggacccacatctccctccactgccacctggtccacctgctctacttcttctatgatgtcattgactgcttctccatgctgcactgtgtcatcaaccccatcctttacaactttctcagcccacacttccggggccggctcctgaatgctgtagtccattaccttcctaaggaccagaccaaggcgggcacatgcgcctcctcttcctcctgttccacccagcattccatcatcatcaccaagggtgatagccagcctgctgcagcagccccccaccctgagccaagcctgagctttcaggcacaccatttgcttccaaatacttcccccatctctcccactcagcctcttacacccagctgaggtagaggccagactcctccaacagtgaaggaaaaggcacagatcaccttagaggccacgctcccaagattagttatcaccctggcagtatgaatacttccctaaggcctcccatccatggaggggaagagtgggaaccagctgttacactcagcatctactgagcactgatgggagccctgcctgggccatgtgctgtggggccaaatggacatcactccctaacttcttgaggtctgtctcctctgtggattcacgcatgtatcaacctcattaaactatgccaaacttttacctcct

SEQ ID NO: 62783 - DNA, 653 bp, Homo sapiens
atccaggccaaatcagcgctggctatgccgctgtactgtattgccacacggctcacattgcatgcaagtttgctgagctgaaggaaaagattgattgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaattgagaaaaaaaaaaaaaaaa

SEQ ID NO: 62784 - DNA, 344 bp, Homo sapiens
ctccctatcctagcagagactaggaggcaggaaccttacttgtatgacaacatgtttttcccaaggcagtgagcaatctcaaggacactgcaggccaggtaaaatagaaacagcacaggttaacccttgacagtcccaaggacaaacactggtcaaatggattccaaaaacagaacgctttactcagacaaaatctctgtctgaaccccaaaagtaaagcagataaaagtggaggccatttaggtgaagcagggttgatgacacagaacccctggcctggggcatctttggaatcccaagaacaccttaaaatgaagtccacagactttaaatctcctcctttt

SEQ ID NO: 62785 - DNA, 1916 bp, Homo sapiens
  misc_feature (419)..(419): n is a, c, g, or t
  misc_feature (515)..(515): n is a, c, g, or t
cgctgaggctctggcacctgaaggagccctgggaggatggcgatgttgcctatggatgcagctgcctccgtaagtatcctcttgcagctggtccagcgatgctctcttctccccttccaggctctccttccttctcagacaagatgtcttatcagaaaaagcagcccacccctcagcccccagtggactgcgtgaagacctctggcggcggtggcggtggcggcggcggcggcggtggtggctgcggcttcttcggcggcggcggctcagggggcggtagcagcggttctggctgcggctactccggcggcggtggctactctggcggcggctgcggcgggggctcctccggcggcgggggcgggggcggcattggaggctgcggagggggctccggtgggagcgtcaagtactccggnggcggcggctcctccggcgggggctctggctgtttctccagcggtgggggcggctccggctgcttctcctccggtggcggcggctcctccgggggnggctccggctgcttctccagcggtgggggcggctcctccgggggcggctccggctgcttctcctccggcggcggcggcttctcgggccaggcggtccagtgccagagctacggaggcgtctctagcggcggctcctccgggggcggctccggctgcttctccagcggcgggggcggcggctctgtctgcggctactctggcggcggctctggcggcggctctggctgcggcggaggctcctctggcggcagcggctccggctacgtctcctcgcagcaggtcactcagacctcgtgcgcgccccagccgagttacggaggggggtcgtccggcggcggcggcagcggcggaagcggctgcttctccagcggcgggggcggcgggagctccggctgcggcggcggctcctccgggattggcagcggctgcatcatcagtggcgggggctccgtctgcggaggtggttcctctggaggcggcggcggcggctcctccgtgggtggctccgggagtggcaagggcgtcccgatctgccaccagacccagcagaagcaggcgcctacctggccgtccaaatagatcccccagggtaccacggaggcgaaggagttggaggtgttttccaggggcaccgatgggcttagagctctcatgatgctacccgaggtttgcaaatccttcatgtcttaacctacctggaagaagccattgagctctccggctgcatctagttctgctgtttagcctctttggtttctgtacaactacctcccaaccccagtgcctcagtcaataaatttgcaaattcatgagaaaaaacaaaaaaaaaaaaaaaaaaaaaaaaaaaaaaaaaaaaaaaaaaaaaaaaaaaaaaaaaagaaacaaaaaaaagaaagaaaaaaacacaaaacgaacaaacagacaacaaaaacaataacaacaccacagaagaacaccagggaaagcggacggtgggcgcgcgccatgcatcactcactccaccacgaggccgcaccggcacaactgaccacagccacaccaccgagcttatcgttatcgccaagccacgccgagacccactagtagagtgagaaacaattaatacagacccgacgcgacgcggacgcccatctctattcaatacactccgaagaaaaaccaaccctaccacccacgacaccatcgccacgacatcacatatacactaacacactacaccaacagacacaacccccactgactacgacccttgcacaaacaccaatcagacaagcccgcgccactacccccacacatccacgaacaacgcgtcttgtttcaccacggatatcatcaccaacaaaccaatccaactcgtcacccccgtccatccgcacgccacacactcagaagagcccaaac

SEQ ID NO: 62786 - DNA, 1827 bp, Homo sapiens
  misc_feature (330)..(330): n is a, c, g, or t
  misc_feature (426)..(426): n is a, c, g, or t
ctctcctcactcacccttcctggtgctttgggctctccttccttctcagacaagatgtcttatcagaaaaagcagcccacccctcagcccccagtggactgcgtgaagacctctggcggcggtggcggtggcggcggcggcggcggtggtggctgcggcttcttcggcggcggcggctcagggggcggtagcagcggttctggctgcggctactccggcggcggtggctactctggcggcggctgcggcgggggctcctccggcggcgggggcgggggcggcattggaggctgcggagggggctccggtgggagcgtcaagtactccggnggcggcggctcctccggcgggggctctggctgtttctccagcggtgggggcggctccggctgcttctcctccggtggcggcggctcctccgggggnggctccggctgcttctccagcggtgggggcggctcctccgggggcggctccggctgcttctcctccggcggcggcggcttctcgggccaggcggtccagtgccagagctacggaggcgtctctagcggcggctcctccgggggcggctccggctgcttctccagcggcgggggcggcggctctgtctgcggctactctggcggcggctctggcggcggctctggctgcggcggaggctcctctggcggcagcggctccggctacgtctcctcgcagcaggtcactcagacctcgtgcgcgccccagccgagttacggaggggggtcgtccggcggcggcggcagcggcggaagcggctgcttctccagcggcgggggcggcgggagctccggctgcggcggcggctcctccgggattggcagcggctgcatcatcagtggcgggggctccgtctgcggaggtggttcctctggaggcggcggcggcggctcctccgtgggtggctccgggagtggcaagggcgtcccgatctgccaccagacccagcagaagcaggcgcctacctggccgtccaaatagatcccccagggtaccacggaggcgaaggagttggaggtgttttccaggggcaccgatgggcttagagctctcatgatgctacccgaggtttgcaaatccttcatgtcttaacctacctggaagaagccattgagctctccggctgcatctagttctgctgtttagcctctttggtttctgtacaactacctcccaaccccagtgcctcagtcaataaatttgcaaattcatgagaaaaaacaaaaaaaaaaaaaaaaaaaaaaaaaaaaaaaaaaaaaaaaaaaaaaaaaaaaaaaaaagaaacaaaaaaaagaaagaaaaaaacacaaaacgaacaaacagacaacaaaaacaataacaacaccacagaagaacaccagggaaagcggacggtgggcgcgcgccatgcatcactcactccaccacgaggccgcaccggcacaactgaccacagccacaccaccgagcttatcgttatcgccaagccacgccgagacccactagtagagtgagaaacaattaatacagacccgacgcgacgcggacgcccatctctattcaatacactccgaagaaaaaccaaccctaccacccacgacaccatcgccacgacatcacatatacactaacacactacaccaacagacacaacccccactgactacgacccttgcacaaacaccaatcagacaagcccgcgccactacccccacacatccacgaacaacgcgtcttgtttcaccacggatatcatcaccaacaaaccaatccaactcgtcacccccgtccatccgcacgccacacactcagaagagcccaaac

SEQ ID NO: 62787 - DNA, 373 bp, Homo sapiens
tatggatgtctagtttttccaataccatttactgaagagactatcttttctccattcaattgcctttccacctttgttaaaaatcaactgatcaggggaggggccaagatggccaaatagaaacaactccagtctgcagctcccagcaagaccaatgcagaaaagtgagtgatttctgcatttccaactgaggtacccagttcatccaactgggactggttaggcagtggaagcgacccacagagagtgagtagaagcagggtggggcgtcacttcatctgggaagtgcacagagccaggggaccttcctccccagccaagggaagtggtgagggactgtgctacctgcctgggatactatgcttttcccacg

SEQ ID NO: 62788 - DNA, 440 bp, Homo sapiens
ttctggatttccatttcctgtgcacttcctaattcatgtagacatacatgttttcttggacaaaggtatgttaaatatccttaacaacataggatgcttccctgaccaatactacatgaaagaaggaaacaattagtattctgctgtaggtggattactgtatttttttctaggaattcctaagtgtaagttaatattgtcaaaacatactgtgaacatttacaaattctgaattatagcatgattactattttttggagcgattaatcttctcatccctcatgcttcaatcctaaagtggtaatttcactgtatgtctgtgggatttctgttgaagatgttatccaattataaagtatttggagagaagctttgaaaatagaatatgtaaaaaagtttcccaaattttcaacttaataaaaatatatctcacatttgga

SEQ ID NO: 62789 - DNA, 376 bp, Homo sapiens
  misc_feature (8)..(8): n is a, c, g, or t
  misc_feature (105)..(105): n is a, c, g, or t
  misc_feature (124)..(124): n is a, c, g, or t
ccccccgnggaagcagctgaagccattagccccttgggacaagccctaaacacacaatcctgcatggaaggagcccccctgatcagcctgggccttcaagatccncctatcctcaggcacaggnaagcaccctcaacagcaccccttgtatatataccataaaggggattctgggagttggaagaggccaacttttcctacctgcagtttgaagattaaggacttagagatttgttgagaggctgcttccgagaggttactgatacactgaggacaggaactactgactactctgaatgagggaaaaacatccagtttggggtgatcctgttttgcaatggcagctgtcagccataacatggtgggaaataacggt

SEQ ID NO: 62790 - DNA, 372 bp, Homo sapiens
cctggtttgcacagtttaagtttccccataatatgcagccaggattacagtattgaaggtggggtctgtggaccagcagcatcgggatttccatgttagaaatgcagaatgtcctggtccaccccagatctgtgaattcaactctgtattttaacaagacccccagatggtttgtatgtgcgataaagtttgaaaaatacttgtctacagcatcttccatagtctcccaaacaggtgtgcaaatgcttcatcaatcattttttgtttgagttgaaatggatgaaccttttgtcagcaaaccaagttttagcctttttagtcttggaagcctgtcattgtgtggatcttgattacaaataattgtaccttagt

SEQ ID NO: 62791 - DNA, 658 bp, Homo sapiens
cacagttcctggccagacagctgcttcccagtgacaaatctactttatatcaagagtgaaatcatccagaatagagtgaattcgggcttcagagcggctgtttaggattcagagctctaccaacatgagcaatctgttggcatgacaggtcagagaagccgtgaaggacatggaaggaagtagatggaactggaaacaggaggccaaccccagcagtcagtggtgctcagaaaaaaataagacactgaaatttgaggacttaatggagtttggtgccttcagttagctgatgtctatgaagcctgaccagtctacttctagtctataagatcatgtggaagcttcagtgacaaacttctactttactaatgattttctgatcctgttacccattgcaattgcttaaatggtattttaattagctgctttaaatgactttgcttttttacaaaaagcagtgtgtgctttagtttaaaatatgggtcactggtgtttctttctagaagatgactgtgtttagtaccagggaaaattggtgatgtatttggagaggttttaacttctgtaactcaggttgatatctggaatgtgagtgtttccatacttccgtggatgcagcaaatttatataaagcgttattaaatttgttctagttttt

SEQ ID NO: 62792 - DNA, 1297 bp, Homo sapiens
cattctgaatgaggtttctttttttgattttctttaaaaaaaaaaaacaacctgctttgatttgctttacattccttgccctccatttttcttattatattgtaaacattagaaaaatgaactaaaaagaatttcatgaatgtacattaaaacaagatcttaaacatttgataaaactagtaaaaatgttaatagaaaaggatgaactttaatagcttcaaaaatattatactcttctttgttcagaaaagaaaaataaaaccaaaagggtatcatacttaaataaatctacagtatagtcatctctcagttatccttggatataacattacttttatattgtatccgcagcaaaccttgctttcagatttcacgattagcccctgctaattacatgctttgttgacttctgtttattcttaatttgtacacggcttgaagctcattccttcaactttgaaaccaccctcaactgcaggggaggtttgaaagacagcagctttgctggagggactctctattctcagcatggactaagttactggaaggaattgagtttaaggggtctaatttgggaccccttaaactagatagcttctagttttgctagctcttgatagtgtggtttgggcatttggtcaaaattattttcctagcataagataaatccactttgaaacaaataacaaaggtcatacaaaagctgcatgtttgtgattattttttaaaaagttatcctacattttaaattttagtagataatgttccctgatgttagtgtgtataactgagagttaggtattgcaaaaggaaaaaattttaattctaagacctcgtgcctatttgtcagaaaataaaaattgtcgtttcaagaactttaaaagttaatttacatgatgtttcttgagtgtttttacaaactgcacaactctattggaggtggattttctgttcatctttattttatgtatgttttctttctgggaaatttgattgggagctagcactgtaatgctaccctcaccaggatctatatgggaaatatatgtggccaattctatgttagtaataccaaattcctcttggtcatttatcttgcatagtactgaggaacacagtttgagatagcactatgctcaaacttattaaggccatgacaagatgccctatataactgaaaacaaatagaggagaaatagtgcctttcagatagagtgttgcaattagcatctgggctcaagtgatcttcctgcttcagcttcccgagtagctgggattacatatgcacaccaccatg

SEQ ID NO: 62793 - DNA, 5810 bp, Homo sapiens
tagtacgaggctcgggtgtttagcaattgagattcggagttaaaacagggatgtgcagatggaggtcggaggagacactgctgccccggcccccgggggcgcggaggacttggaggacacgcagttccccagtgaggaagctagagaaggtggaggggttcacgcggtcccgccggatcccgaagacgagggcctggaggaaacaggatccaaggacaaggaccagccacccagcccatcaccaccgccccagtcagaggccctgtcaagcacctctcggctctggagtcctgcagcccctgagaatagtcccacatgtagccctgagagtagctctggaggccagggcggggaccccagtgatgaggagtggcgcagccagcggaagcatgtgtttgtgctgagtgaggctggcaagcccatctactcgcggtatggtagtgtggaggcgctgtcggctaccatgggtgtaatgaccgccctggtgtcctttgtgcagagtgcgggagatgccatccgtgccatctacgctgaggaccacaagctggtgttcctacaacagggcccactgttgctcgtggccatgtcacggacttctcagtcagcagcccagctgcggggggagctgctagctgtgcacgcacagatcgtgagcacacttacacgtgcaagtgtcgcccgcatcttcgcacacaagcagaactatgacctccgccgcctgctggctggttcagagcgcacactggaccgacttctggacagtatggagcaggacccaggagccctgctcctgggtgccgtgcgctgtgtgccccttgcccgcccgctgcgagacgcactaggtgcgctcctccgacgttgcacagcgcctggcctggcgctgtcagtgctggcagtaggcggtcgacttataacagcagcccaggagcggaatgtgctggccgagtgccggctggacccagctgacctgcagttgctgctcgactgggtgggtgcaccagcctttgcggcgggtgaggcttgggcacctgtgtgcctgccccgcttcaaccctgatggttttttctacgcctacgtggcccgcctggatgctatgcctgtctgcctgctgctgcttggcacccaacgtgaagccttccatgccatggccgcctgccggcgcctggtcgaagatgggatgcatgcccttggtgccatgcgtgcccttggggaggctgccagcttctctaatgcctcatcagccagtgctcctgcctacagcgtgcaggctgtcggggcgccgggcctccggcacttcctgtataagccgctggacatccctgaccaccaccgccaactgccccagtttaccagccctgagctagaggccccctacagcagagaggaggagcggcagcggctgtcggacctgtaccaccgcctgcatgctcgtctccacagcacctcccgacccctgcgcctcatttaccacgtggctgagaaggagacactactggcctgggtgacctccaaattcgagctctatacctgcctcagccctctggtgaccaaggcaggtgcaatcttggtagtgaccaaactcctgcgctgggtgaagaaagaggaggaccggctcttcattcgttacccacccaagtactccacaccaccagccacctctacggaccaagctgcccataatggcttgttcactggactctgatagttggagctcccagaccaggcagtgctgggagcaaccacctttgttttttaccttctgtctaccctggaaatgtgtgtgggggtgtgtctgtggccagtcattgtctccctaagcaatggggcaaggtctgagggcccaccgatgagagagatggtggcagccgccaggcgagcaggctgctttccctgcccagtcatgcacctccccctctggggaaatccttaggcctccctctcccttccctctgtctcatctcctccacttggatgatgctctagcctctgtcagggactgtcccctccaaacttgcttccgtggtctgcctcctagttgaatctcagccctgagtgtccagatctggccaaggtgtctagggtggcccacgggggtgctggaattggcacttcagggccaggctatgcttgggactggcctgagggtattttaaagaaaaaaactacataaaaggcctaaaagtaagacccacaaggatattcctttgcccttcttgtacttttttcatctttaccctgccagaaatgacccgccctcaatgctggctgctgctaacattaatgagaaggtggccttcagtgtccacctgtggaacccaggacacagcacctgactgcacacagtggctgaaatccagcatttttacataggagatgcacttagcctctaagcctcgttttactcatctgtgaaacagagataagtaaccctctctcatgaactctttgatgaggatttgtaaacgaaaacagactcgaactattgtgtaccaccacatagcacatgcacgtctgtcccagactttgacaacctgcacaagacaagcagcctaaagcaggagagacctccctagggttttgtgtgtgtgcacactaccctcactccccaactggccattaccctagttctgcccttgtttgtggagttacagcctcaaggttgtagcatgtgtgctggcaatcagggccgcagtgtgttctgcgcctgcccagagctgactcctgatttaaccgctggcgtaaccgcgggttgcacgcatgcgtgctgaaaagcctttcaccctcacgtggtttcttttttaaccagtcatcaagcgaggctcgcgcgcaggccccgcgttggaaaatggcggggaagctgaaacctctgaatgtggaggcgccagaagctgctgaggaggctgaaggtagtgagggcaagtgggctgcactcctttctctccaaccagggcagaaaggagggaggattcgtcccattacaataatgaaataatgatattctaatttttttaaataaaatgttaagccttttgttattgaagaaaaacaattttttaaccgttcagcacagtggagataaattaacaggcatattcttatcaccgagattaacttttgtcaactgtagtgtatacgttgttgaaagtaaacaacatgtagttcagtacgaaagtcttcaaacaaaagtggggcggtggggatgttctcataacaatcaccgtgctgcagccaccccttattaacagtaattcccagtgtcgccatttcacacctaacacatatgacactttgatggactcttaaacctcctaatcgaacatggcctcccccacagcctcttttctccagggtattgacttgaatgacaggcaaaggagggtggaggggtgtcggcctagacactattggaaattgtattccatccaaaagaaaaaaaaatctcaggccgggcacggaggctcacgcctgtaatcccagcactttgggaggccgaggcgggcagatcacgaggttaggagttcgaggccagcctgaccaacatggtgaaacaccatctctactaaaaaactatatatacatatacatatgtgtgtatgtgtatttatatgtatgtatgtatgtgtgtgtgtatatatatatatatatgtatatgtgtatatatatatatatgtgtatatatatatatatatacacacactaatcagccgggcacggtggtgtgggcctgtaatcgcagctactcaggaagctgaggcaggagaatcacttgaacccgagaggcggaggttgcagtgagccgagatcatgtcactgcactccagcctgggtgacagagtgagactccgtctcaaaagaaaaaaaattctcccttggccgggcttggtggcttatgcctgtaatcccagcactttggaaggccgaggcgggtgggtcacctgaggtcaggagtttgagaccagcctggccagcatggcgaaacctcgtctctactaaaaatacaaaaattgtccgggtgtggtggcgggcgcctgtagtcccagctactggggaggctgaggcaggggaattgcttgaacccgggaggcagaggttatcgtgagctgacattgcgccactgcactccagcgcggaagacagagtgagccaaaaaaaaaaaaaaaaaagaaaaagaaaacaaaaagaaaaaaatctcccaaggcagtcatgcatttgtatgccactagcatttttttgttatagaaatattcaaagtgtaccaacgtagagaaaatagctttaaacaaagcccatgtgtacctatcagtatgctttaactgttgtcacctttctgccccacttttatctatctcgaacacccctttctgcacactctttaaaccactgtattaacaaacacattagactgcatcctgccagacctacccatacagacatcaaagtaatgattattgcttattgcctgacctaggatgtgagctccatgagaacagagactgtttacctctcgctcccctgcacctaaaacaatgcctgcttggtgtaaagtaagtgctcagtaattttttaatgtgtgaccaatgaaataacttcaagagcagagagctcttttagattagaggcacatactaagtgccagcattcaacaaaagacagacggaaataagacagatgcaaatagatctcatttattaactgtgtaatgcagctgccactgcaattaaaaaaaaaattttagtatcaacctttcaaattcctcaaaattaaagttatgactaacttcaccagcaaaggaaaaattgaaggatgtatcaagttgccatttctagcccatcaaatcggctttataaagggaagcatagtatctggtattgacgaccttgtagagaaacaggccttttcctgcctcagggaagagagctgactcaaagtaaaggctttgctagaggcagtcggcagagtatttttagcatctaaaatgctcttccacttcggcagtgaccatgcgatgtaatcaaaggagaatacgtaagtgtatggaccaggaatggtcactggagtgttgatgtaggcacaacacaagaagtagtcacagaaattgctaagtctaggtttatgtgtgcatgctgtggagtgtctctgtggtggatttctttttaagaggcagaaaaaaattctaatttaaatgtattaaattataagttctaatttaaatgtattaaaattaaattataagttgataggattattattgacacacaaggagctccaaaagagatcgtatttttattagagacaagccagttgggattgaaacaaaaatggaggggggtatagccctgtgtatgttgcacagaaaaagtatctgaatgataaaggcctaagtgataactctggacaagggatttggattttgggagtagtgcagaggtagaggcatttttgtgatttattgttctattttttcttctagaaaaatgtaagtagtcatatataattttaaaatataaaggagaagaggcaaaatgttgaatggcacctgaggatcctatattcatattggatcagtattaacatccaggttttgattgttgtactatggttacctggtagattccctttgtatataggaaatagacactggaatagtaaggagtagtgggtcaagatgtctgcaacttattgttcagaatcactcacaaatgggaaatctgatataaggacaaaatgggagcactgtggcctatttttacaacttttgtgtacatctgcaattgtttcaaaataaaatgtttaaaagggtgaaaaaaaaa

SEQ ID NO: 62794 - DNA, 5652 bp, Homo sapiens
ggcgaagtgggcctcgctctcccgggttcgcagccgtagccagatccgttgaaaggagtgcagagaggtctcattgcgctcccgaacagacctgacgtagatccgaagtggcccgcgccatctcaactatgaggggacacccgtaggcggcgggagagggacgccgcgaggagccaataaagctccgcaaccggaagtgtcttctgggaggggtcgtacccggaagtgtggcacctcccgggccgcacccggaagtgtgatgccaccgccgctacggggaagtaatggtatccggccaattgagattcggagttaaaacagggatgtgcagatggaggtcggaggagacactgctgccccggcccccgggggcgcggaggacttggaggacacgcagttccccagtgaggaagctagagaaggtggaggggttcacgcggtcccgccggatcccgaagacgagggcctggaggaaacaggatccaaggacaaggaccagccacccagcccatcaccaccgccccagtcagaggccctgtcaagcacctctcggctctggagtcctgcagcccctgagaatagtcccacatgtagccctgagagtagctctggaggccagggcggggaccccagtgatgaggagtggcgcagccagcggaagcatgtgtttgtgctgagtgaggctggcaagcccatctactcgcggtatggtagtgtggaggcgctgtcggctaccatgggtgtaatgaccgccctggtgtcctttgtgcagagtgcgggagatgccatccgtgccatctacgctgaggaccacaagctggtgttcctacaacagggcccactgttgctcgtggccatgtcacggacttctcagtcagcagcccagctgcggggggagctgctagctgtgcacgcacagatcgtgagcacacttacacgtgcaagtgtcgcccgcatcttcgcacacaagcagaactatgacctccgccgcctgctggctggttcagagcgcacactggaccgacttctggacagtatggagcaggacccaggagccctgctcctgggtgccgtgcgctgtgtgccccttgcccgcccgctgcgagacgcactaggtgcgctcctccgacgttgcacagcgcctggcctggcgctgtcagtgctggcagtaggcggtcgacttataacagcagcccaggagcggaatgtgctggccgagtgccggctggacccagctgacctgcagttgctgctcgactgggtgggtgcaccagcctttgcggcgggtgaggcttgggcacctgtgtgcctgccccgcttcaaccctgatggttttttctacgcctacgtggcccgcctggatgctatgcctgtctgcctgctgctgcttggcacccaacgtgaagccttccatgccatggccgcctgccggcgcctggtcgaagatgggatgcatgcccttggtgccatgcgtgcccttggggaggctgccagcttctctaatgcctcatcagccagtgctcctgcctacagcgtgcaggctgtcggggcgccgggcctccggcacttcctgtataagccgctggacatccctgaccaccaccgccaactgccccagtttaccagccctgagctagaggccccctacagcagagaggaggagcggcagcggctgtcggacctgtaccaccgcctgcatgctcgtctccacagcacctcccgacccctgcgcctcatttaccacgtggctgagaaggagacactactggcctgggtgacctccaaattcgagctctatacctgcctcagccctctggtgaccaaggcaggtgcaatcttggtagtgaccaaactcctgcgctgggtgaagaaagaggaggaccggctcttcattcgttacccacccaagtactccacaccaccagccacctctacggaccaagctgcccataatggcttgttcactggactctgatagttggagctcccagaccaggcagtgctgggagcaaccacctttgttttttaccttctgtctaccctggaaatgtgtgtgggggtgtgtctgtggccagtcattgtctccctaagcaatggggcaaggtctgagggcccaccgatgagagagatggtggcagccgccaggcgagcaggctgctttccctgcccagtcatgcacctccccctctggggaaatccttaggcctccctctcccttccctctgtctcatctcctccacttggatgatgctctagcctctgtcagggactgtcccctccaaacttgcttccgtggtctgcctcctagttgaatctcagccctgagtgtccagatctggccaaggtgtctagggtggcccacgggggtgctggaattggcacttcagggccaggctatgcttgggactggcctgagggtattttaaagaaaaaaactacataaaaggcctaaaagtaagacccacaaggatattcctttgcccttcttgtacttttttcatctttaccctgccagaaatgacccgccctcaatgctggctgctgctaacattaatgagaaggtggccttcagtgtccacctgtggaacccaggacacagcacctgactgcacacagtggctgaaatccagcatttttacataggagatgcacttagcctctaagcctcgttttactcatctgtgaaacagagataagtaaccctctctcatgaactctttgatgaggatttgtaaacgaaaacagactcgaactattgtgtaccaccacatagcacatgcacgtctgtcccagactttgacaacctgcacaagacaagcagcctaaagcaggagagacctccctagggttttgtgtgtgtgcacactaccctcactccccaactggccattaccctagttctgcccttgtttgtggagttacagcctcaaggttgtagcatgtgtgctggcaatcagggccgcagtgtgttctgcgcctgcccagagctgactcctgatttaaccgctggcgtaaccgcgggttgcacgcatgcgtgctgaaaagcctttcaccctcacgtggtttcttttttaaccagtcatcaagcgaggctcgcgcgcaggccccgcgttggaaaatggcggggaagctgaaacctctgaatgtggaggcgccagaagctgctgaggaggctgaaggtagtgagggcaagtgggctgcactcctttctctccaaccagggcagaaaggagggaggattcgtcccattacaataatgaaataatgatattctaatttttttaaataaaatgttaagccttttgttattgaagaaaaacaattttttaaccgttcagcacagtggagataaattaacaggcatattcttatcaccgagattaacttttgtcaactgtagtgtatacgttgttgaaagtaaacaacatgtagttcagtacgaaagtcttcaaacaaaagtggggcggtggggatgttctcataacaatcaccgtgctgcagccaccccttattaacagtaattcccagtgtcgccatttcacacctaacacatatgacactttgatggactcttaaacctcctaatcgaacatggcctcccccacagcctcttttctccagggtattgacttgaatgacaggcaaaggagggtggaggggtgtcggcctagacactattggaaattgtattccatccaaaagaaaaaaaaatctcaggccgggcacggaggctcacgcctgtaatcccagcactttgggaggccgaggcgggcagatcacgaggttaggagttcgaggccagcctgaccaacatggtgaaacaccatctctataaaaatacaaaaattgtccgggtgtggtggcgggcgcctgtagtcccagctactggggaggctgaggcaggggaattgcttgaacccgggaggcagaggttatcgtgagctgacattgcgccactgcactccagcgcggaagacagagtgagccaaaaaaaaaaaaaaaaaagaaaaagaaaacaaaaagaaaaaaatctcccaaggcagtcatgcatttgtatgccactagcatttttttgttatagaaatattcaaagtgtaccaacgtagagaaaatagctttaaacaaagcccatgtgtacctatcagtatgctttaactgttgtcacctttctgccccacttttatctatctcgaacacccctttctgcacactctttaaaccactgtattaacaaacacattagactgcatcctgccagacctacccatacagacatcaaagtaatgattattgcttattgcctgacctaggatgtgagctccatgagaacagagactgtttacctctcgctcccctgcacctaaaacaatgcctgcttggtgtaaagtaagtgctcagtaattttttaatgtgtgaccaatgaaataacttcaagagcagagagctcttttagattagaggcacatactaagtgccagcattcaacaaaagacagacggaaataagacagatgcaaatagatctcatttattaactgtgtaatgcagctgccactgcaattaaaaaaaaaattttagtatcaacctttcaaattcctcaaaattaaagttatgactaacttcaccagcaaaggaaaaattgaaggatgtatcaagttgccatttctagcccatcaaatcggctttataaagggaagcatagtatctggtattgacgaccttgtagagaaacaggccttttcctgcctcagggaagagagctgactcaaagtaaaggctttgctagaggcagtcggcagagtatttttagcatctaaaatgctcttccacttcggcagtgaccatgcgatgtaatcaaaggagaatacgtaagtgtatggaccaggaatggtcactggagtgttgatgtaggcacaacacaagaagtagtcacagaaattgctaagtctaggtttatgtgtgcatgctgtggagtgtctctgtggtggatttctttttaagaggcagaaaaaaattctaatttaaatgtattaaattataagttctaatttaaatgtattaaaattaaattataagttgataggattattattgacacacaaggagctccaaaagagatcgtatttttattagagacaagccagttgggattgaaacaaaaatggaggggggtatagccctgtgtatgttgcacagaaaaagtatctgaatgataaaggcctaagtgataactctggacaagggatttggattttgggagtagtgcagaggtagaggcatttttgtgatttattgttctattttttcttctagaaaaatgtaagtagtcatatataattttaaaatataaaggagaagaggcaaaatgttgaatggcacctgaggatcctatattcatattggatcagtattaacatccaggttttgattgttgtactatggttacctggtagattccctttgtatataggaaatagacactggaatagtaaggagtagtgggtcaagatgtctgcaacttattgttcagaatcactcacaaatgggaaatctgatataaggacaaaatgggagcactgtggcctatttttacaacttttgtgtacatctgcaattgtttcaaaataaaatgtttaaaagggtgaaaaaaaaa

SEQ ID NO: 62795 - DNA, 5524 bp, Homo sapiens
ggcgaagtgggcctcgctctcccgggttcgcagccgtagccagatccgttgaaaggagtgcagagaggtctcattgcgctcccgaacagacctgacgtagatccgaagtggcccgcgccatctcaactatgaggggacacccgtaggcggcgggagagggacgccgcgaggagccaataaagctccgcaaccggaagtgtcttctgggaggggtcgtacccggaagtgtggcacctcccgggccgcacccggaagtgtgatgccaccgccgctacggggaagtaatggtatccggccaattgagattcggagttaaaacagggatgtgcagatggaggtcggaggagacactgctgccccggcccccgggggcgcggaggacttggaggacacgcagttccccagtgaggaagctagagaaggtggaggggttcacgcggtcccgccggatcccgaagacgagggcctggaggaaacaggatccaaggacaaggaccagccacccagcccatcaccaccgccccagtcagaggccctgtcaagcacctctcggctctggagtcctgcagcccctgagaatagtcccacatgtagccctgagagtagctctggaggccagggcggggaccccagtgatgaggagtggcgcagccagcggaagcatgtgtttgtgctgagtgaggctggcaagcccatctactcgcggtatggtagtgtggaggcgctgtcggctaccatgggtgtaatgaccgccctggtgtcctttgtgcagagtgcgggagatgccatccgtgccatctacgctgaggaccacaagctggtgttcctacaacagggcccactgttgctcgtggccatgtcacggacttctcagtcagcagcccagctgcggggggagctgctagctgtgcacgcacagatcgtgagcacacttacacgtgcaagtgtcgcccgcatcttcgcacacaagcagaactatgacctccgccgcctgctggctggttcagagcgcacactggaccgacttctggacagtatggagcaggacccaggagccctgctcctgggtgccgtgcgctgtgtgccccttgcccgcccgctgcgagacgcactaggtgcgctcctccgacgttgcacagcgcctggcctggcgctgtcagtgctggcagtaggcggtcgacttataacagcagcccaggagcggaatgtgctggccgagtgccggctggacccagctgacctgcagttgctgctcgactgggtgggtgcaccagcctttgcggcgggtgaggcttgggcacctgtgtgcctgccccgcttcaaccctgatggttttttctacgcctacgtggcccgcctggatgctatgcctgtctgcctgctgctgcttggcacccaacgtgaagccttccatgccatggccgcctgccggcgcctggtcgaagatgggatgcatgcccttggtgccatgcgtgcccttggggaggctgccagcttctctaatgcctcatcagccagtgctcctgcctacagcgtgcaggctgtcggggcgccgggcctccggcacttcctgtataagccgctggacatccctgaccaccaccgccaactgccccagtttaccagccctgagctagaggccccctacagcagagaggaggagcggcagcggctgtcggacctgtaccaccgcctgcatgctcgtctccacagcacctcccgacccctgcgcctcatttaccacgtggctgagaaggagacactactggcctgggtgacctccaaattcgagctctatacctgcctcagccctctggtgaccaaggcaggtgcaatcttggtagtgaccaaactcctgcgctgggtgaagaaagaggaggaccggctcttcattcgttacccacccaagtactccacaccaccagccacctctacggaccaagctgcccataatggcttgttcactggactctgatagttggagctcccagaccaggcagtgctgggagcaaccacctttgttttttaccttctgtctaccctggaaatgtgtgtgggggtgtgtctgtggccagtcattgtctccctaagcaatggggcaaggtctgagggcccaccgatgagagagatggtggcagccgccaggcgagcaggctgctttccctgcccagtcatgcacctccccctctggggaaatccttaggcctccctctcccttccctctgtctcatctcctccacttggatgatgctctagcctctgtcagggactgtcccctccaaacttgcttccgtggtctgcctcctagttgaatctcagccctgagtgtccagatctggccaaggtgtctagggtggcccacgggggtgctggaattggcacttcagggccaggctatgcttgggactggcctgagggtattttaaagaaaaaaactacataaaaggcctaaaagtaagacccacaaggatattcctttgcccttcttgtacttttttcatctttaccctgccagaaatgacccgccctcaatgctggctgctgctaacattaatgagaaggtggccttcagtgtccacctgtggaacccaggacacagcacctgactgcacacagtggctgaaatccagcatttttacataggagatgcacttagcctctaagcctcgttttactcatctgtgaaacagagataagtaaccctctctcatgaactctttgatgaggatttgtaaacgaaaacagactcgaactattgtgtaccaccacatagcacatgcacgtctgtcccagactttgacaacctgcacaagacaagcagcctaaagcaggagagacctccctagggttttgtgtgtgtgcacactaccctcactccccaactggccattaccctagttctgcccttgtttgtggagttacagcctcaaggttgtagcatgtgtgctggcaatcagggccgcagtgtgttctgcgcctgcccagagctgactcctgatttaaccgctggcgtaaccgcgggttgcacgcatgcgtgtgaggaggctgaaggtagtgagggcaagtgggctgcactcctttctctccaaccagggcagaaaggagggaggattcgtcccattacaataatgaaataatgatattctaatttttttaaataaaatgttaagccttttgttattgaagaaaaacaattttttaaccgttcagcacagtggagataaattaacaggcatattcttatcaccgagattaacttttgtcaactgtagtgtatacgttgttgaaagtaaacaacatgtagttcagtacgaaagtcttcaaacaaaagtggggcggtggggatgttctcataacaatcaccgtgctgcagccaccccttattaacagtaattcccagtgtcgccatttcacacctaacacatatgacactttgatggactcttaaacctcctaatcgaacatggcctcccccacagcctcttttctccagggtattgacttgaatgacaggcaaaggagggtggaggggtgtcggcctagacactattggaaattgtattccatccaaaagaaaaaaaaatctcaggccgggcacggaggctcacgcctgtaatcccagcactttgggaggccgaggcgggcagatcacgaggttaggagttcgaggccagcctgaccaacatggtgaaacaccatctctataaaaatacaaaaattgtccgggtgtggtggcgggcgcctgtagtcccagctactggggaggctgaggcaggggaattgcttgaacccgggaggcagaggttatcgtgagctgacattgcgccactgcactccagcgcggaagacagagtgagccaaaaaaaaaaaaaaaaaagaaaaagaaaacaaaaagaaaaaaatctcccaaggcagtcatgcatttgtatgccactagcatttttttgttatagaaatattcaaagtgtaccaacgtagagaaaatagctttaaacaaagcccatgtgtacctatcagtatgctttaactgttgtcacctttctgccccacttttatctatctcgaacacccctttctgcacactctttaaaccactgtattaacaaacacattagactgcatcctgccagacctacccatacagacatcaaagtaatgattattgcttattgcctgacctaggatgtgagctccatgagaacagagactgtttacctctcgctcccctgcacctaaaacaatgcctgcttggtgtaaagtaagtgctcagtaattttttaatgtgtgaccaatgaaataacttcaagagcagagagctcttttagattagaggcacatactaagtgccagcattcaacaaaagacagacggaaataagacagatgcaaatagatctcatttattaactgtgtaatgcagctgccactgcaattaaaaaaaaaattttagtatcaacctttcaaattcctcaaaattaaagttatgactaacttcaccagcaaaggaaaaattgaaggatgtatcaagttgccatttctagcccatcaaatcggctttataaagggaagcatagtatctggtattgacgaccttgtagagaaacaggccttttcctgcctcagggaagagagctgactcaaagtaaaggctttgctagaggcagtcggcagagtatttttagcatctaaaatgctcttccacttcggcagtgaccatgcgatgtaatcaaaggagaatacgtaagtgtatggaccaggaatggtcactggagtgttgatgtaggcacaacacaagaagtagtcacagaaattgctaagtctaggtttatgtgtgcatgctgtggagtgtctctgtggtggatttctttttaagaggcagaaaaaaattctaatttaaatgtattaaattataagttctaatttaaatgtattaaaattaaattataagttgataggattattattgacacacaaggagctccaaaagagatcgtatttttattagagacaagccagttgggattgaaacaaaaatggaggggggtatagccctgtgtatgttgcacagaaaaagtatctgaatgataaaggcctaagtgataactctggacaagggatttggattttgggagtagtgcagaggtagaggcatttttgtgatttattgttctattttttcttctagaaaaatgtaagtagtcatatataattttaaaatataaaggagaagaggcaaaatgttgaatggcacctgaggatcctatattcatattggatcagtattaacatccaggttttgattgttgtactatggttacctggtagattccctttgtatataggaaatagacactggaatagtaaggagtagtgggtcaagatgtctgcaacttattgttcagaatcactcacaaatgggaaatctgatataaggacaaaatgggagcactgtggcctatttttacaacttttgtgtacatctgcaattgtttcaaaataaaatgtttaaaagggtgaaaaaaaaa

SEQ ID NO: 62796 - DNA, 4526 bp, Homo sapiens
acaacgtagtacgtgtcgtgtagtccgttgtcagtgctggcagtaggcggtcgacttataacagcagcccaggagcggaatgtgctggccgagtgccggctggacccagctgacctgcagttgctgctcgactgggtgggtgcaccagcctttgcggcgggtgaggcttgggcacctgtgtgcctgccccgcttcaaccctgatggttttttctacgcctacgtggcccgcctggatgctatgcctgtctgcctgctgctgcttggcacccaacgtgaagccttccatgccatggccgcctgccggcgcctggtcgaagatgggatgcatgcccttggtgccatgcgtgcccttggggaggctgccagcttctctaatgcctcatcagccagtgctcctgcctacagcgtgcaggctgtcggggcgccgggcctccggcacttcctgtataagccgctggacatccctgaccaccaccgccaactgccccagtttaccagccctgagctagaggccccctacagcagagaggaggagcggcagcggctgtcggacctgtaccaccgcctgcatgctcgtctccacagcacctcccgacccctgcgcctcatttaccacgtggctgagaaggagacactactggcctgggtgacctccaaattcgagctctatacctgcctcagccctctggtgaccaaggcaggtgcaatcttggtagtgaccaaactcctgcgctgggtgaagaaagaggaggaccggctcttcattcgttacccacccaagtactccacaccaccagccacctctacggaccaagctgcccataatggcttgttcactggactctgatagttggagctcccagaccaggcagtgctgggagcaaccacctttgttttttaccttctgtctaccctggaaatgtgtgtgggggtgtgtctgtggccagtcattgtctccctaagcaatggggcaaggtctgagggcccaccgatgagagagatggtggcagccgccaggcgagcaggctgctttccctgcccagtcatgcacctccccctctggggaaatccttaggcctccctctcccttccctctgtctcatctcctccacttggatgatgctctagcctctgtcagggactgtcccctccaaacttgcttccgtggtctgcctcctagttgaatctcagccctgagtgtccagatctggccaaggtgtctagggtggcccacgggggtgctggaattggcacttcagggccaggctatgcttgggactggcctgagggtattttaaagaaaaaaactacataaaaggcctaaaagtaagacccacaaggatattcctttgcccttcttgtacttttttcatctttaccctgccagaaatgacccgccctcaatgctggctgctgctaacattaatgagaaggtggccttcagtgtccacctgtggaacccaggacacagcacctgactgcacacagtggctgaaatccagcatttttacataggagatgcacttagcctctaagcctcgttttactcatctgtgaaacagagataagtaaccctctctcatgaactctttgatgaggatttgtaaacgaaaacagactcgaactattgtgtaccaccacatagcacatgcacgtctgtcccagactttgacaacctgcacaagacaagcagcctaaagcaggagagacctccctagggttttgtgtgtgtgcacactaccctcactccccaactggccattaccctagttctgcccttgtttgtggagttacagcctcaaggttgtagcatgtgtgctggcaatcagggccgcagtgtgttctgcgcctgcccagagctgactcctgatttaaccgctggcgtaaccgcgggttgcacgcatgcgtgctgaaaagcctttcaccctcacgtggtttcttttttaaccagtcatcaagcgaggctcgcgcgcaggccccgcgttggaaaatggcggggaagctgaaacctctgaatgtggaggcgccagaagctgctgaggaggctgaaggtagtgagggcaagtgggctgcactcctttctctccaaccagggcagaaaggagggaggattcgtcccattacaataatgaaataatgatattctaatttttttaaataaaatgttaagccttttgttattgaagaaaaacaattttttaaccgttcagcacagtggagataaattaacaggcatattcttatcaccgagattaacttttgtcaactgtagtgtatacgttgttgaaagtaaacaacatgtagttcagtacgaaagtcttcaaacaaaagtggggcggtggggatgttctcataacaatcaccgtgctgcagccaccccttattaacagtaattcccagtgtcgccatttcacacctaacacatatgacactttgatggactcttaaacctcctaatcgaacatggcctcccccacagcctcttttctccagggtattgacttgaatgacaggcaaaggagggtggaggggtgtcggcctagacactattggaaattgtattccatccaaaagaaaaaaaaatctcaggccgggcacggaggctcacgcctgtaatcccagcactttgggaggccgaggcgggcagatcacgaggttaggagttcgaggccagcctgaccaacatggtgaaacaccatctctataaaaatacaaaaattgtccgggtgtggtggcgggcgcctgtagtcccagctactggggaggctgaggcaggggaattgcttgaacccgggaggcagaggttatcgtgagctgacattgcgccactgcactccagcgcggaagacagagtgagccaaaaaaaaaaaaaaaaaagaaaaagaaaacaaaaagaaaaaaatctcccaaggcagtcatgcatttgtatgccactagcatttttttgttatagaaatattcaaagtgtaccaacgtagagaaaatagctttaaacaaagcccatgtgtacctatcagtatgctttaactgttgtcacctttctgccccacttttatctatctcgaacacccctttctgcacactctttaaaccactgtattaacaaacacattagactgcatcctgccagacctacccatacagacatcaaagtaatgattattgcttattgcctgacctaggatgtgagctccatgagaacagagactgtttacctctcgctcccctgcacctaaaacaatgcctgcttggtgtaaagtaagtgctcagtaattttttaatgtgtgaccaatgaaataacttcaagagcagagagctcttttagattagaggcacatactaagtgccagcattcaacaaaagacagacggaaataagacagatgcaaatagatctcatttattaactgtgtaatgcagctgccactgcaattaaaaaaaaaattttagtatcaacctttcaaattcctcaaaattaaagttatgactaacttcaccagcaaaggaaaaattgaaggatgtatcaagttgccatttctagcccatcaaatcggctttataaagggaagcatagtatctggtattgacgaccttgtagagaaacaggccttttcctgcctcagggaagagagctgactcaaagtaaaggctttgctagaggcagtcggcagagtatttttagcatctaaaatgctcttccacttcggcagtgaccatgcgatgtaatcaaaggagaatacgtaagtgtatggaccaggaatggtcactggagtgttgatgtaggcacaacacaagaagtagtcacagaaattgctaagtctaggtttatgtgtgcatgctgtggagtgtctctgtggtggatttctttttaagaggcagaaaaaaattctaatttaaatgtattaaattataagttctaatttaaatgtattaaaattaaattataagttgataggattattattgacacacaaggagctccaaaagagatcgtatttttattagagacaagccagttgggattgaaacaaaaatggaggggggtatagccctgtgtatgttgcacagaaaaagtatctgaatgataaaggcctaagtgataactctggacaagggatttggattttgggagtagtgcagaggtagaggcatttttgtgatttattgttctattttttcttctagaaaaatgtaagtagtcatatataattttaaaatataaaggagaagaggcaaaatgttgaatggcacctgaggatcctatattcatattggatcagtattaacatccaggttttgattgttgtactatggttacctggtagattccctttgtatataggaaatagacactggaatagtaaggagtagtgggtcaagatgtctgcaacttattgttcagaatcactcacaaatgggaaatctgatataaggacaaaatgggagcactgtggcctatttttacaacttttgtgtacatctgcaattgtttcaaaataaaatgtttaaaagggtgaaaaaaaaa

SEQ ID NO: 62797 - DNA, 4345 bp, Homo sapiens
ggcgaagtgggcctcgctctcccgggttcgcagccgtagccagatccgttgaaaggagtgcagagaggtctcattgcgctcccgaacagacctgacgtagatccgaagtggcccgcgccatctcaactatgaggggacacccgtaggcggcgggagagggacgccgcgaggagccaataaagctccgcaaccggaagtgtcttctgggaggggtcgtacccggaagtgtggcacctcccgggccgcacccggaagtgtgatgccaccgccgctacggggaagtaatggtatccggccaattgagattcggagttaaaacagggatgtgcagatggaggtcggaggagacactgctgccccggcccccgggggcgcggaggacttggaggacacgcagttccccagtgaggaagctagagaaggtggaggggttcacgcggtcccgccggatcccgaagacgagggcctggaggaaacaggatccaaggacaaggaccagccacccagcccatcaccaccgccccagtcagaggccctgtcaagcacctctcggctctggagtcctgcagcccctgagaatagtcccacatgtagccctgagagtagctctggaggccagggcggggaccccagtgatgaggagtggcgcagccacggcagcggctgtcggacctgtaccaccgcctgcatgctcgtctccacagcacctcccgacccctgcgcctcatttaccacgtggctgagaaggagacactactggcctgggtgacctccaaattcgagctctatacctgcctcagccctctggtgaccaaggcaggtgcaatcttggtagtgaccaaactcctgcgctgggtgaagaaagaggaggaccggctcttcattcgttacccacccaagtactccacaccaccagccacctctacggaccaagctgcccataatggcttgttcactggactctgatagttggagctcccagaccaggcagtgctgggagcaaccacctttgttttttaccttctgtctaccctggaaatgtgtgtgggggtgtgtctgtggccagtcattgtctccctaagcaatggggcaaggtctgagggcccaccgatgagagagatggtggcagccgccaggcgagcaggctgctttccctgcccagtcatgcacctccccctctggggaaatccttaggcctccctctcccttccctctgtctcatctcctccacttggatgatgctctagcctctgtcagggactgtcccctccaaacttgcttccgtggtctgcctcctagttgaatctcagccctgagtgtccagatctggccaaggtgtctagggtggcccacgggggtgctggaattggcacttcagggccaggctatgcttgggactggcctgagggtattttaaagaaaaaaactacataaaaggcctaaaagtaagacccacaaggatattcctttgcccttcttgtacttttttcatctttaccctgccagaaatgacccgccctcaatgctggctgctgctaacattaatgagaaggtggccttcagtgtccacctgtggaacccaggacacagcacctgactgcacacagtggctgaaatccagcatttttacataggagatgcacttagcctctaagcctcgttttactcatctgtgaaacagagataagtaaccctctctcatgaactctttgatgaggatttgtaaacgaaaacagactcgaactattgtgtaccaccacatagcacatgcacgtctgtcccagactttgacaacctgcacaagacaagcagcctaaagcaggagagacctccctagggttttgtgtgtgtgcacactaccctcactccccaactggccattaccctagttctgcctcctttctctccaaccagggcagaaaggagggaggattcgtcccattacaataatgaaataatgatattctaatttttttaaataaaatgttaagccttttgttattgaagaaaaacaattttttaaccgttcagcacagtggagataaattaacaggcatattcttatcaccgagattaacttttgtcaactgtagtgtatacgttgttgaaagtaaacaacatgtagttcagtacgaaagtcttcaaacaaaagtggggcggtggggatgttctcataacaatcaccgtgctgcagccaccccttattaacagtaattcccagtgtcgccatttcacacctaacacatatgacactttgatggactcttaaacctcctaatcgaacatggcctcccccacagcctcttttctccagggtattgacttgaatgacaggcaaaggagggtggaggggtgtcggcctagacactattggaaattgtattccatccaaaagaaaaaaaaatctcaggccgggcacggaggctcacgcctgtaatcccagcactttgggaggccgaggcgggcagatcacgaggttaggagttcgaggccagcctgaccaacatggtgaaacaccatctctataaaaatacaaaaattgtccgggtgtggtggcgggcgcctgtagtcccagctactggggaggctgaggcaggggaattgcttgaacccgggaggcagaggttatcgtgagctgacattgcgccactgcactccagcgcggaagacagagtgagccaaaaaaaaaaaaaaaaaagaaaaagaaaacaaaaagaaaaaaatctcccaaggcagtcatgcatttgtatgccactagcatttttttgttatagaaatattcaaagtgtaccaacgtagagaaaatagctttaaacaaagcccatgtgtacctatcagtatgctttaactgttgtcacctttctgccccacttttatctatctcgaacacccctttctgcacactctttaaaccactgtattaacaaacacattagactgcatcctgccagacctacccatacagacatcaaagtaatgattattgcttattgcctgacctaggatgtgagctccatgagaacagagactgtttacctctcgctcccctgcacctaaaacaatgcctgcttggtgtaaagtaagtgctcagtaattttttaatgtgtgaccaatgaaataacttcaagagcagagagctcttttagattagaggcacatactaagtgccagcattcaacaaaagacagacggaaataagacagatgcaaatagatctcatttattaactgtgtaatgcagctgccactgcaattaaaaaaaaaattttagtatcaacctttcaaattcctcaaaattaaagttatgactaacttcaccagcaaaggaaaaattgaaggatgtatcaagttgccatttctagcccatcaaatcggctttataaagggaagcatagtatctggtattgacgaccttgtagagaaacaggccttttcctgcctcagggaagagagctgactcaaagtaaaggctttgctagaggcagtcggcagagtatttttagcatctaaaatgctcttccacttcggcagtgaccatgcgatgtaatcaaaggagaatacgtaagtgtatggaccaggaatggtcactggagtgttgatgtaggcacaacacaagaagtagtcacagaaattgctaagtctaggtttatgtgtgcatgctgtggagtgtctctgtggtggatttctttttaagaggcagaaaaaaattctaatttaaatgtattaaattataagttctaatttaaatgtattaaaattaaattataagttgataggattattattgacacacaaggagctccaaaagagatcgtatttttattagagacaagccagttgggattgaaacaaaaatggaggggggtatagccctgtgtatgttgcacagaaaaagtatctgaatgataaaggcctaagtgataactctggacaagggatttggattttgggagtagtgcagaggtagaggcatttttgtgatttattgttctattttttcttctagaaaaatgtaagtagtcatatataattttaaaatataaaggagaagaggcaaaatgttgaatggcacctgaggatcctatattcatattggatcagtattaacatccaggttttgattgttgtactatggttacctggtagattccctttgtatataggaaatagacactggaatagtaaggagtagtgggtcaagatgtctgcaacttattgttcagaatcactcacaaatgggaaatctgatataaggacaaaatgggagcactgtggcctatttttacaacttttgtgtacatctgcaattgtttcaaaataaaatgtttaaaagggtgaaaaaaaaa

SEQ ID NO: 62798 - DNA, 3148 bp, Homo sapiens
cccgcgagaattcctgctgctcccgcgagaattcctgctgctaacattaatgagaaggtggccttcagtgtccacctgtggaacccaggacacagcacctgactgcacacagtggctgaaatccagcatttttacataggagatgcacttagcctctaagcctcgttttactcatctgtgaaacagagataagtaaccctctctcatgaactctttgatgaggatttgtaaacgaaaacagactcgaactattgtgtaccaccacatagcacatgcacgtctgtcccagactttgacaacctgcacaagacaagcagcctaaagcaggagagacctccctagggttttgtgtgtgtgcacactaccctcactccccaactggccattaccctagttctgcccttgtttgtggagttacagcctcaaggttgtagcatgtgtgctggcaatcagggccgcagtgtgttctgcgcctgcccagagctgactcctgatttaaccgctggcgtaaccgcgggttgcacgcatgcgtgctgaaaagcctttcaccctcacgtggtttcttttttaaccagtcatcaagcgaggctcgcgcgcaggccccgcgttggaaaatggcggggaagctgaaacctctgaatgtggaggcgccagaagctgctgaggaggctgaaggtagtgagggcaagtgggctgcactcctttctctccaaccagggcagaaaggagggaggattcgtcccattacaataatgaaataatgatattctaatttttttaaataaaatgttaagccttttgttattgaagaaaaacaattttttaaccgttcagcacagtggagataaattaacaggcatattcttatcaccgagattaacttttgtcaactgtagtgtatacgttgttgaaagtaaacaacatgtagttcagtacgaaagtcttcaaacaaaagtggggcggtggggatgttctcataacaatcaccgtgctgcagccaccccttattaacagtaattcccagtgtcgccatttcacacctaacacatatgacactttgatggactcttaaacctcctaatcgaacatggcctcccccacagcctcttttctccagggtattgacttgaatgacaggcaaaggagggtggaggggtgtcggcctagacactattggaaattgtattccatccaaaagaaaaaaaaatctcaggccgggcacggaggctcacgcctgtaatcccagcactttgggaggccgaggcgggcagatcacgaggttaggagttcgaggccagcctgaccaacatggtgaaacaccatctctataaaaatacaaaaattgtccgggtgtggtggcgggcgcctgtagtcccagctactggggaggctgaggcaggggaattgcttgaacccgggaggcagaggttatcgtgagctgacattgcgccactgcactccagcgcggaagacagagtgagccaaaaaaaaaaaaaaaaaagaaaaagaaaacaaaaagaaaaaaatctcccaaggcagtcatgcatttgtatgccactagcatttttttgttatagaaatattcaaagtgtaccaacgtagagaaaatagctttaaacaaagcccatgtgtacctatcagtatgctttaactgttgtcacctttctgccccacttttatctatctcgaacacccctttctgcacactctttaaaccactgtattaacaaacacattagactgcatcctgccagacctacccatacagacatcaaagtaatgattattgcttattgcctgacctaggatgtgagctccatgagaacagagactgtttacctctcgctcccctgcacctaaaacaatgcctgcttggtgtaaagtaagtgctcagtaattttttaatgtgtgaccaatgaaataacttcaagagcagagagctcttttagattagaggcacatactaagtgccagcattcaacaaaagacagacggaaataagacagatgcaaatagatctcatttattaactgtgtaatgcagctgccactgcaattaaaaaaaaaattttagtatcaacctttcaaattcctcaaaattaaagttatgactaacttcaccagcaaaggaaaaattgaaggatgtatcaagttgccatttctagcccatcaaatcggctttataaagggaagcatagtatctggtattgacgaccttgtagagaaacaggccttttcctgcctcagggaagagagctgactcaaagtaaaggctttgctagaggcagtcggcagagtatttttagcatctaaaatgctcttccacttcggcagtgaccatgcgatgtaatcaaaggagaatacgtaagtgtatggaccaggaatggtcactggagtgttgatgtaggcacaacacaagaagtagtcacagaaattgctaagtctaggtttatgtgtgcatgctgtggagtgtctctgtggtggatttctttttaagaggcagaaaaaaattctaatttaaatgtattaaattataagttctaatttaaatgtattaaaattaaattataagttgataggattattattgacacacaaggagctccaaaagagatcgtatttttattagagacaagccagttgggattgaaacaaaaatggaggggggtatagccctgtgtatgttgcacagaaaaagtatctgaatgataaaggcctaagtgataactctggacaagggatttggattttgggagtagtgcagaggtagaggcatttttgtgatttattgttctattttttcttctagaaaaatgtaagtagtcatatataattttaaaatataaaggagaagaggcaaaatgttgaatggcacctgaggatcctatattcatattggatcagtattaacatccaggttttgattgttgtactatggttacctggtagattccctttgtatataggaaatagacactggaatagtaaggagtagtgggtcaagatgtctgcaacttattgttcagaatcactcacaaatgggaaatctgatataaggacaaaatgggagcactgtggcctatttttacaacttttgtgtacatctgcaattgtttcaaaataaaatgtttaaaagggtgaaaaaaaaa

SEQ ID NO: 62799 - DNA, 2869 bp, Homo sapiens
ggcgaagtgggcctcgctctcccgggttcgcagccgtagccagatccgttgaaaggagtgcagagaggtctcattgcgctcccgaacagacctgacgtagatccgaagtggcccgcgccatctcaactatgaggggacacccgtaggcggcgggagagggacgccgcgaggagccaataaagctccgcaaccggaagtgtcttctgggaggggtcgtacccggaagtgtggcacctcccgggccgcacccggaagtgtgatgccaccgccgctacggggaagtaatggtatccggccaattgagattcggagttaaaacagggatgtgcagatggaggtcggaggagacactgctgccccggcccccgggggcgcggaggacttggaggacacgcagttccccagtgaggaagctagagaaggtggaggggttcacgcggtcccgccggatcccgaagacgagggcctggaggaaacaggatccaaggacaaggaccagccacccagcccatcaccaccgccccagtcagaggccctgtcaagcacctctcggctctggagtcctgcagcccctgagaatagtcccacatgtagccctgagagtagctctggaggccagggcggggaccccagtgatgaggagtggcgcagccagcggaagcatgtgtttgtgctgagtgaggctggcaagcccatctactcgcggtatggtagtgtggaggcgctgtcggctaccatgggtgtaatgaccgccctggtgtcctttgtgcagagtgcgggagatgccatccgtgccatctacgctgaggaccacaagctggtgttcctacaacagggcccactgttgctcgtggccatgtcacggacttctcagtcagcagcccagctgcggggggagctgctagctgtgcacgcacagatcgtgagcacacttacacgtgcaagtgtcgcccgcatcttcgcacacaagcagaactatgacctccgccgcctgctggctggttcagagcgcacactggaccgacttctggacagtatggagcaggacccaggagccctgctcctgggtgccgtgcgctgtgtgccccttgcccgcccgctgcgagacgcactaggtgcgctcctccgacgttgcacagcgcctggcctggcgctgtcagtgctggcagtaggcggtcgacttataacagcagcccaggagcggaatgtgctggccgagtgccggctggacccagctgacctgcagttgctgctcgactgggtgggtgcaccagcctttgcggcgggtgaggcttgggcacctgtgtgcctgccccgcttcaaccctgatggttttttctacgcctacgtggcccgcctggatgctatgcctgtctgcctgctgctgcttggcacccaacgtgaagccttccatgccatggccgcctgccggcgcctggtcgaagatgggatgcatgcccttggtgccatgcgtgcccttggggaggctgccagcttctctaatgcctcatcagccagtgctcctgcctacagcgtgcaggctgtcggggcgccgggcctccggcacttcctgtataagccgctggacatccctgaccaccaccgccaactgccccagtttaccagccctgagctagaggccccctacagcagagaggaggagcggcagcggctgtcggacctgtaccaccgcctgcatgctcgtctccacagcacctcccgacccctgcgcctcatttaccacgtggctgagaaggagacactactggcctgggtgacctccaaattcgagctctatacctgcctcagccctctggtgaccaaggcaggtgcaatcttggtagtgaccaaactcctgcgctgggtgaagaaagaggaggaccggctcttcattcgttacccacccaagtactccacaccaccagccacctctacggaccaagctgcccataatggcttgttcactggactctgatagttggagctcccagaccaggcagtgctgggagcaaccacctttgttttttaccttctgtctaccctggaaatgtgtgtgggggtgtgtctgtggccagtcattgtctccctaagcaatggggcaaggtctgagggcccaccgatgagagagatggtggcagccgccaggcgagcaggctgctttccctgcccagtcatgcacctccccctctggggaaatccttaggcctccctctcccttccctctgtctcatctcctccacttggatgatgctctagcctctgtcagggactgtcccctccaaacttgcttccgtggtctgcctcctagttgaatctcagccctgagtgtccagatctggccaaggtgtctagggtggcccacgggggtgctggaattggcacttcagggccaggctatgcttgggactggcctgagggtattttaaagaaaaaaactacataaaaggcctaaaagtaagacccacaaggatattcctttgcccttcttgtacttttttcatctttaccctgccagaaatgacccgccctcaatgctggctgctgctaacattaatgagaaggtggccttcagtgtccacctgtggaacccaggacacagcacctgactgcacacagtggctgaaatccagcatttttacataggagatgcacttagcgctcgcgcgcaggccccgcgttggaaaatggcggggaagctgaaacctctgaatgtggaggcgccagaagctgctgaggaggctgaaggtagtgagggcaagtgggctgcactcctttctctccaaccagggcagaaaggagggaggattcgtcccattacaataatgaaataatgatattctaatttttttaaataaaatgttaagccttt

SEQ ID NO: 62800 - DNA, 2260 bp, Homo sapiens
ggcgaagtgggcctcgctctcccgggttcgcagccgtagccagatccgttgaaaggagtgcagagaggtctcattgcgctcccgaacagacctgacgtagatccgaagtggcccgcgccatctcaactatgaggggacacccgtaggcggcgggagagggacgccgcgaggagccaataaagctccgcaaccggaagtgtcttctgggaggggtcgtacccggaagtgtggcacctcccgggccgcacccggaagtgtgatgccaccgccgctacggggaagtaatggtatccggccaattgagattcggagttaaaacagggatgtgcagatggaggtcggaggagacactgctgccccggcccccgggggcgcggaggacttggaggacacgcagttccccagtgaggaagctagagaaggtggaggggttcacgcggtcccgccggatcccgaagacgagggcctggaggaaacaggatccaaggacaaggaccagccacccagcccatcaccaccgccccagtcagaggccctgtcaagcacctctcggctctggagtcctgcagcccctgagaatagtcccacatgtagccctgagagtagctctggaggccagggcggggaccccagtgatgaggagtggcgcagccagcggaagcatgtgtttgtgctgagtgaggctggcaagcccatctactcgcggtatggtagtgtggaggcgctgtcggctaccatgggtgtaatgaccgccctggtgtcctttgtgcagagtgcgggagatgccatccgtgccatctacgctgaggaccacaagctggtgttcctacaacagggcccactgttgctcgtggccatgtcacggacttctcagtcagcagcccagctgcggggggagctgctagctgtgcacgcacagatcgtgagcacacttacacgtgcaagtgtcgcccgcatcttcgcacacaagcagaactatgacctccgccgcctgctggctggttcagagcgcacactggaccgacttctggacagtatggagcaggacccaggagccctgctcctgggtgccgtgcgctgtgtgccccttgcccgcccgctgcgagacgcactaggtgcgctcctccgacgttgcacagcgcctggcctggcgctgtcagtgctggcagtaggcggtcgacttataacagcagcccaggagcggaatgtgctggccgagtgccggctggacccagctgacctgcagttgctgctcgactgggtgggtgcaccagcctttgcggcgggtgaggcttgggcacctgtgtgcctgccccgcttcaaccctgatggttttttctacgcctacgtggcccgcctggatgctatgcctgtctgcctgctgctgcttggcacccaacgtgaagccttccatgccatggccgcctgccggcgcctggtcgaagatgggatgcatgcccttggtgccatgcgtgcccttggggaggctgccagcttctctaatgcctcatcagccagtgctcctgcctacagcgtgcaggctgtcggggcgccgggcctccggcacttcctgtataagccgctggacatccctgaccaccaccgccaactgccccagtttaccagccctgagctagaggccccctacagcagagaggaggagcggcagcggctgtcggacctgtaccaccgcctgcatgctcgtctccacagcacctcccgacccctgcgcctcatttaccacgtggctgagaaggagacactactggcctgggtgacctccaaattcgagctctatacctgcctcagccctctggtgaccaaggcaggtgcaatcttggtagtgaccaaactcctgcgctgggtgaagaaagaggaggaccggctcttcattcgttacccacccaagtactccacaccaccagccacctctacggaccaagctgcccataatggcttgttcactggactctgatagttggagctcccagaccaggcagtgctgggagcaaccacctttgttttttaccttctgtctaccctggaaatgtgtgtgggggtgtgtctgtggccagtcattgtctctacaaaaaattaaataagttggccaggctttctggtgcatgcctgtagtccttgctacttgggaggatgaggccagaggattgcttgagcctgggaagtcaaggctggagtgggtcatgatcgcatcactgtactctagcctgggtaacagagtggaagtggagactctgtctca

SEQ ID NO: 62801 - DNA, 5800 bp, Homo sapiens
tagtacgaggctcgggtgtttagcaattgagattcggagttaaaacagggatgtgcagatggaggtcggaggagacactgctgccccggcccccgggggcgcggaggacttggaggacacgcagttccccagtgaggaagctagagaaggtggaggggttcacgcggtcccgccggatcccgaagacgagggcctggaggaaacaggatccaaggacaaggaccagccacccagcccatcaccaccgccccagtcagaggccctgtcaagcacctctcggctctggagtcctgcagcccctgagaatagtcccacatgtagccctgagagtagctctggaggccagggcggggaccccagtgatgaggagtggcgcagccagcggaagcatgtgtttgtgctgagtgaggctggcaagcccatctactcgcggtatggtagtgtggaggcgctgtcggctaccatgggtgtaatgaccgccctggtgtcctttgtgcagagtgcgggagatgccatccgtgccatctacgctgaggaccacaagctggtgttcctacaacagggcccactgttgctcgtggccatgtcacggacttctcagtcagcagcccagctgcggggggagctgctagctgtgcacgcacagatcgtgagcacacttacacgtgcaagtgtcgcccgcatcttcgcacacaagcagaactatgacctccgccgcctgctggctggttcagagcgcacactggaccgacttctggacagtatggagcaggacccaggagccctgctcctgggtgccgtgcgctgtgtgccccttgcccgcccgctgcgagacgcactaggtgcgctcctccgacgttgcacagcgcctggcctggcgctgtcagtgctggcagtaggcggtcgacttataacagcagcccaggagcggaatgtgctggccgagtgccggctggacccagctgacctgcagttgctgctcgactgggtgggtgcaccagcctttgcggcgggtgaggcttgggcacctgtgtgcctgccccgcttcaaccctgatggttttttctacgcctacgtggcccgcctggatgctatgcctgtctgcctgctgctgcttggcacccaacgtgaagccttccatgccatggccgcctgccggcgcctggtcgaagatgggatgcatgcccttggtgccatgcgtgcccttggggaggctgccagcttctctaatgcctcatcagccagtgctcctgcctacagcgtgcaggctgtcggggcgccgggcctccggcacttcctgtataagccgctggacatccctgaccaccaccgccaactgccccagtttaccagccctgagctagaggccccctacagcagagaggaggagcggcagcggctgtcggacctgtaccaccgcctgcatgctcgtctccacagcacctcccgacccctgcgcctcatttaccacgtggctgagaaggagacactactggcctgggtgacctccaaattcgagctctatacctgcctcagccctctggtgaccaaggcaggtgcaatcttggtagtgaccaaactcctgcgctgggtgaagaaagaggaggaccggctcttcattcgttacccacccaagtactccacaccaccagccacctctacggaccaagctgcccataatggcttgttcactggactctgatagttggagctcccagaccaggcagtgctgggagcaaccacctttgttttttaccttctgtctaccctggaaatgtgtgtgggggtgtgtctgtggccagtcattgtctccctaagcaatggggcaaggtctgagggcccaccgatgagagagatggtggcagccgccaggcgagcaggctgctttccctgcccagtcatgcacctccccctctggggaaatccttaggcctccctctcccttccctctgtctcatctcctccacttggatgatgctctagcctctgtcagggactgtcccctccaaacttgcttccgtggtctgcctcctagttgaatctcagccctgagtgtccagatctggccaaggtgtctagggtggcccacgggggtgctggaattggcacttcagggccaggctatgcttgggactggcctgagggtattttaaagaaaaaaactacataaaaggcctaaaagtaagacccacaaggatattcctttgcccttcttgtacttttttcatctttaccctgccagaaatgacccgccctcaatgctggctgctgctaacattaatgagaaggtggccttcagtgtccacctgtggaacccaggacacagcacctgactgcacacagtggctgaaatccagcatttttacataggagatgcacttagcctctaagcctcgttttactcatctgtgaaacagagataagtaaccctctctcatgaactctttgatgaggatttgtaaacgaaaacagactcgaactattgtgtaccaccacatagcacatgcacgtctgtcccagactttgacaacctgcacaagacaagcagcctaaagcaggagagacctccctagggttttgtgtgtgtgcacactaccctcactccccaactggccattaccctagttctgcccttgtttgtggagttacagcctcaaggttgtagcatgtgtgctggcaatcagggccgcagtgtgttctgcgcctgcccagagctgactcctgatttaaccgctggcgtaaccgcgggttgcacgcatgcgtgctgaaaagcctttcaccctcacgtggtttcttttttaaccagtcatcaagcgaggctcgcgcgcaggccccgcgttggaaaatggcggggaagctgaaacctctgaatgtggaggcgccagaagctgctgaggaggctgaaggtagtgagggcaagtgggctgcactcctttctctccaaccagggcagaaaggagggaggattcgtcccattacaataatgaaataatgatattctaatttttttaaataaaatgttaagccttttgttattgaagaaaaacaattttttaaccgttcagcacagtggagataaattaacaggcatattcttatcaccgagattaacttttgtcaactgtagtgtatacgttgttgaaagtaaacaacatgtagttcagtacgaaagtcttcaaacaaaagtggggcggtggggatgttctcataacaatcaccgtgctgcagccaccccttattaacagtaattcccagtgtcgccatttcacacctaacacatatgacactttgatggactcttaaacctcctaatcgaacatggcctcccccacagcctcttttctccagggtattgacttgaatgacaggcaaaggagggtggaggggtgtcggcctagacactattggaaattgtattccatccaaaagaaaaaaaaatctcaggccgggcacggaggctcacgcctgtaatcccagcactttgggaggccgaggcgggcagatcacgaggttaggagttcgaggccagcctgaccaacatggtgaaacaccatctctactaaaaaactatatatacatatacatatgtgtgtatgtgtatttatatgtatgtatgtatgtgtgtgtgtatatatatatatatatgtatatgtgtatatatatatatatgtgtatatatatatatatatacacacactaatcagccgggcacggtggtgtgggcctgtaatcgcagctactcaggaagctgaggcaggagaatcacttgaacccgagaggcggaggttgcagtgagccgagatcatgtcactgcactccagcctgggtgacagagtgagactccgtctcaaaagaaaaaaaattctcccttggccgggcttggtggcttatgcctgtaatcccagcactttggaaggccgaggcgggtgggtcacctgaggtcaggagtttgagaccagcctggccagcatggcgaaacctcgtctctactaaaaatacaaaaattgtccgggtgtggtggcgggcgcctgtagtcccagctactggggaggctgaggcaggggaattgcttgaacccgggaggcagaggttatcgtgagctgacattgcgccactgcactccagcgcggaagacagagtgagccaaaaaaaaaaaaaaaaaagaaaaagaaaacaaaaagaaaaaaatctcccaaggcagtcatgcatttgtatgccactagcatttttttgttatagaaatattcaaagtgtaccaacgtagagaaaatagctttaaacaaagcccatgtgtacctatcagtatgctttaactgttgtcacctttctgccccacttttatctatctcgaacacccctttctgcacactctttaaaccactgtattaacaaacacattagactgcatcctgccagacctacccatacagacatcaaagtaatgattattgcttattgcctgacctaggatgtgagctccatgagaacagagactgtttacctctcgctcccctgcacctaaaacaatgcctgcttggtgtaaagtaagtgctcagtaattttttaatgtgtgaccaatgaaataacttcaagagcagagagctcttttagattagaggcacatactaagtgccagcattcaacaaaagacagacggaaataagacagatgcaaatagatctcatttattaactgtgtaatgcagctgccactgcaattaaaaaaaaaattttagtatcaacctttcaaattcctcaaaattaaagttatgactaacttcaccagcaaaggaaaaattgaaggatgtatcaagttgccatttctagcccatcaaatcggctttataaagggaagcatagtatctggtattgacgaccttgtagagaaacaggccttttcctgcctcagggaagagagctgactcaaagtaaaggctttgctagaggcagtcggcagagtatttttagcatctaaaatgctcttccacttcggcagtgaccatgcgatgtaatcaaaggagaatacgtaagtgtatggaccaggaatggtcactggagtgttgatgtaggcacaacacaagaagtagtcacagaaattgctaagtctaggtttatgtgtgcatgctgtggagtgtctctgtggtggatttctttttaagaggcagaaaaaaattctaatttaaatgtattaaattataagttctaatttaaatgtattaaaattaaattataagttgataggattattattgacacacaaggagctccaaaagagatcgtatttttattagagacaagccagttgggattgaaacaaaaatggaggggggtatagccctgtgtatgttgcacagaaaaagtatctgaatgataaaggcctaagtgataactctggacaagggatttggattttgggagtagtgcagaggtagaggcatttttgtgatttattgttctattttttcttctagaaaaatgtaagtagtcatatataattttaaaatataaaggagaagaggcaaaatgttgaatggcacctgaggatcctatattcatattggatcagtattaacatccaggttttgattgttgtactatggttacctggtagattccctttgtatataggaaataggtcccgtacagctaggggttccgcgggtataaggtctgaatatttcggtccaaaggccctacaaattggaatttgtaagtgaggaccaaactggaccctctggaacgattcaaatccactagtgtgccatactgcaatcgtttgtaaatataatgttttcaagggt

SEQ ID NO: 62802 - DNA, 5354 bp, Homo sapiens
ggcgaagtgggcctcgctctcccgggttcgcagccgtagccagatccgttgaaaggagtgcagagaggtctcattgcgctcccgaacagacctgacgtagatccgaagtggcccgcgccatctcaactatgaggggacacccgtaggcggcgggagagggacgccgcgaggagccaataaagctccgcaaccggaagtgtcttctgggaggggtcgtacccggaagtgtggcacctcccgggccgcacccggaagtgtgatgccaccgccgctacggggaagtaatggtatccggccaattgagattcggagttaaaacagggatgtgcagatggaggtcggaggagacactgctgccccggcccccgggggcgcggaggacttggaggacacgcagttccccagtgaggaagctagagaaggtggaggggttcacgcggtcccgccggatcccgaagacgagggcctggaggaaacaggatccaaggacaaggaccagccacccagcccatcaccaccgccccagtcagaggccctgtcaagcacctctcggctctggagtcctgcagcccctgagaatagtcccacatgtagccctgagagtagctctggaggccagggcggggaccccagtgatgaggagtggcgcagccagcggaagcatgtgtttgtgctgagtgaggctggcaagcccatctactcgcggtatggtagtgtggaggcgctgtcggctaccatgggtgtaatgaccgccctggtgtcctttgtgcagagtgcgggagatgccatccgtgccatctacgctgaggaccacaagctggtgttcctacaacagggcccactgttgctcgtggccatgtcacggacttctcagtcagcagcccagctgcggggggagctgctagctgtgcacgcacagatcgtgagcacacttacacgtgcaagtgtcgcccgcatcttcgcacacaagcagaactatgacctccgccgcctgctggctggttcagagcgcacactggaccgacttctggacagtatggagcaggacccaggagccctgctcctgggtgccgtgcgctgtgtgccccttgcccgcccgctgcgagacgcactaggtgcgctcctccgacgttgcacagcgcctggcctggcgctgtcagtgctggcagtaggcggtcgacttataacagcagcccaggagcggaatgtgctggccgagtgccggctggacccagctgacctgcagttgctgctcgactgggtgggtgcaccagcctttgcggcgggtgaggcttgggcacctgtgtgcctgccccgcttcaaccctgatggttttttctacgcctacgtggcccgcctggatgctatgcctgtctgcctgctgctgcttggcacccaacgtgaagccttccatgccatggccgcctgccggcgcctggtcgaagatgggatgcatgcccttggtgccatgcgtgcccttggggaggctgccagcttctctaatgcctcatcagccagtgctcctgcctacagcgtgcaggctgtcggggcgccgggcctccggcacttcctgtataagccgctggacatccctgaccaccaccgccaactgccccagtttaccagccctgagctagaggccccctacagcagagaggaggagcggcagcggctgtcggacctgtaccaccgcctgcatgctcgtctccacagcacctcccgacccctgcgcctcatttaccacgtggctgagaaggagacactactggcctgggtgacctccaaattcgagctctatacctgcctcagccctctggtgaccaaggcaggtgcaatcttggtagtgaccaaactcctgcgctgggtgaagaaagaggaggaccggctcttcattcgttacccacccaagtactccacaccaccagccacctctacggaccaagctgcccataatggcttgttcactggactctgatagttggagctcccagaccaggcagtgctgggagcaaccacctttgttttttaccttctgtctaccctggaaatgtgtgtgggggtgtgtctgtggccagtcattgtctccctaagcaatggggcaaggtctgagggcccaccgatgagagagatggtggcagccgccaggcgagcaggctgctttccctgcccagtcatgcacctccccctctggggaaatccttaggcctccctctcccttccctctgtctcatctcctccacttggatgatgctctagcctctgtcagggactgtcccctccaaacttgcttccgtggtctgcctcctagttgaatctcagccctgagtgtccagatctggccaaggtgtctagggtggcccacgggggtgctggaattggcacttcagggccaggctatgcttgggactggcctgagggtattttaaagaaaaaaactacataaaaggcctaaaagtaagacccacaaggatattcctttgcccttcttgtacttttttcatctttaccctgccagaaatgacccgccctcaatgctggctgctgctaacattaatgagaaggtggccttcagtgtccacctgtggaacccaggacacagcacctgactgcacacagtggctgaaatccagcatttttacataggagatgcacttagcctctaagcctcgttttactcatctgtgaaacagagataagtaaccctctctcatgaactctttgatgaggatttgtaaacgaaaacagactcgaactattgtgtaccaccacatagcacatgcacgtctgtcccagactttgacaacctgcacaagacaagcagcctaaagcaggagagacctccctagggttttgtgtgtgtgcacactaccctcactccccaactggccattaccctagttctgcctcctttctctccaaccagggcagaaaggagggaggattcgtcccattacaataatgaaataatgatattctaatttttttaaataaaatgttaagccttttgttattgaagaaaaacaattttttaaccgttcagcacagtggagataaattaacaggcatattcttatcaccgagattaacttttgtcaactgtagtgtatacgttgttgaaagtaaacaacatgtagttcagtacgaaagtcttcaaacaaaagtggggcggtggggatgttctcataacaatcaccgtgctgcagccaccccttattaacagtaattcccagtgtcgccatttcacacctaacacatatgacactttgatggactcttaaacctcctaatcgaacatggcctcccccacagcctcttttctccagggtattgacttgaatgacaggcaaaggagggtggaggggtgtcggcctagacactattggaaattgtattccatccaaaagaaaaaaaaatctcaggccgggcacggaggctcacgcctgtaatcccagcactttgggaggccgaggcgggcagatcacgaggttaggagttcgaggccagcctgaccaacatggtgaaacaccatctctataaaaatacaaaaattgtccgggtgtggtggcgggcgcctgtagtcccagctactggggaggctgaggcaggggaattgcttgaacccgggaggcagaggttatcgtgagctgacattgcgccactgcactccagcgcggaagacagagtgagccaaaaaaaaaaaaaaaaaagaaaaagaaaacaaaaagaaaaaaatctcccaaggcagtcatgcatttgtatgccactagcatttttttgttatagaaatattcaaagtgtaccaacgtagagaaaatagctttaaacaaagcccatgtgtacctatcagtatgctttaactgttgtcacctttctgccccacttttatctatctcgaacacccctttctgcacactctttaaaccactgtattaacaaacacattagactgcatcctgccagacctacccatacagacatcaaagtaatgattattgcttattgcctgacctaggatgtgagctccatgagaacagagactgtttacctctcgctcccctgcacctaaaacaatgcctgcttggtgtaaagtaagtgctcagtaattttttaatgtgtgaccaatgaaataacttcaagagcagagagctcttttagattagaggcacatactaagtgccagcattcaacaaaagacagacggaaataagacagatgcaaatagatctcatttattaactgtgtaatgcagctgccactgcaattaaaaaaaaaattttagtatcaacctttcaaattcctcaaaattaaagttatgactaacttcaccagcaaaggaaaaattgaaggatgtatcaagttgccatttctagcccatcaaatcggctttataaagggaagcatagtatctggtattgacgaccttgtagagaaacaggccttttcctgcctcagggaagagagctgactcaaagtaaaggctttgctagaggcagtcggcagagtatttttagcatctaaaatgctcttccacttcggcagtgaccatgcgatgtaatcaaaggagaatacgtaagtgtatggaccaggaatggtcactggagtgttgatgtaggcacaacacaagaagtagtcacagaaattgctaagtctaggtttatgtgtgcatgctgtggagtgtctctgtggtggatttctttttaagaggcagaaaaaaattctaatttaaatgtattaaattataagttctaatttaaatgtattaaaattaaattataagttgataggattattattgacacacaaggagctccaaaagagatcgtatttttattagagacaagccagttgggattgaaacaaaaatggaggggggtatagccctgtgtatgttgcacagaaaaagtatctgaatgataaaggcctaagtgataactctggacaagggatttggattttgggagtagtgcagaggtagaggcatttttgtgatttattgttctattttttcttctagaaaaatgtaagtagtcatatataattttaaaatataaaggagaagaggcaaaatgttgaatggcacctgaggatcctatattcatattggatcagtattaacatccaggttttgattgttgtactatggttacctggtagattccctttgtatataggaaatagacactggaatagtaaggagtagtgggtcaagatgtctgcaacttattgttcagaatcactcacaaatgggaaatctgatataaggacaaaatgggagcactgtggcctatttttacaacttttgtgtacatctgcaattgtttcaaaataaaatgtttaaaagggtgaaaaaaaaa

SEQ ID NO: 62803 - DNA, 3303 bp, Homo sapiens
ggcgaagtgggcctcgctctcccgggttcgcagccgtagccagatccgttgaaaggagtgcagagaggtctcattgcgctcccgaacagacctgacgtagatccgaagtggcccgcgccatctcaactatgaggggacacccgtaggcggcgggagagggacgccgcgaggagccaataaagctccgcaaccggaagtgtcttctgggaggggtcgtacccggaagtgtggcacctcccgggccgcacccggaagtgtgatgccaccgccgctacggggaagtaatggtatccggccaattgagattcggagttaaaacagggatgtgcagatggaggtcggaggagacactgctgccccggcccccgggggcgcggaggacttggaggacacgcagttccccagtgaggaagctagagaaggtggaggggttcacgcggtcccgccggatcccgaagacgagggcctggaggaaacaggatccaaggacaaggaccagccacccagcccatcaccaccgccccagtcagaggccctgtcaagcacctctcggctctggagtcctgcagcccctgagaatagtcccacatgtagccctgagagtagctctggaggccagggcggggaccccagtgatgaggagtggcgcagccagcggaagcatgtgtttgtgctgagtgaggctggcaagcccatctactcgcggtatggtagtgtggaggcgctgtcggctaccatgggtgtaatgaccgccctggtgtcctttgtgcagagtgcgggagatgccatccgtgccatctacgctgaggaccacaagctggtgttcctacaacagggcccactgttgctcgtggccatgtcacggacttctcagtcagcagcccagctgcggggggagctgctagctgtgcacgcacagatcgtgagcacacttacacgtgcaagtgtcgcccgcatcttcgcacacaagcagaactatgacctccgccgcctgctggctggttcagagcgcacactggaccgacttctggacagtatggagcaggacccaggagccctgctcctgggtgccgtgcgctgtgtgccccttgcccgcccgctgcgagacgcactaggtgcgctcctccgacgttgcacagcgcctggcctggcgctgtcagtgctggcagtaggcggtcgacttataacagcagcccaggagcggaatgtgctggccgagtgccggctggacccagctgacctgcagttgctgctcgactgggtgggtgcaccagcctttgcggcgggtgaggcttgggcacctgtgtgcctgccccgcttcaaccctgatggttttttctacgcctacgtggcccgcctggatgctatgcctgtctgcctgctgctgcttggcacccaacgtgaagccttccatgccatggccgcctgccggcgcctggtcgaagatgggatgcatgcccttggtgccatgcgtgcccttggggaggctgccagcttctctaatgcctcatcagccagtgctcctgcctacagcgtgcaggctgtcggggcgccgggcctccggcacttcctgtataagccgctggacatccctgaccaccaccgccaactgccccagtttaccagccctgagctagaggccccctacagcagagaggaggagcggcagcggctgtcggacctgtaccaccgcctgcatgctcgtctccacagcacctcccgacccctgcgcctcatttaccacgtggctgagaaggagacactactggcctgggtgacctccaaattcgagctctatacctgcctcagccctctggtgaccaaggcaggtgcaatcttggtagtgaccaaactcctgcgctgggtgaagaaagaggaggaccggctcttcattcgttacccacccaagtactccacaccaccagccacctctacggaccaagctgcccataatggcttgttcactggactctgatagttggagctcccagaccaggcagtgctgggagcaaccacctttgttttttaccttctgtctaccctggaaatgtgtgtgggggtgtgtctgtggccagtcattgtctccctaagcaatggggcaaggtctgagggcccaccgatgagagagatggtggcagccgccaggcgagcaggctgctttccctgcccagtcatgcacctccccctctggggaaatccttaggcctccctctcccttccctctgtctcatctcctccacttggatgatgctctagcctctgtcagggactgtcccctccaaacttgcttccgtggtctgcctcctagttgaatctcagccctgagtgtccagatctggccaaggtgtctagggtggcccacgggggtgctggaattggcacttcagggccaggctatgcttgggactggcctgagggtattttaaagaaaaaaactacataaaaggcctaaaagtaagacccacaaggatattcctttgcccttcttgtacttttttcatctttaccctgccagaaatgacccgccctcaatgctggctgctgctaacattaatgagaaggtggccttcagtgtccacctgtggaacccaggacacagcacctgactgcacacagtggctgaaatccagcatttttacataggagatgcacttagcctctaagcctcgttttactcatctgtgaaacagagataagtaaccctctctcatgaactctttgatgaggatttgtaaacgaaaacagactcgaactattgtgtaccaccacatagcacatgcacgtctgtcccagactttgacaacctgcacaagacaagcagcctaaagcaggagagacctccctagggttttgtgtgtgtgcacactaccctcactccccaactggccattaccctagttctgcccttgtttgtggagttacagcctcaaggttgtagcatgtgtgctggcaatcagggccgcagtgtgttctgcgcctgcccagagctgactcctgatttaaccgctggcgtaaccgcgggttgcacgcatgcgtgctgaaaagcctttcaccctcacgtggtttcttttttaaccagtcatcaagcgaggctcgcgcgcaggccccgcgttggaaaatggcggggaagctgaaacctctgaatgtggaggcgccagaagctgctgaggaggctgaaggtagtgagggcaagtgggctgcactcctttctctccaaccagggcagaaaggagggaggattcgtcccattacaataatgaaataatgatattctaatttttttaaataaaatgttaagccttt

SEQ ID NO: 62804 - DNA, 4680 bp, Homo sapiens
ggcgaagtgggcctcgctctcccgggttcgcagccgtagccagatccgttgaaaggagtgcagagaggtctcattgcgctcccgaacagacctgacgtagatccgaagtggcccgcgccatctcaactatgaggggacacccgtaggcggcgggagagggacgccgcgaggagccaataaagctccgcaaccggaagtgtcttctgggaggggtcgtacccggaagtgtggcacctcccgggccgcacccggaagtgtgatgccaccgccgctacggggaagtaatggtatccggccaattgagattcggagttaaaacagggatgtgcagatggaggtcggaggagacactgctgccccggcccccgggggcgcggaggacttggaggacacgcagttccccagtgaggaagctagagaaggtggaggggttcacgcggtcccgccggatcccgaagacgagggcctggaggaaacaggatccaaggacaaggaccagccacccagcccatcaccaccgccccagtcagaggccctgtcaagcacctctcggctctggagtcctgcagcccctgagaatagtcccacatgtagccctgagagtagctctggaggccagggcggggaccccagtgatgaggagtggcgcagccagcggaagcatgtgtttgtgctgagtgaggctggcaagcccatctactcgcggtatggtagtgtggaggcgctgtcggctaccatgggtgtaatgaccgccctggtgtcctttgtgcagagtgcgggagatgccatccgtgccatctacgctgaggaccacaagctggtgttcctacaacagggcccactgttgctcgtggccatgtcacggacttctcagtcagcagcccagctgcggggggagctgctagctgtgcacgcacagatcgtgagcacacttacacgtgcaagtgtcgcccgcatcttcgcacacaagcagaactatgacctccgccgcctgctggctggttcagagcgcacactggaccgacttctggacagtatggagcaggacccaggagccctgctcctgggtgccgtgcgctgtgtgccccttgcccgcccgctgcgagacgcactaggtgcgctcctccgacgttgcacagcgcctggcctggcgctgtcagtgctggcagtaggcggtcgacttataacagcagcccaggagcggaatgtgctggccgagtgccggctggacccagctgacctgcagttgctgctcgactgggtgggtgcaccagcctttgcggcgggtgaggcttgggcacctgtgtgcctgccccgcttcaaccctgatggttttttctacgcctacgtggcccgcctggatgctatgcctgtctgcctgctgctgcttggcacccaacgtgaagccttccatgccatggccgcctgccggcgcctggtcgaagatgggatgcatgcccttggtgccatgcgtgcccttggggaggctgccagcttctctaatgcctcatcagccagtgctcctgcctacagcgtgcaggctgtcggggcgccgggcctccggcacttcctgtataagccgctggacatccctgaccaccaccgccaactgccccagtttaccagccctgagctagaggccccctacagcagagaggaggagcggcagcggctgtcggacctgtaccaccgcctgcatgctcgtctccacagcacctcccgacccctgcgcctcatttaccacgtggctgagaaggagacactactggcctgggtgacctccaaattcgagctctatacctgcctcagccctctggtgaccaaggcaggtgcaatcttggtagtgaccaaactcctgcgctgggtgaagaaagaggaggaccggctcttcattcgttacccacccaagtactccacaccaccagccacctctacggaccaagctgcccataatggcttgttcactggactctgatagttggagctcccagaccaggcagtgctgggagcaaccacctttgttttttaccttctgtctaccctggaaatgtgtgtgggggtgtgtctgtggccagtcattgtctccctaagcaatggggcaaggtctgagggcccaccgatgagagagatggtggcagccgccaggcgagcaggctgctttccctgcccagtcatgcacctccccctctggggaaatccttaggcctccctctcccttccctctgtctcattcctttctctccaaccagggcagaaaggagggaggattcgtcccattacaataatgaaataatgatattctaatttttttaaataaaatgttaagccttttgttattgaagaaaaacaattttttaaccgttcagcacagtggagataaattaacaggcatattcttatcaccgagattaacttttgtcaactgtagtgtatacgttgttgaaagtaaacaacatgtagttcagtacgaaagtcttcaaacaaaagtggggcggtggggatgttctcataacaatcaccgtgctgcagccaccccttattaacagtaattcccagtgtcgccatttcacacctaacacatatgacactttgatggactcttaaacctcctaatcgaacatggcctcccccacagcctcttttctccagggtattgacttgaatgacaggcaaaggagggtggaggggtgtcggcctagacactattggaaattgtattccatccaaaagaaaaaaaaatctcaggccgggcacggaggctcacgcctgtaatcccagcactttgggaggccgaggcgggcagatcacgaggttaggagttcgaggccagcctgaccaacatggtgaaacaccatctctataaaaatacaaaaattgtccgggtgtggtggcgggcgcctgtagtcccagctactggggaggctgaggcaggggaattgcttgaacccgggaggcagaggttatcgtgagctgacattgcgccactgcactccagcgcggaagacagagtgagccaaaaaaaaaaaaaaaaaagaaaaagaaaacaaaaagaaaaaaatctcccaaggcagtcatgcatttgtatgccactagcatttttttgttatagaaatattcaaagtgtaccaacgtagagaaaatagctttaaacaaagcccatgtgtacctatcagtatgctttaactgttgtcacctttctgccccacttttatctatctcgaacacccctttctgcacactctttaaaccactgtattaacaaacacattagactgcatcctgccagacctacccatacagacatcaaagtaatgattattgcttattgcctgacctaggatgtgagctccatgagaacagagactgtttacctctcgctcccctgcacctaaaacaatgcctgcttggtgtaaagtaagtgctcagtaattttttaatgtgtgaccaatgaaataacttcaagagcagagagctcttttagattagaggcacatactaagtgccagcattcaacaaaagacagacggaaataagacagatgcaaatagatctcatttattaactgtgtaatgcagctgccactgcaattaaaaaaaaaattttagtatcaacctttcaaattcctcaaaattaaagttatgactaacttcaccagcaaaggaaaaattgaaggatgtatcaagttgccatttctagcccatcaaatcggctttataaagggaagcatagtatctggtattgacgaccttgtagagaaacaggccttttcctgcctcagggaagagagctgactcaaagtaaaggctttgctagaggcagtcggcagagtatttttagcatctaaaatgctcttccacttcggcagtgaccatgcgatgtaatcaaaggagaatacgtaagtgtatggaccaggaatggtcactggagtgttgatgtaggcacaacacaagaagtagtcacagaaattgctaagtctaggtttatgtgtgcatgctgtggagtgtctctgtggtggatttctttttaagaggcagaaaaaaattctaatttaaatgtattaaattataagttctaatttaaatgtattaaaattaaattataagttgataggattattattgacacacaaggagctccaaaagagatcgtatttttattagagacaagccagttgggattgaaacaaaaatggaggggggtatagccctgtgtatgttgcacagaaaaagtatctgaatgataaaggcctaagtgataactctggacaagggatttggattttgggagtagtgcagaggtagaggcatttttgtgatttattgttctattttttcttctagaaaaatgtaagtagtcatatataattttaaaatataaaggagaagaggcaaaatgttgaatggcacctgaggatcctatattcatattggatcagtattaacatccaggttttgattgttgtactatggttacctggtagattccctttgtatataggaaatagacactggaatagtaaggagtagtgggtcaagatgtctgcaacttattgttcagaatcactcacaaatgggaaatctgatataaggacaaaatgggagcactgtggcctatttttacaacttttgtgtacatctgcaattgtttcaaaataaaatgtttaaaagggtgaaaaaaaaa

SEQ ID NO: 62805 - DNA, 414 bp, Homo sapiens
tctaatttttttagttttattttctaggaagttttaggctgaaagccacatataattagttatgtgataactatgagttgccatggctactgaattggacatgggacccttagactgctacccagcaccttgttaagtacttagcaagagttagatactactgttgtaatattactaggatgccatccagaaaatgtaaggaatgtcttttgacctgataaactccttagaactccttcatcttttataaagaggagtatccctctcctagatatagctgcttctgaccccaaaggcagatgtgttggttttcaactagaaagctaaatggtacctataaattttttttttcttaaactgttttaaactcttaatcttcaaaatatatacttctttgattctggtcaaaccatt

SEQ ID NO: 62806 - DNA, 452 bp, Homo sapiens
gcacaacaaaaaataaaataaaatccttctgagaaagaaaagaaactactatctcagaaatgcaagcctcctgtaaatgatcaggtccagagaagcatggggatgagacagcagtcatatcccacctcctgcctgccttgagctaaacaaccacctcttgaagctgctggccatgtgcactgaagactgcttgccaccacaggtagctatacatcaacttaacaatgctgcacgctggaccctctaactcatttcatatagttcaacaatgtagccaatcactaatcaatgttatttctgtaaaccaatgagaattcctggcaaacaactttctgtcagcccactctttgtcctgtgttttgcctttaaaaaccagcttgtaacacaggccaaatggagctcatacccaaggttacctaggtctgagtcttcagggcagatgtcctcatctg

SEQ ID NO: 62807 - DNA, 663 bp, Homo sapiens
catagccaagctttgactgttggtcacctgacttcaagtttagagctctgttaccccctgtccattgcctgctctagtgcaaggttctctacagggggtgattttgcctcccaggtgacatttgacaaaggctggagacagttgtgattgtcacaacttggggttgcagggcgaagtgctactggcaacacgtgaccagggatgtgctaaacattctacaatgcacaggatgactccctaccctgccccaacaaataatgatttagctccaaatgtcaatagtgcagtggttggtgatgaataaatgtcctgcacagaactgagtcttccccttctcagcccatggcagacattactaatcaatcacagtacttttctcccctgatcacagtctgaatcctcaacacagtgctccattcaggagctactagttgataaaatacctatcgatcatcctttggctggatagcatagagacagtacgttctgaagtcattctgcttgggtttgagttctggctttgttaccacctattagctgtatgatctggggtcctaattcacttctctgtgcctcatttttcccatctgtgaaatggggatcacaaatggggataaaccgagggtgatttgggggattaaacaattgtatgcattttttaaa

SEQ ID NO: 62808 - DNA, 285 bp, Homo sapiens
cttgatatatcccaccattgaaacttggttcgcaaaaagtcctctttaaatgtgccttccagaactgaatatggcacattagatctgacactcctgaagcagatggtaaagtggagttactgccattcttgataagatgccaacactggactgcaactccactttgggctcacagtcaagcagaactcaagtccaaccaatgaaccagtgcctactagcactcaccaaggctccacagcatacattcacaaatcctcccccaccatcaaatttggtaccaggccg

SEQ ID NO: 62809 - DNA, 216 bp, Homo sapiens
tcgcccttagggcgtggtgcggagggcggtacaaaggatattctgtttctatctgcaatgcatttgataatcatttctatgaaatgtattttatttaatcagataagctaataagcgaattggttacatcgtttgtatctgttggcctagtggacagctgtgcctggtgcacctctggcttttaataaatactcattggttgaaacaccctgctaa

SEQ ID NO: 62810 - DNA, 1857 bp, Homo sapiens
  misc_feature (182)..(182): n is a, c, g, or t
agcggggatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtcngatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcctgaggcgttttgtttgagtgcaccctgctggtcagaggtgcaagcagatgagaatccagacattgcatgtggaggtctccagctcaggaaagtggggagggaaataattttggttcttgtgcaataaaagttgaccttgactctctgaggaagattttgctgcttttgcctgaagaaaacagacccatctctggaggtctcaggaagggcccagcgaacacactctcttggataattaccacgatggcgtcagcaaacactccaccctgtgcctttttagtccttcccgccctcctgcctctcccttacacccctcttaacgactttcaaactaaaggatacatcatatactgacaaactcaatgtggtcctttcaagaattagccatgagtctcaaaaaggcaataaatggctctaagtggacaggtttgcttcaaacaagtaacatctacattttgtcttttttttttcagttctcctgttatgttctggttgaaatcacctgtgtgtcttaatttctcaattcctttttggcaagaatatcaagcaaggtgaatttaacattatgtttatgttttgttttgttgctgtaactaatagttaattggactgattcttacccagccctggtcaagaatctgtgaggcatgtgactgaagtactaaattaaacttattttgaaaccaaacctaatttttaagccaaaaggtgtaatagtgatttaatacaggatgaaaaacactgaatttttaagactgtaggtggactatgttagtagttttcaagcaggatgtctgtattcagcattcaataatgctaaaatccctttcagcatgaaatttgtatgtttttatcctttgctgactaaaataaaataactggtggtttgctaactatttaccatatgggttggctggtttttattaataattgtttagggtatcataagatctgtaagtacaaaggatattctgtttctatctgcaatgcatttgataatcatttctatgaaatgtattttatttaatcagataagctaataagcgaattggttacatcgtttgtatctgttggcctagtggacagctgtgcctggtgcacctctggcttttaataaatactcattggttgaaacaccctgctaacactgtgttttgtcagttcgtaaattcctttaaccaagacttaactatgctttttaactctttttccacctgccatctactactaccaactcacttatacttccttcctcccaagtaatcatttcaaaactaaaaaaggatttaagttcttgggttacaacggtttaaaggaaagaaaatgaactttgaagtc

SEQ ID NO: 62811 - DNA, 1697 bp, Homo sapiens
  misc_feature (182)..(182): n is a, c, g, or t
agcggggatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtcngatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcctgaggcgttttgtttgagtgcaccctgctggtcagaggtgcaagcagatgagaatccagacattgcatgtggaggtctccagctcaggaaagtggggagggaaataattttggttcttgtgcaataaaagttgaccttgactctctgaggaagattttgctgcttttgcctgaagaaaacagacccatctctggaggtctcaggaagggcccagcgaacacactctcttggataattaccacgatggcgtcagcaaacactccaccctgtgcctttttagtccttcccgccctcctgcctctcccttacacccctcttaacgactttcaaactaaaggatacatcatatactgacaaactcaatgtggtcctttcaagaattagccatgagtctcaaaaaggcaataaatggctctaagtggacaggtttgcttcaaacaagtaacatctacattttgtcttttttttttcagttctcctgttatgttctggttgaaatcacctgtgtgtcttaatttctcaattcctttttggcaagaatatcaagcaaggtgaatttaacattatgtttatgttttgttttgttgctgtaactaatagttaattggactgattcttacccagccctggtcaagaatctgtgaggcatgtgactgaagtactaaattaaacttattttgaaaccaaacctaatttttaagccaaaaggtgtaatagtgatttaatacaggatgaaaaacactgaatttttaagactgtaggtggactatgttagtagttttcaagcaggatgtctgtattcagcattcaataatgctaaaatccctttcagcatgaaatttgtatgtttttatcctttgctgactaaaataaaataactggtggtttgctaactatttaccatatgggttggctggtttttattaataattgtttagggtatcataagatctgtaagtacaaaggatattctgtttctatctgcaatgcatttgataatcatttctatgaaatgtattttatttaatcagataagctaataagcgaattggttacatcgtttgtatctgttggcctagtggacagctgtgcctggtgcacctctggcttttaataaatactcattggttgaaacaccctgctaaaaaacaaaaaaaacagaagacgataaaaaatcg

SEQ ID NO: 62812 - DNA, 1296 bp, Homo sapiens
aatcagctcggacctgaaacgctcagccaacatagtgaaattagaaaagatacaaaataacttacagaagttgcttgagaatggtgactgatcgaccagattgcttgggccatcggaatacctcatgtttccctttgaagaaggtgcttcctgaggcgttttgtttgagtgcaccctgctggtcagaggtgcaagcagatgagaatccagacattgcatgtggaggtctccagctcaggaaagtggggagggaaataattttggttcttgtgcaataaaagttgaccttgactctctgaggaagattttgctgcttttgcctgaagaaaacagacccatctctggaggtctcaggaagggcccagcgaacacactctcttggataattaccacgatggcgtcagcaaacactccaccctgtgcctttttagtccttcccgccctcctgcctctcccttacacccctcttaacgactttcaaactaaaggatacatcatatactgacaaactcaatgtggtcctttcaagaattagccatgagtctcaaaaaggcaataaatggctctaagtggacaggtttgcttcaaacaagtaacatctacattttgtcttttttttttcagttctcctgttatgttctggttgaaatcacctgtgtgtcttaatttctcaattcctttttggcaagaatatcaagcaaggtgaatttaacattatgtttatgttttgttttgttgctgtaactaatagttaattggactgattcttacccagccctggtcaagaatctgtgaggcatgtgactgaagtactaaattaaacttattttgaaaccaaacctaatttttaagccaaaaggtgtaatagtgatttaatacaggatgaaaaacactgaatttttaagactgtaggtggactatgttagtagttttcaagcaggatgtctgtattcagcattcaataatgctaaaatccctttcagcatgaaatttgtatgtttttatcctttgctgactaaaataaaataactggtggtttgctaactatttaccatatgggttggctggtttttattaataattgtttagggtatcataagatctgtaagtacaaaggatattctgtttctatctgcaatgcatttgataatcatttctatgaaatgtattttatttaatcagataagctaataagcgaattggttacatcgtttgtatctgttggcctagtggacagctgtgcctggtgcacctctggcttttaataaatactcattggttgaaacaccctgctaa

SEQ ID NO: 62813 - DNA, 1610 bp, Homo sapiens
  misc_feature (182)..(182): n is a, c, g, or t
agcggggatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtcngatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcctgaggcgttttgtttgagtgcaccctgctggtcagaggtgcaagcagatgagaatccagacattgcatgtggaggtctccagctcaggaaagtggggagggaaataattttggttcttgtgcaataaaagttgaccttgactctctgaggaagattttgctgcttttgcctgaagaaaacagacccatctctggaggtctcaggaagggcccagcgaacacactctcttggataattaccacgatggcgtcagcaaacactccaccctgtgcctttttagtccttcccgccctcctgcctctcccttacacccctcttaacgactttcaaactaaaggatacatcatatactgacaaactcaatgtggtcctttcaagaattagccatgagtatctacattttgtcttttttttttcagttctcctgttatgttctggttgaaatcacctgtgtgtcttaatttctcaattcctttttggcaagaatatcaagcaaggtgaatttaacattatgtttatgttttgttttgttgctgtaactaatagttaattggactgattcttacccagccctggtcaagaatctgtgaggcatgtgactgaagtactaaattaaacttattttgaaaccaaacctaatttttaagccaaaaggtgtaatagtgatttaatacaggatgaaaaacactgaatttttaagactgtaggtggactatgttagtagttttcaagcaggatgtctgtattcagcattcaataatgctaaaatccctttcagcatgaaatttgtatgtttttatcctttgctgactaaaataaaataactggtggtttgctaactatttaccatatgggttggctggtttttattaataattgtttagggtatcataagatctgtaagtacaaaggatattctgtttctatctgcaatgcatttgataatcatttctatgaaatgtattttatttaatcagataagctaataagcgaattggttacatcgtttgtatctgttggcctagtggacagctgtgcctggtgcacctctggcttttaataaatactcattggttgaaacaccctgctaa

SEQ ID NO: 62814 - DNA, 1341 bp, Homo sapiens
  misc_feature (182)..(182): n is a, c, g, or t
agcggggatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtcngatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcctgaggcgttttgtttgagtgcaccctgctggtcagaggtgcaagcagatgagaatccagacattgcatgtggaggtctccagctcaggaaagtggggagggaaataattttggttcttgtgcaataaaagttgaccttgactctctgaggaagattttgctgcttttgcctgaagaaaacagacccatctctggaggtctcaggaagggcccagcgaacacactctcttggataattaccacgatggcgtcagcaaacactccaccctgtgcctttttagtccttcccgccctcctgcctctcccttacacccctcttaacgactttcaaactaaaggatacatcatatactgacaaactcaatgtggtcctttcaagaattagccatgagtctcaaaaaggcaataaatggctctaagtggacaggtttgcttcaaacaagtaacatctacattttgtcttttttttttcagttctcctgttatgttctggttgaaatcacctgtgtgtcttaatttctcaattcctttttggcaagaatatcaagcaaggtgaatttaacattatgtttatgttttgttttgttgctgtaactaatagttaattggactgattcttacccagccctggtcaagaatcagtccaattaactattagttacagcaacaaaacaaaacataaacataaagcagccttcttcccccaggcaactaaacagaaagaggtttggttttgtttactgcgatatatacaggaaatcgagtatacagtccatgcagtagcacagccatttggagagacatcctgttgctgggaaacgta

SEQ ID NO: 62815 - DNA, 1062 bp, Homo sapiens
  misc_feature (182)..(182): n is a, c, g, or t
agcggggatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtcngatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcctgaggcgttttgtttgagtgcaccctgctggtcagaggtgcaagcagatgagaatccagacattgcatgtggaggtctccagctcaggaaagtggggagggaaataattttggttcttgtgcaataaaagttgaccttgactctctgaggaagattttgctgcttttgcctgaagaaaacagacccatctctggaggtctcaggaagggcccagcgaacacactctcttggataattaccacgatggcgtcagcaaacactccaccctgtgcctttttagtccttcccgccctcctgcctctcccttacacccctcttaacgactttcaaactaaaggatacatcatatactgacaaactcaatgtggtcctttcaagaattagccatgagtctcaaaaaggcaataaatggctctaagtggacaggtttgcttcaaacaagtaacatctacattttgtcttttttttttcagttctcctgttatgttctggttgaaatcacctgtgtgtcttaatttctctcggaccaatggtaccgagctt

SEQ ID NO: 62816 - DNA, 568 bp, Homo sapiens
ggtacccggtgtttatcgatgccacacttggactgattcttacccagccctggtcaagaatctgtgaggcatgtgactgaagtactaaattaaacttattttgaaaccaaacctaatttttaagccaaaaggtgtaatagtgatttaatacaggatgaaaaacactgaatttttaagactgtaggtggactatgttagtagttttcaagcaggatgtctgtattcagcattcaataatgctaaaatccctttcagcatgaaatttgtatgtttttatcctttgctgactaaaataaaataactggtggtttgctaactatttaccatatgggttggctggtttttattaataattgtttagggtatcataagatctgtaagtacaaaggatattctgtttctatctgcaatgcatttgataatcatttctatgaaatgtattttatttaatcagataagctaataagcgaattggttacatcgtttgtatctgttggcctagtggacagctgtgcctggtgcacctctggcttttaataaatactcattggttgaaacaccctgctaa

SEQ ID NO: 62817 - DNA, 462 bp, Homo sapiens
ccacgcgtccggtattaaatcactattacacctttgatttaatacaggatgaaaaacactgaatttttaagactgtaggtggactatgttagtagttttcaagcaggatgtctgtattcagcattcaataatgctaaaatccctttcagcatgaaatttgtatgtttttatcctttgctgactaaaataaaataactggtggtttgctaactatttaccatatgggttggctggtttttattaataattgtttagggtatcataagatctgtaagtacaaaggatattctgtttctatctgcaatgcatttgataatcatttctatgaaatgtattttatttaatcagataagctaataagcgaattggttacatcgtttgtatctgttggcctagtggacagctgtgcctggtgcacctctggcttttaataaatactcattggttgaaacaccctgctaa

SEQ ID NO: 62818 - DNA, 1664 bp, Homo sapiens
  misc_feature (182)..(182): n is a, c, g, or t
agcggggatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtcngatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcctgaggcgttttgtttgagtgcaccctgctggtcagaggtgcaagcagatgagaatccagacattgcatgtggaggtctccagctcaggaaagtggggagggaaataattttggttcttgtgcaataaaagttgaccttgactctctgaggaagattttgctgcttttgcctgaagaaaacagacccatctctggaggtctcaggaagggcccagcgaacacactctcttggataattaccacgatggcgtcagcaaacactccaccctgtgcctttttagtccttcccgccctcctgcctctcccttacacccctcttaacgactttcaaactaaaggatacatcatatactgacaaactcaatgtggtcctttcaagaattagccatgagtctcaaaaaggcaataaatggctctaagtggacaggtttgcttcaaacaagtaacatctacattttgtcttttttttttcagttctcctgttatgttctggttgaaatcacctgtgtgtcttaatttctcaattcctttttggcaagaatatcaagcaaggtgaatttaacattatgtttatgttttgttttgttgctgtaactaatagttaattggactgattcttacccagccctggtcaagaatctgtgaggcatgtgactgaagtactaaattaaacttattttgaaaccaaacctaatttttaagccaaaaggtgtaatagtgatttaatacaggatgaaaaacactgaatttttaagactgtaggtggactatgttagtagttttcaagcaggatgtctgtattcagcattcaataatgctaaaatccctttcagcatgaaatttgtatgtttttatcctttgctgactaaaataaaataactggtggtttgctaactatttaccatatgggttggctggtttttattaataattgtttagggtatcataagatctgtaagtacaaaggatattctgtttctatctgcaatgcatttgataatcatttctatgaaatgtattttatttaatcagataagctaataagcgaattggttacatcgtttgtatctgttggcctagtggacagctgtgcctggtgcacctctggcttttaataaatactcattggttgaaacaccctgctaa

SEQ ID NO: 62819 - DNA, 2308 bp, Homo sapiens
  misc_feature (182)..(182): n is a, c, g, or t
agcggggatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtcngatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcctgaggcgttttgtttgagtgcaccctgctggtcagaggtgcaagcagatgagaatccagacattgcatgtggaggtctccagctcaggaaagtggggagggaaataattttggttcttgtgcaataaaagttgaccttgactctctgaggaagattttgctgcttttgcctgaagaaaacagacccatctctggaggtctcaggaagggcccagcgaacacactctcttggataattaccacgatggcgtcagcaaacactccaccctgtgcctttttagtccttcccgccctcctgcctctcccttacacccctcttaacgactttcaaactaaaggatacatcatatactgacaaactcaatgtggtcctttcaagaattagccatgagtctcaaaaaggcaataaatggctctaagtggacaggtttgcttcaaacaagtaacatctacattttgtcttttttttttcagttctcctgttatgttctggttgaaatcacctgtgtgtcttaatttctcaattcctttttggcaagaatatcaagcaaggtgaatttaacattatgtttatgttttgttttgttgctgtaactaatagttaattggactgattcttacccagccctggtcaagaatctgtgaggcatgtgactgaagtactaaattaaacttattttgaaaccaaacctaatttttaagccaaaaggtgtaatagtgatttaatacaggatgaaaaacactgaatttttaagactgtaggtggactatgttagtagttttcaagcaggatgtctgtattcagcattcaataatgctaaaatccctttcagcatgaaatttgtatgtttttatcctttgctgactaaaataaaataactggtggtttgctaactatttaccatatgggttggctggtttttattaataattgtttagggtatcataagatctgtaagtacaaaggatattctgtttctatctgcaatgcatttgataatcatttctatgaaatgtattttatttaatcagataagctaataagcgaattggttacatcgtttgtatctgttggcctagtggacagctgtgcctggtgcacctctggcttttaataaatactcattggttgaaacaccctgctaacactgtgttttgtcagttcgtaaattcctttaaccaagacttaactatgctttttaactctttttccacctgccatctactactaccaactcacttatacttccttcctcccaagtaatcatttcaaaactaaaaaaggatttaagttcttgggttacaacggtttaaaggaaagaaaatgaactttgaagtcaaaaaaaaaagaaaaaaaaaaaagacaatgcttcattcctcagtccacatttatgagttatgtgacctttagcaaaatatttggccatatccccccattttattgatgaggttgaaagtaccagtaaaaagtatcagtgtgaggattaaatgtgataatgtcagccaggtgcagtggctcatgcctataatcccagcattctcggaggccaaggcaggaggactgcttgagctcaggaggttgtgatcagcctggacaacgcagcaagatcccatttctactaaaaataaaaataaattagccaggtgtggtgatgcatgcctatagtcccagctactcaggagaattgctgaagtctgggagactgaggctgcagtgagccacgatcacaccattgcaccctagcctgagtgacaaagcaagaccttgtctcagtcaatcaatcagtcaa

SEQ ID NO: 62820 - DNA, 2254 bp, Homo sapiens
  misc_feature (182)..(182): n is a, c, g, or t
agcggggatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtcngatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcctgaggcgttttgtttgagtgcaccctgctggtcagaggtgcaagcagatgagaatccagacattgcatgtggaggtctccagctcaggaaagtggggagggaaataattttggttcttgtgcaataaaagttgaccttgactctctgaggaagattttgctgcttttgcctgaagaaaacagacccatctctggaggtctcaggaagggcccagcgaacacactctcttggataattaccacgatggcgtcagcaaacactccaccctgtgcctttttagtccttcccgccctcctgcctctcccttacacccctcttaacgactttcaaactaaaggatacatcatatactgacaaactcaatgtggtcctttcaagaattagccatgagtctcaaaaaggcaataaatggctctaagtggacaggtttgcttcaaacaagtaacatctacattttgtcttttttttttcagttctcctgttatgttctggttgaaatcacctgtgtgtcttaatttctcaattcctttttggcaagaatatcaagcaaggtgaatttaacattatgtttatgttttgttttgttgctgtaactaatagttaattggactgattcttacccagccctggtcaagaatctgtgaggcatgtgactgaagtactaaattaaacttattttgaaaccaaacctaatttttaagccaaaaggtgtaatagtgatttaatacaggatgaaaaacactgaatttttaagactgtaggtggactatgttagtagttttcaagcaggatgtctgtattcagcattcaataatgctaaaatccctttcagcatgaaatttgtatgtttttatcctttgctgactaaaataataattgtttagggtatcataagatctgtaagtacaaaggatattctgtttctatctgcaatgcatttgataatcatttctatgaaatgtattttatttaatcagataagctaataagcgaattggttacatcgtttgtatctgttggcctagtggacagctgtgcctggtgcacctctggcttttaataaatactcattggttgaaacaccctgctaacactgtgttttgtcagttcgtaaattcctttaaccaagacttaactatgctttttaactctttttccacctgccatctactactaccaactcacttatacttccttcctcccaagtaatcatttcaaaactaaaaaaggatttaagttcttgggttacaacggtttaaaggaaagaaaatgaactttgaagtcaaaaaaaaaagaaaaaaaaaaaagacaatgcttcattcctcagtccacatttatgagttatgtgacctttagcaaaatatttggccatatccccccattttattgatgaggttgaaagtaccagtaaaaagtatcagtgtgaggattaaatgtgataatgtcagccaggtgcagtggctcatgcctataatcccagcattctcggaggccaaggcaggaggactgcttgagctcaggaggttgtgatcagcctggacaacgcagcaagatcccatttctactaaaaataaaaataaattagccaggtgtggtgatgcatgcctatagtcccagctactcaggagaattgctgaagtctgggagactgaggctgcagtgagccacgatcacaccattgcaccctagcctgagtgacaaagcaagaccttgtctcagtcaatcaatcagtcaa

SEQ ID NO: 62821 - DNA, 1149 bp, Homo sapiens
  misc_feature (182)..(182): n is a, c, g, or t
agcggggatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtcngatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcctgaggcgttttgtttgagtgcaccctgctggtcagaggtgcaagcagatgagaatccagacattgcatgtggaggtctccagctcaggaaagtggggagggaaataattttggttcttgtgcaataaaagttgaccttgactctctgaggaagattttgctgcttttgcctgaagaaaacagacccatctctggaggtctcaggaagggcccagcgaacacactctcttggataattaccacgatggcgtcagcaaacactccaccctgtgcctttttagtccttcccgccctcctgcctctcccttacacccctcttaacgactttcaaactaaaggatacatcatatactgacaaactcaatgtggtcctttcaagaattagccatgagtctcaaaaaggcaataaatggctctaagtggacaggtttgcttcaaacaagtaacatctacattttgtcttttttttttcagttctcctgttatgttctggttgaaatcacctgtgtgtcttaatttctcaattcctttttggcaagaatatcaagcaaggtgaatttaacattatgtttatgttttgttttgttgctgtaactaatagttaatctctcggaccaatggtacgagctca

SEQ ID NO: 62822 - DNA, 815 bp, Homo sapiens
  misc_feature (182)..(182): n is a, c, g, or t
agcggggatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtcngatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaagttctcctgttatgttctggttgaaatcacctgtgtgtcttaatttctcaattcctttttggcaagaatatcaagcaagatagggtctcactctatcatcgcccaggctggagtacagtggcgcaatctcggctcactggaacctctacctcccaacctatcctctcgcctcagcctcccaagtagctgggactacaggtgcacaccaccacacccagctaattttttgtatttttagtagagacaggtttttccatgttgcccaggctggtgttgaactcctgggctcaaacaatccacctaca

SEQ ID NO: 62823 - DNA, 371 bp, Homo sapiens
ctctaatatttgatgtcctcttccttcagatgccaaagaataaaattttaaatctaaaacttcaaagggtggtgaaggtttttaaattctgaatagaaagtacatattactttttaagcacaagaaaatggaacatgatgagccctctgtttaaaaattatggtattcactgggtgtttttcaaagctgtgtgtgtggtctggtgttgacaggagagaacatacaatttcaaattagctagtgcttgtcagctgttgctgatagctgttggaaggttttgggaaagacaggggcacggtgatattttggcaagcttgcctattaaggacatttgctggaaatgacttcatgattcctatccctttcttctt

SEQ ID NO: 62824 - DNA, 677 bp, Homo sapiens
ataccattacacatccactataataaaaaaaaaatggacaatcacaagtgttgaagatgatgtggagaaattggaacactcatatgttgctgatgggaatgtaaaatagtgcagtcactctggaagacagtttggcagttcctcaaaaagagttaccatattacccagcaataccaatcctaaatatatgctcaagaaaaatgaaaatatatccacacaaaaatttgtacacaaatgatcttagcaacattattcacaataacaccaaagtggaagcaacctaaatatccatcattgatgaatgaataaacaaaatgtatatccatgtaatggaatgttatttgggagcaaaaagatttgaatgaagtattatactactgatgccacagcatgtatgaaccttgaaaacaggaagaaagcaaaaaaaaaaaaaatcacatattgtatgactccatttacatgaatggcccagaattgacaaatctgtagagatagaaaactagactggtagttgttagggattggcggcggaaaggttggggtgggaaatggggtggggaatagaaggaaaggcgaggtgaagactaaaagggagggggtttccttttgaggagaaaaaatgttctaaaattgattgtgatggtggcacaactctgaatataacaactaaaaaacaa

SEQ ID NO: 62825 - DNA, 387 bp, Homo sapiens
agacaagcccgccatgttagccaggctggtctcaaactcctggcctcaagtgatccgtgtgaggcaggtgtgaggcaccgtgcccggccgtgaggaggagttctaatttgcacaaatacatcctatgggctagtttgaactcatgctgttctctaccagctacagactcttcagcccttaaacccagtgctcctgccccttagagcaccccaccctgacttgatccccaccccactgcagggagggagcagagcagctcatctggggaccccagtgggacagtgaggggcagcaaaggaaagagcctgctgggggtcagtgaggcaggcagggttcacatcctggcctgtgactgagcctttctaggggagcctcagtgctttcctc

SEQ ID NO: 62826 - DNA, 295 bp, Homo sapiens
ccccttcaagcagaaaaatctatctgctgaacaataaagaccacataagagaaaatggagtgtgggccctccctactggtttatgcctcagatagaggtccctggtggtaggggcctagatagagagacagtgtaatagaattgcattaacacagtgtccaagagtgcagaatccacaaatggttgatgggcaggcctctcctggtctttgtctccaccctgtctggctcacaactctacatttctatggttgcttcgctccaattaaacttcaagctcagcttccatcctatgc

SEQ ID NO: 62827 - DNA, 630 bp, Homo sapiens
aggctggtctcgaactcctgaccgcaagtgatctgcccgcctcagcctcccaaagtgctgggattccaggcgtgagccatcgcgcctgacaaaattttttaagttattctggatgccagtttgagcctgatgcttaacaggatggaatatttggaggtcttgagaagagggtgattgtatattccatgtaagaggaatgtaaatagtttgtgtctagaaggaagattgtaacagattaagatgtacgaattccttctcacctattgagagaaacggggtctatttcttttccttttgaatctatatgggttttgtgatttcaccaatgaatagaatacctctgccagtttttgggcctaggacttaagaaactggcagcttctacttcctgttttttaacgcatccactcttggaacccaaatgacaatctgcgaagaagactaaggggccccacggagaggcccacatggagaaaactcaatcccccctcacccgctatcccaggctgtcagccagcaccaccttgtcttgccagccatgtgagtgagccatgttggaagtgaatcctccaggcccggtgagccatttaaactgactgaagacagcagctctgtccatgtgcacagaga

SEQ ID NO: 62828 - DNA, 2083 bp, Homo sapiens
gcgccgtcccgcgccagggctcgctccgagagccgcttccttctcgccgcggccggcgcgggccccccggccatgcgcccccgagccccagcctgcgccgccgcggcgctcgggctctgcagccttctgctgctgctcgcgcccgggcacgcgtgccccgcgggctgcgcctgcaccgacccgcacaccgtggactgccgcgaccgcgggctgcccagcgtgccagaccctttccccctggacgtgcgcaagctgctggtggccggcaaccgcatccagcggatccccgaggacttcttcatcttctacggcgacctggtctacctggacttcaggaacaactcgctgcgctcgctggaggagggcacgttcagcggctcggccaagctcgtgttcctcgacctcagctacaacaacttgacccagctgggcgccggcgccttccgctcggccgggaggctggtgaagcttagcctggctaacaacaacctggtgggcgtgcacgaggacgccttcgagaccctggagtcgctgcaggtgctggagctcaacgacaacaacctgcgcagcctcagcgtggccgccctggccgcgctgcccgcgctgcgctccctgcgtctggacgggaacccctggctgtgcgactgtgacttcgcccacctcttctcctggatccaggagaacgcatccaaactgcccaaaggccttgatgaaatccagtgctccctgcccatggagagcaggaggatatccctgcgtgagctgtcggaggccagcttcagcgagtgtaggttcagcctgtcactcacagacctctgcatcatcattttctccggtgtggccgtgtccattgcggccatcatctccagcttcttcctggccactgtggtgcagtgcctccagaggtgcgcacccaacaaagatgcggaggatgaagacgaggacaaggatgactgagccacctcctccctcctgcctcttactctccagcaccgaaccagaagctctctccaagacgagagggaaatgctgaaaatggaaaagcactggccaccatctgtgaactgaacagagcctgttccgtgtcttggcccctgggtacacctgctgggaccactgatctcagagtttagaatcagcagagcacagaagcccaggaaggatggagggaattattcctggagcataacctgcctctcagatcgaggtgtgtgttgggggagaagatgaccgagtcaggcttcatagctgatgactaaaagcctcccccaggaaatgtgaagactggcagctttcaatggcaaagatgattttacgccattctttttctgacctgtactgggagatcatgaaacatctgccttcctcccaagaaacagcagctcaaacagtggagattcaaattcggatcattcaccacaagaacgagaactttgatccttatataataggcctcagcaaccttgggatgttatactgggaactaataaactcgtgtgcaatagactcaatgtttatgttcccccagattttatatgttgaaacctaatccccaatgtgatggtatttggaggtggggcttttgggaggtgattaggtttagatcatatcatgaggatggggcccaaatgatgggattagtgccctcatgaaaggtggccccagagagctccttcaccccttcaatgcttgaggatgcagcaagaaatcagctgcccatgaaccgagaagcaggccctcaccagaacccagccatgctggcacccagatctcagacttccagcctccagaactgggagaaataaataaatgtctgttgtttgtaagccactcaatctctggtattctgttatagtggtcgaaatggacccatgaagaagctaacaactggtcagagggtgtctgttgttaattttggtaagctggttgggaaaactttgacttgacataactcaaaccctgatctttatcctaagcggtagcgacttgtagaggaaggattagttgctttgtacagttgtgatggtctctctgctcagcatcatttttccttctgaaggacagacaggttgttcccctccat

SEQ ID NO: 62829 - DNA, 563 bp, Homo sapiens
ttgtgttgggcttatttcatgtagcatataatgctttcagtttcaccaatattgtggcaaatgtcagaactctttcccgtctcattgttgaataatattccatcctatgtgatgccacatcttctttatccattcatttgcttgtggacacttgggtggtttccatcttttagctattgtaagtaatgctgcaatgaacattggcatgtaagtatctgctttagtacctgctttcagttcatcgtatatatacctagaagtggagttgctgataattctatattataatatcatagaataattctatgtttgatagctatgacaagtctatgtttaactttttaaggaaacaccaaactgttttccacaatggctgtctcattttagtgtctccagcagcaatgcccaacggttctaatttctccacatcctcattgacacttgccattttctgtttttttcatagtagtcatcctaatggttgtgaagtgctatctcattgtgggtttgaattgcattttcctaagtatggaggatgttgagtacctttgcatgtgctcatt

SEQ ID NO: 62830 - DNA, 1205 bp, Homo sapiens
gagaccatatggactgcaaagcctaaaatgtgtatctggacccttacagtaaaacaatgaccctgggttttcatggcaccccaatgcctttttggtgacttgcaggaatacagattcctatattccagtttgtttttttttttttctccttagcttaaggttcgtattcccatttgcttctgagaaagttaggaaaattttgttttatgttgcagatgctctcacaacaataattgtgctggagatagatacaacttagtgaaattttcctacagaactaaaaacgcaaaattgcatcactcctgaagaaaagaaatttagagtatgaattgagttggttgagagtagaattaaaaagatttctagcactttgagcatgttttagaaatttgatccttacatttaaaattatgtaaatgacatctttcactggcatttgctcacatttaagtcaatctacagctgttacttactaagctaagaaataagaagatccctatggttctgaatctctcataatattctgaagtaatttatatcaattgaattttcattaatcattttaggaaatattatgttttattttgtggcattatatgacaatgactttctcaacaatagctcagggaatacgcaaacagccagctcttttatgtaagaaagccattttctaatccccacgctttcctgagtgttacgtattttatttctttgaaaagagagggccttgagtaaatgctttcgtttgctttccttacatatttagaaatccaagaagggcccttgtcttagtctatttctgtcacagagaaattgttcattccaaaatatccaccttaagggaagctagtgaccgagatatggagaaaaacataggcattcatgacctttgtgtttccgtttgactttcaacatctgtaaccaaaaggtcacaaatgaaatatttagtagaaagtgcaatatcaatttattaggagtacctaaaattataactctaaataatatacagcaatattattgctctattattacagcaatcaataatataatatagccactaggatacactcgctgtagaactcagaacaaaagatatcaatcttctgccagtccgcatcattatgtgtagcagagactttactggaatgagtgaggggaaagataacaaaatgtagattaggattccacattctcccctgcccatc

SEQ ID NO: 62831 - DNA, 135 bp, Homo sapiens
gtgccatcagcaagaggatctgttctctcagcccagcaagatcgtaaaagcccaggccaagagaccccgggaccccggaacaccagtgcccggcacagtaaggactcagccttcatggtaacgctgcagtctcag

SEQ ID NO: 62832 - DNA, 410 bp, Homo sapiens
tggcctgctcagagaacagagatgacttacaggggattcaattgtgtaatttcaaatacaagcttagtagaaccccattcctgatacagatgaaaaatgactcttctccaccacagcgtagggatattttcatccgccgtggtaatggcttacctcggcaggtcctacctcttcaggtcctttcagtgtcctcaggcctccctgagtggttgagagctgaatggggctgagagcttcaagttttcatagactgattcctctgctcaccttcacccgctgcatctcccaccagcaggttgctgttcagcctatatgtgtttccttgatgattagagggttagggtctcctccactgtagagaaaatgcaaatggtttctactaggtgtcttagaactgactgctgaagaaa

SEQ ID NO: 62833 - DNA, 243 bp, Homo sapiens
aagccaactctccccgctgcacagagggtcccctcaccctcgccaccctgacagggtgagccactgcacctggtcaaatgtatttgtttctataaagacctacagtcaacataaatcttatgactgagtgctatttctcccacaatgcctgacacatgacagggacgctggcgacagactcaaaaggccacatcctgtatgatgcatttatcttttttaaaacattaaactttttttaaactt

SEQ ID NO: 62834 - DNA, 418 bp, Homo sapiens
tctctacgcatgccggtggcaccctccctccccgacccaagtagcgacaatcataaccatccccaaacattgccaaatgtcccttgggggcaaaatctccttgggctgagaaccactgcacatggggctgacagatgaatggcatcttagcattgatttgtttttgcaaaccacctgtgtgatctcaggcaactcatgtaacctgaagtaagaacccacagaacctggatctcagtttctgcaccttcctaatgcacacggtgtgctctgcaaattaaattaagtgaattaaatgggaaggcattcaaaaaatgtaaattcctctctcatactgggagctgtagttctgtaggaggagcatagaaggtttaaaacatgctaaaccttgtccacgttccccttcctcagtctctgtgga

SEQ ID NO: 62835 - DNA, 394 bp, Homo sapiens
ttttttaagcactcttgtgtggactggtcaaagatgttcctaaaacaacattgctgtcaccaagcctcccatgaattaggctggctcctcccatgtggatatctgcttctgcatagttggtgaagaggaagcatcctcagtcaaagctaccagctgaggaacccttaggaaaccccgctggtacctggcctgtcttttgtaagtatacatcaggccagggggctgcttgccaagcaacatcattgactgcatactgtttagtgcatgcattaccaggcctcaaacatccaagtgatgctacctgaataagtcgagaatttttgataataaacataagccaaatcaaaaaaatgttctggatttttcatcatttccactcattagtccaagaaaa

SEQ ID NO: 62836 - DNA, 284 bp, Homo sapiens
agaactgaaaagtgcagtagccgaaataaaaaccactggctaggctcaacagcagaatggaggtaataaagtcaataaacttgaagatagttcaaaagaaattagctaatatgaatagcagcgaaaaaaagatggaaaatcaaaaagaacatagcctctgggaatgtagaacaagaaaagatttaacatttgtgtcatcagggtttcagaaggagaagagatagtataggactcaaaaaagatttgaagaaataatggctgaaaacttacaaattttgtgaaag

SEQ ID NO: 62837 - DNA, 545 bp, Homo sapiens
gacatgaaactgtggaaataagtgaactcctaaaactttcaccacgggatgctctgagaagacattttcccatctctatattcccaaatgttaccctgacccactccaatttaacgagaagtctctccatttcataaagacccatcctctcccttcttttctgtcacttcctttaacatcctcttccctcatggatgctgggaactctcttatttgaccatgtcccatttctttcttccataatcagctcctgatcccccacttccgctacaccatggcgatcaacacgctggcccagagtagtcttgtctccgaatggggaatttttgacctggtatggaaatggatgggtgaaggggaggatggttcaatattggaagaatcctaggggttgtttccctttcccattcctcccccaagctctccttcctccatggaaggcctctcccaaacctgcctcatgcctgaagagcttcctgcttaaaagggctagagtaggatcataggcctggagtttcctgatactcatctccctccctctgcaa

SEQ ID NO: 62838 - DNA, 1394 bp, Homo sapiens
gacatgaaactgtggaaataagtgaactcctaaaactttcaccacgggatgctctgagaagacattttcccatctctatattcccaaatgttaccctgacccactccaatttaacgagaagtctctccatttcataaagacccatcctctcccttcttttctgtcacttcctttaacatcctcttccctcatggatgctgggaactctcttatttgaccatgtcccatttctttcttccataatcagctcctgatcccccacttccgctacaccatggcgatcaacacgctggcccagagtagtcttgtctccgaatggggaatttttgacctggtggtgagcactggtagtggaagccacgtggacattcttcagagagccatggcttgtttgacctatcattccctctgtcctcctgatgacctggctgaccgtgggctcctggatgtgaaatcttctttttatggctaagatgccatcaggctgtggggaatcatcagccgggaataggtacgtggaggggatggttgggcttttctacaatagtgaccaagccatgaaggatgatctagagctgcaggcctggtgcagagagatgactgagactggactgcagagggcccaagaccaggggttcctcatctccttagagtcccgggctcagctctgccactttgtcaccatgtgcatcttcacatgcacaggtcagcatgcttctaaccacctgggccagctggactggtactcctggatccctaatggcccatgcaccatgcagaagcccccgcccatctctaaggatgtgacagagaaggatatagtggacttactgcccaatctccaccaggcacgtatgcaaaagaccttcacaaagttccttggcagacgccagcctgtcatgcatgaggagaaatatttctctggtcctgagccccaagctgtgctgagacaattccaggaggaactggcttccatggacaaggagattgaggtccggaatgcagtcctggacctgccctgtgagtacctttgacccagcatggtagagaacagcgtgaccatctgagaggccttgcccgcctcagctccaaagctccaccatccctgagtgcctttgagtattccgtcctcctcacatcctctggtgaacaaattgtccccaaagctttgtggtcagggtatccagagctgctcaccacacaactatggggaatacacagtgatggtccccattgcatttggaagtggcatcccccaaagctgccctaccttaaatgtccatccagtcctgcacttcctcaccccgatccctgcacacctcctcattgccaaaggacctggcttagatacaagtaaaaatatatgattaaataacaaaacggaaaatatgtgt

SEQ ID NO: 62839 - DNA, 1340 bp, Homo sapiens
gacatgaaactgtggaaataagtgaactcctaaaactttcaccacgggatgctctgagaagacattttcccatctctatattcccaaatgttaccctgacccactccaatttaacgagaagtctctccatttcataaagacccatcctctcccttcttttctgtcacttcctttaacatcctcttccctcatggatgctgggaactctcttatttgaccatgtcccatttctttcttccataatcagctcctgatcccccacttccgctacaccatggcgatcaacacgctggcccagagtagtcttgtctccgaatggggaatttttgacctggtggtgagcactggtagtggaagccacgtggacattcttcagagagccatggcttgtttgacctatcattccctctgtcctcctgatgacctggctgaccgtgggctcctggatgtgaaatcttctttttatggctaagatgccatcaggctgtggggaatcatcagccgggaataggtacgtggaggggatggttgggcttttctacaatagtgaccaagccatgaaggatgatctagagctgcaggcctggtgcagagagatgactgagactggactgcagagggcccaagaccaggggttcctcatctccttagagtcccgggctcagctctgccactttgtcaccatgtgcatcttcacatgcacaggtcagcatgcttctaaccacctgggccagctggactggtactcctggatccctaatggcccatgcaccatgcagaagcccccgcccatctctaaggatgtgacagagaaggatatagtggacttactgcccaatctccaccagcatgaggagaaatatttctctggtcctgagccccaagctgtgctgagacaattccaggaggaactggcttccatggacaaggagattgaggtccggaatgcagtcctggacctgccctgtgagtacctttgacccagcatggtagagaacagcgtgaccatctgagaggccttgcccgcctcagctccaaagctccaccatccctgagtgcctttgagtattccgtcctcctcacatcctctggtgaacaaattgtccccaaagctttgtggtcagggtatccagagctgctcaccacacaactatggggaatacacagtgatggtccccattgcatttggaagtggcatcccccaaagctgccctaccttaaatgtccatccagtcctgcacttcctcaccccgatccctgcacacctcctcattgccaaaggacctggcttagatacaagtaaaaatatatgattaaataacaaaacggaaaatatgtgt

SEQ ID NO: 62840 - DNA, 1339 bp, Homo sapiens
  misc_feature (272)..(272): n is a, c, g, or t
  misc_feature (822)..(822): n is a, c, g, or t
atgggcaagtacacggtccgcgtagccaccggggatttgctcctggcgggctctcccaacctggtgcagctatggctggtgggcgagcacggggaggcagacctagggaagcagctgccaccggtgtggggaaaggaggcagagtttgagatcgacgtccccctgcacctggggcgcctcctgatggtgaagctgcgcaaacacaacgtgctgttgagtctcgactggttctgcaagtggatctcagtgcagggcccggggacccaaggcgnggcctttttcccctgctaccgctgggtgcagggccacggaattatctgcctgcctgagggtactggtggggctcctggaaagatgggttaatcctgcctatagcagggaataggcaaccggaccttcctagggacgagcgattcctcgaggataaggatttagactttaatgtctccctagcaaaagggttgaaggacttggccattaaggggacactggatttcataaattgtgtgaaaaggctggaagatttcaaaaaaatattcccacatggaaagactgtcctggctgagcgggtttatgattcttggaagaatgatgccttctttgggtaccagtttctcaatggtgcaaaccccatgctcctgaggtgttcttcaaggctcccagcctgcctggtgctgcctccagggatggaagacttgaagacccagctggagaaagaactccaggctggatctctgtttgaagtggatttctccttgctggatggagtcaagcctaatgtcatcatttttaagcagcaatgcgtggcagcccctttggtcntgctgaagcttcagcctgatggaggactcttacccatggtcatccagctccagccaccttgacacggatgtcccccacctctgctctttctgccctcgcatccccccatggcctggctcctggccaagacctgggtccggagctctgatttccagctgcagcagttacagtcacatctgctgaggggacacttgattgctgaggttattgctgtggctacaatgagaagcttgcctagcctccatcctatctacaagactgagagaagggagcagagtgagaaaagaaacaagagaaggaacctcattgaggtaggaggaaaatcaaaaagtgcaatccatggcagccaggaaaagaaagcgtttcaagagggacgcgtgattatctgtctcaagtgctgctgagagatcaagaaagttacagagaagtgacatttggatttctcaatatggaagtcattggttaataaatggacatgcgccatctcagggaagtggaggaagcctgattcatgggg

SEQ ID NO: 62841 - DNA, 424 bp, Homo sapiens
ttccctttcccattcctcccccaagctctccttcctccatggaaggcctctcccaaacctgcctcatgcctgaagagcttcctgcttaaaagggctagagtaggatcataggcctggagtttcctgatactcatctccctccctctgcaacttggcatggctgtgggttatcctcaggtggtgagcactggtagtggaagccacgtggacattcttcagagagccatggcttgtttgacctatcattccctctgtcctcctgatgacctggctgaccgtgggctcctggatgtgaaatcttctttttatggctaagatgccatcaggctgtggggaatcatcagccggtaggtgaaggtggcacagagaggcaatgaacggaggggcgggggactgtaggtccagaaggtcctgcattggcccc

SEQ ID NO: 62842 - DNA, 431 bp, Homo sapiens
ctggatgtgaaatcttctttttatggctaagatgccatcaggctgtggggaatcatcagccggtaggtgaaggtggcacagagaggcaatgaacggaggggcgggggactgtaggtccagaaggtcctgcattggcccctgagactgagtgtcttcttcccagggaataggtacgtggaggggatggttgggcttttctacaatagtgaccaagccatgaaggatgatctagagctgcaggcctggtgcagagagatgactgagactggactgcagagggcccaagaccaggggtgagacatggatccttccccactgaaccctgtcaacacccactcctctgcaaacaatctgcttcttctcacatcatcatgagacaccccacctgcccaaggaagctgagaattctccagagtgtgtccagaaatgct

SEQ ID NO: 62843 - DNA, 401 bp, Homo sapiens
ggagattgaggtccggaatgcagtcctggacctgccctgtgagtacctttgacccagcatggtagagaacagcgtgaccatctgagaggccttgcccgcctcagctccaaagctccaccatccctgagtgcctttgagtattccgtcctcctcacatcctctggtgaacaaattgtccccaaagctttgtggtcagggtatccagagctgctcaccacacaactatggggaatacacagtgatggtccccattgcatttggaagtggcatcccccaaagctgccctaccttaaatgtccatccagtcctgcacttcctcaccccgatccctgcacacctcctcattgccaaaggacctggcttagatacaagtaaaaatatatgattaaataacaaaacgg

SEQ ID NO: 62844 - DNA, 2226 bp, Homo sapiens
  misc_feature (272)..(272): n is a, c, g, or t
  misc_feature (822)..(822): n is a, c, g, or t
atgggcaagtacacggtccgcgtagccaccggggatttgctcctggcgggctctcccaacctggtgcagctatggctggtgggcgagcacggggaggcagacctagggaagcagctgccaccggtgtggggaaaggaggcagagtttgagatcgacgtccccctgcacctggggcgcctcctgatggtgaagctgcgcaaacacaacgtgctgttgagtctcgactggttctgcaagtggatctcagtgcagggcccggggacccaaggcgnggcctttttcccctgctaccgctgggtgcagggccacggaattatctgcctgcctgagggtactggtggggctcctggaaagatgggttaatcctgcctatagcagggaataggcaaccggaccttcctagggacgagcgattcctcgaggataaggatttagactttaatgtctccctagcaaaagggttgaaggacttggccattaaggggacactggatttcataaattgtgtgaaaaggctggaagatttcaaaaaaatattcccacatggaaagactgtcctggctgagcgggtttatgattcttggaagaatgatgccttctttgggtaccagtttctcaatggtgcaaaccccatgctcctgaggtgttcttcaaggctcccagcctgcctggtgctgcctccagggatggaagacttgaagacccagctggagaaagaactccaggctggatctctgtttgaagtggatttctccttgctggatggagtcaagcctaatgtcatcatttttaagcagcaatgcgtggcagcccctttggtcntgctgaagcttcagcctgatggaggactcttacccatggtcatccagctccagccaccttgacacggatgtcccccacctctgctctttctgccctcgcatccccccatggcctggctcctggccaagacctgggtccggagctctgatttccagctgcagcagttacagtcacatctgctgaggggacacttgattgctgaggttattgctgtggctacaatgagaagcttgcctagcctccatcctatctacaagctcctgatcccccacttccgctacaccatggcgatcaacacgctggcccagagtagtcttgtctccgaatggggaatttttgacctggtggtgagcactggtagtggaagccacgtggacattcttcagagagccatggcttgtttgacctatcattccctctgtcctcctgatgacctggctgaccgtgggctcctggatgtgaaatcttctttttatggctaagatgccatcaggctgtggggaatcatcagccgggaataggtacgtggaggggatggttgggcttttctacaatagtgaccaagccatgaaggatgatctagagctgcaggcctggtgcagagagatgactgagactggactgcagagggcccaagaccaggggttcctcatctccttagagtcccgggctcagctctgccactttgtcaccatgtgcatcttcacatgcacaggtcagcatgcttctaaccacctgggccagctggactggtactcctggatccctaatggcccatgcaccatgcagaagcccccgcccatctctaaggatgtgacagagaaggatatagtggacttactgcccaatctccaccaggcacgtatgcaaaagaccttcacaaagttccttggcagacgccagcctgtcatgcatgaggagaaatatttctctggtcctgagccccaagctgtgctgagacaattccaggaggaactggcttccatggacaaggagattgaggtccggaatgcagtcctggacctgccctgtgagtacctttgacccagcatggtagagaacagcgtgaccatctgagaggccttgcccgcctcagctccaaagctccaccatccctgagtgcctttgagtattccgtcctcctcacatcctctggtgaacaaattgtccccaaagctttgtggtcagggtatccagagctgctcaccacacaactatggggaatacacagtgatggtccccattgcatttggaagtggcatcccccaaagctgccctaccttaaatgtccatccagtcctgcacttcctcaccccgatccctgcacacctcctcattgccaaaggacctggcttagatacaagtaaaaatatatgattaaataacaaaacggaaaatatgtgt

SEQ ID NO: 62845 - DNA, 1485 bp, Homo sapiens
gacatgaaactgtggaaataagtgaactcctaaaactttcaccacgggatgctctgagaagacattttcccatctctatattcccaaatgttaccctgacccactccaatttaacgagaagtctctccatttcataaagacccatcctctcccttcttttctgtcacttcctttaacatcctcttccctcatggatgctgggaactctcttatttgaccatgtcccatttctttcttccataatcagctcctgatcccccacttccgctacaccatggcgatcaacacgctggcccagagtagtcttgtctccgaatggggaatttttgacctggtggtgagcactggtagtggaagccacgtggacattcttcagagagccatggcttgtttgacctatcattccctctgtcctcctgatgacctggctgaccgtgggctcctggatgtgaaatcttctttttatggctaagatgccatcaggctgtggggaatcatcagccgggaataggtacgtggaggggatggttgggcttttctacaatagtgaccaagccatgaaggatgatctagagctgcaggcctggtgcagagagatgactgagactggactgcagagggcccaagaccaggggttcctcatctccttagagtcccgggctcagctctgccactttgtcaccatgtgcatcttcacatgcacaggtcagcatgcttctaaccacctgggccagctggactggtactcctggatccctaatggcccatgcaccatgcagaagcccccgcccatctctaaggatgtgacagagaaggatatagtggacttactgcccaatctccaccaggcacgtatgcaaaagaccttcacaaagttccttggcagacgccagcctgtcatgcatgaggagaaatatttctctggtcctgagccccaagctgtgctgagacaattccaggaggaactggcttccatggacaaggagattgaggtccggaatgcagtcctggacctgccctttttccaccaatatatacatccctaaacaacatgacttagttttgaaacactgagcagcaagcaccaatctagaagaataaggaaagggtgatgttaccactgtttgaggaaggctcaggaggagaagataaactgaacagcctctcggtcattgtctggcttcagcttccctaagcatttataagagctttttatgggaaaatcattgagtaagatgatgagtaacactgggaatcactgggctcagcacaggtgagacatacggtaacgctggagaatgggccgagttttagatgtttggccaggatatagtcagaaggagatggctgttgtgtatattctgctcatcacgacttctcctccacttcccagaagaggtcaaggcagaacatttctggatgacacccacagtagatcaagcatcagagcactcgaggaatgagcaggaactttatcagcatgtg

SEQ ID NO: 62846 - DNA, 1442 bp, Homo sapiens
tcgggtcggacccacgcgcagcggccggagatgcagcggggcgccgcgctgtgcctgcgactgtggctctgcctgggactcctggacggcctggtgagtggctactccatgacccccccgaccttgaacatcacggaggagtcacacgtcatcgacaccggtgacagcctgtccatctcctgcaggggacagcaccccctcgagtgggcttggccaggagctcaggaggcgccagccaccggagacaaggacagcgaggacacgggggtggtgcgagactgcgagggcacagacgccaggccctactgcaaggtgttgctgctgcacgaggtacatgccaacgacacaggcagctacgtctgctactacaagtacatcaaggcacgcatcgagggcaccacggccgccagctcctacgtgttcgtgagagactttgagcagccattcatcaacaagcctgacacgctcttggtcaacaggaaggacgccatgtgggtgccctgtctggtgtccatccccggcctcaatgtcacgctgcgctcgcaaagctcggtgctgtggccagacgggcaggaggtggtgtgggatgaccggcggggcatgctcgtgtccacgccactgctgcacgatgccctgtacctgcagtgcgagaccacctggggagaccaggacttcctttccaaccccttcctggtgcacatcacaggcaacgagctctatgacatccagctgttgcccaggaagtcgctggagctgctggtaggggagaagctggtcctgaactgcaccgtgtgggctgagtttaactcaggtgtcacctttgactgggactacccagggaagcaggcagagcggggtaagtgggtgcccgagcgacgctcccagcagacccacacagaactctccagcatcctgaccatccacaacgtcagccagcacgacctgggctcgtatgtgtgcaaggccaacaacggcatccagcgatttcgggagagcaccgaggtcattgtgcatgaaaatcccttcatcagcgtcgagtggctcaaaggacccatcctggaggccacggcaggagacgagctggtgaagctgcccgtgaagctggcagcgtaccccccgcccgagttccagtggtacaaggatggaaaggcactgtccgggcgccacagtccacatgccctggtgctcaaggaggtgacagaggccagcacaggcacctacaccctcgccctgtggaactccgctgctggcctgaggcgcaacatcagcctggagctggtggtgaatgtgcccccccagatacatgagaaggaggcctcctcccccagcatctactcgcgtcacagccgccaggccctcacctgcacggcctacggggtgcccccatgtgatttagtattttcaactccacagaaccctccaaccatttaacacccacccct

SEQ ID NO: 62847 - DNA, 4459 bp, Homo sapiens
tcgggtcggacccacgcgcagcggccggagatgcagcggggcgccgcgctgtgcctgcgactgtggctctgcctgggactcctggacggcctggtgagtggctactccatgacccccccgaccttgaacatcacggaggagtcacacgtcatcgacaccggtgacagcctgtccatctcctgcaggggacagcaccccctcgagtgggcttggccaggagctcaggaggcgccagccaccggagacaaggacagcgaggacacgggggtggtgcgagactgcgagggcacagacgccaggccctactgcaaggtgttgctgctgcacgaggtacatgccaacgacacaggcagctacgtctgctactacaagtacatcaaggcacgcatcgagggcaccacggccgccagctcctacgtgttcgtgagagactttgagcagccattcatcaacaagcctgacacgctcttggtcaacaggaaggacgccatgtgggtgccctgtctggtgtccatccccggcctcaatgtcacgctgcgctcgcaaagctcggtgctgtggccagacgggcaggaggtggtgtgggatgaccggcggggcatgctcgtgtccacgccactgctgcacgatgccctgtacctgcagtgcgagaccacctggggagaccaggacttcctttccaaccccttcctggtgcacatcacaggcaacgagctctatgacatccagctgttgcccaggaagtcgctggagctgctggtaggggagaagctggtcctgaactgcaccgtgtgggctgagtttaactcaggtgtcacctttgactgggactacccagggaagcaggcagagcggggtaagtgggtgcccgagcgacgctcccagcagacccacacagaactctccagcatcctgaccatccacaacgtcagccagcacgacctgggctcgtatgtgtgcaaggccaacaacggcatccagcgatttcgggagagcaccgaggtcattgtgcatgaaaatcccttcatcagcgtcgagtggctcaaaggacccatcctggaggccacggcaggagacgagctggtgaagctgcccgtgaagctggcagcgtaccccccgcccgagttccagtggtacaaggatggaaaggcactgtccgggcgccacagtccacatgccctggtgctcaaggaggtgacagaggccagcacaggcacctacaccctcgccctgtggaactccgctgctggcctgaggcgcaacatcagcctggagctggtggtgaatgtgcccccccagatacatgagaaggaggcctcctcccccagcatctactcgcgtcacagccgccaggccctcacctgcacggcctacggggtgcccctgcctctcagcatccagtggcactggcggccctggacaccctgcaagatgtttgcccagcgtagtctccggcggcggcagcagcaagacctcatgccacagtgccgtgactggagggcggtgaccacgcaggatgccgtgaaccccatcgagagcctggacacctggaccgagtttgtggagggaaagaataagactgtgagcaagctggtgatccagaatgccaacgtgtctgccatgtacaagtgtgtggtctccaacaaggtgggccaggatgagcggctcatctacttctatgtgaccaccatccccgacggcttcaccatcgaatccaagccatccgaggagctactagagggccagccggtgctcctgagctgccaagccgacagctacaagtacgagcatctgcgctggtaccgcctcaacctgtccacgctgcacgatgcgcacgggaacccgcttctgctcgactgcaagaacgtgcatctgttcgccacccctctggccgccagcctggaggaggtggcacctggggcgcgccacgccacgctcagcctgagtatcccccgcgtcgcgcccgagcacgagggccactatgtgtgcgaagtgcaagaccggcgcagccatgacaagcactgccacaagaagtacctgtcggtgcaggccctggaagcccctcggctcacgcagaacttgaccgacctcctggtgaacgtgagcgactcgctggagatgcagtgcttggtggccggagcgcacgcgcccagcatcgtgtggtacaaagacgagaggctgctggaggaaaagtctggagtcgacttggcggactccaaccagaagctgagcatccagcgcgtgcgcgaggaggatgcgggacgctatctgtgcagcgtgtgcaacgccaagggctgcgtcaactcctccgccagcgtggccgtggaaggctccgaggataagggcagcatggagatcgtgatccttgtcggtaccggcgtcatcgctgtcttcttctgggtcctcctcctcctcatcttctgtaacatgaggaggccggcccacgcagacatcaagacgggctacctgtccatcatcatggaccccggggaggtgcctctggaggagcaatgcgaatacctgtcctacgatgccagccagtgggaattcccccgagagcggctgcacctggggagagtgctcggctacggcgccttcgggaaggtggtggaagcctccgctttcggcatccacaagggcagcagctgtgacaccgtggccgtgaaaatgctgaaagagggcgccacggccagcgagcagcgcgcgctgatgtcggagctcaagatcctcattcacatcggcaaccacctcaacgtggtcaacctcctcggggcgtgcaccaagccgcagggccccctcatggtgatcgtggagttctgcaagtacggcaacctctccaacttcctgcgcgccaagcgggacgccttcagcccctgcgcggagaagtctcccgagcagcgcggacgcttccgcgccatggtggagctcgccaggctggatcggaggcggccggggagcagcgacagggtcctcttcgcgcggttctcgaagaccgagggcggagcgaggcgggcttctccagaccaagaagctgaggacctgtggctgagcccgctgaccatggaagatcttgtctgctacagcttccaggtggccagagggatggagttcctggcttcccgaaagtgcatccacagagacctggctgctcggaacattctgctgtcggaaagcgacgtggtgaagatctgtgactttggccttgcccgggacatctacaaagaccccgactacgtccgcaagggcagtgcccggctgcccctgaagtggatggcccctgaaagcatcttcgacaaggtgtacaccacgcagagtgacgtgtggtcctttggggtgcttctctgggagatcttctctctgggggcctccccgtaccctggggtgcagatcaatgaggagttctgccagcggctgagagacggcacaaggatgagggccccggagctggccactcccgccatacgccgcatcatgctgaactgctggtccggagaccccaaggcgagacctgcattctcggagctggtggagatcctgggggacctgctccagggcaggggcctgcaagaggaagaggaggtctgcatggccccgcgcagctctcagagctcagaagagggcagcttctcgcaggtgtccaccatggccctacacatcgcccaggctgacgctgaggacagcccgccaagcctgcagcgccacagcctggccgccaggtattacaactgggtgtcctttcccgggtgcctggccagaggggctgagacccgtggttcctccaggatgaagacatttgaggaattccccatgaccccaacgacctacaaaggctctgtggacaaccagacagacagtgggatggtgctggcctcggaggagtttgagcagatagagagcaggcatagacaagaaagcggcttcaggtagctgaagcagagagagagaaggcagcatacgtcagcattttcttctctgcacttataagaaagatcaaagactttaagactttcgctatttcttctactgctatctactacaaacttcaaagaggaaccaggaggacaagaggagcatgaaagtggacaaggagtgtgaccactgaagcaccacagggaggggttaggcctccggatgactgcgggcaggcctggataatatccagcctcccacaagaagctggtggagcagagtgttccctgactcctccaaggaaagggagacgccctttcatggtctgctgagtaacaggtgccttcccagacactggcgttactgcttgaccaaagagccctcaagcggcccttatgccagcgtgacagagggctcacctcttgccttctaggtcacttctcacaatgtcccttcagcacctgaccctgtgcccgccagttattccttggtaatatgagtaatacatcaaagagtagtattaaaagctaattaatcatgtttataaaaa

SEQ ID NO: 62848 - DNA, 4301 bp, Homo sapiens
tcgggtcggacccacgcgcagcggccggagatgcagcggggcgccgcgctgtgcctgcgactgtggctctgcctgggactcctggacggcctggtgagtggctactccatgacccccccgaccttgaacatcacggaggagtcacacgtcatcgacaccggtgacagcctgtccatctcctgcaggggacagcaccccctcgagtgggcttggccaggagctcaggaggcgccagccaccggagacaaggacagcgaggacacgggggtggtgcgagactgcgagggcacagacgccaggccctactgcaaggtgttgctgctgcacgaggtacatgccaacgacacaggcagctacgtctgctactacaagtacatcaaggcacgcatcgagggcaccacggccgccagctcctacgtgttcgtgagagactttgagcagccattcatcaacaagcctgacacgctcttggtcaacaggaaggacgccatgtgggtgccctgtctggtgtccatccccggcctcaatgtcacgctgcgctcgcaaagctcggtgctgtggccagacgggcaggaggtggtgtgggatgaccggcggggcatgctcgtgtccacgccactgctgcacgatgccctgtacctgcagtgcgagaccacctggggagaccaggacttcctttccaaccccttcctggtgcacatcacaggcaacgagctctatgacatccagctgttgcccaggaagtcgctggagctgctggtaggggagaagctggtcctgaactgcaccgtgtgggctgagtttaactcaggtgtcacctttgactgggactacccagggaagcaggcagagcggggtaagtgggtgcccgagcgacgctcccagcagacccacacagaactctccagcatcctgaccatccacaacgtcagccagcacgacctgggctcgtatgtgtgcaaggccaacaacggcatccagcgatttcgggagagcaccgaggtcattgtgcatgaaaatcccttcatcagcgtcgagtggctcaaaggacccatcctggaggccacggcaggagacgagctggtgaagctgcccgtgaagctggcagcgtaccccccgcccgagttccagtggtacaaggatggaaaggcactgtccgggcgccacagtccacatgccctggtgctcaaggaggtgacagaggccagcacaggcacctacaccctcgccctgtggaactccgctgctggcctgaggcgcaacatcagcctggagctggtggtgaatgtgcccccccagatacatgagaaggaggcctcctcccccagcatctactcgcgtcacagccgccaggccctcacctgcacggcctacggggtgcccctgcctctcagcatccagtggcactggcggccctggacaccctgcaagatgtttgcccagcgtagtctccggcggcggcagcagcaagacctcatgccacagtgccgtgactggagggcggtgaccacgcaggatgccgtgaaccccatcgagagcctggacacctggaccgagtttgtggagggaaagaataagactgtgagcaagctggtgatccagaatgccaacgtgtctgccatgtacaagtgtgtggtctccaacaaggtgggccaggatgagcggctcatctacttctatgtgaccaccatccccgacggcttcaccatcgaatccaagccatccgaggagctactagagggccagccggtgctcctgagctgccaagccgacagctacaagtacgagcatctgcgctggtaccgcctcaacctgtccacgctgcacgatgcgcacgggaacccgcttctgctcgactgcaagaacgtgcatctgttcgccacccctctggccgccagcctggaggaggtggcacctggggcgcgccacgccacgctcagcctgagtatcccccgcgtcgcgcccgagcacgagggccactatgtgtgcgaagtgcaagaccggcgcagccatgacaagcactgccacaagaagtacctgtcggtgcaggccctggaagcccctcggctcacgcagaacttgaccgacctcctggtgaacgtgagcgactcgctggagatgcagtgcttggtggccggagcgcacgcgcccagcatcgtgtggtacaaagacgagaggctgctggaggaaaagtctggagtcgacttggcggactccaaccagaagctgagcatccagcgcgtgcgcgaggaggatgcgggacgctatctgtgcagcgtgtgcaacgccaagggctgcgtcaactcctccgccagcgtggccgtggaaggctccgaggataagggcagcatggagatcgtgatccttgtcggtaccggcgtcatcgctgtcttcttctgggtcctcctcctcctcatcttctgtaacatgaggaggccggcccacgcagacatcaagacgggctacctgtccatcatcatggaccccggggaggtgcctctggaggagcaatgcgaatacctgtcctacgatgccagccagtgggaattcccccgagagcggctgcacctggggagagtgctcggctacggcgccttcgggaaggtggtggaagcctccgctttcggcatccacaagggcagcagctgtgacaccgtggccgtgaaaatgctgaaagagggcgccacggccagcgagcagcgcgcgctgatgtcggagctcaagatcctcattcacatcggcaaccacctcaacgtggtcaacctcctcggggcgtgcaccaagccgcagggccccctcatggtgatcgtggagttctgcaagtacggcaacctctccaacttcctgcgcgccaagcgggacgccttcagcccctgcgcggagaagtctcccgagcagcgcggacgcttccgcgccatggtggagctcgccaggctggatcggaggcggccggggagcagcgacagggtcctcttcgcgcggttctcgaagaccgagggcggagcgaggcgggcttctccagaccaagaagctgaggacctgtggctgagcccgctgaccatggaagatcttgtctgctacagcttccaggtggccagagggatggagttcctggcttcccgaaagtgcatccacagagacctggctgctcggaacattctgctgtcggaaagcgacgtggtgaagatctgtgactttggccttgcccgggacatctacaaagaccccgactacgtccgcaagggcagtgcccggctgcccctgaagtggatggcccctgaaagcatcttcgacaaggtgtacaccacgcagagtgacgtgtggtcctttggggtgcttctctgggagatcttctctctgggggcctccccgtaccctggggtgcagatcaatgaggagttctgccagcggctgagagacggcacaaggatgagggccccggagctggccactcccgccatacgccgcatcatgctgaactgctggtccggagaccccaaggcgagacctgcattctcggagctggtggagatcctgggggacctgctccagggcaggggcctgcaagaggaagaggaggtctgcatggccccgcgcagctctcagagctcagaagagggcagcttctcgcaggtgtccaccatggccctacacatcgcccaggctgacgctgaggacagcccgccaagcctgcagcgccacagcctggccgccaggtattacaactgggtgtcctttcccgggtgcctggccagaggggctgagacccgtggttcctccaggatgaagacatttgaggaattccccatgaccccaacgacctacaaaggctctgtggtacttcacatgaagggtgggggctgcgctctcggctcagggctggggccgcctcaggggaggcagcgtcaggaattcgtaaggcaaatggcagaacccaacgactgtcctttgaaagtgcaagtccagggtgagccttgggcacatttgggccctcctgcgatgccacgactcacagctgctttctgtcctatgccctcgtcacccccacacgaggcctcccctcctcagcagcgcagaaaccccagtggaaggacggctcctcctcggtggcaggttcgggggtcccgggcctggtcagtgagcgctgggcagaggggccccatgggagcccttggccagaccacagggacctgggttcctgcctccagggccacttggagatgttgggggactctgaaaagatcgcagtttccctcccgtgtaattcaaaataaaaaccacaccaagccacagtcgaagga

SEQ ID NO: 62849 - DNA, 1383 bp, Homo sapiens
ggtgggaggggacatggggccacgggcctctgttcttcaaggctctgttcttcaagggacctttaagaggtgattagaccctctggatctgtcggttctggcacttgctctgtaattcaaccacctctccagcatccttcaaatacgcctctttccatgggagcagattttgttggcttttggccactggcccttaagtcctgattagtatctaccccttgagtcctcagggtgctcaggacagaggaagtcaccagaacaggcaataagaaagagtggagaggatctctgttaccttaagaccccagtgagcctcctccctgcttcccagtcacagactctggacagaaaccctgccccccgcccctggcaagatgccagctcccttcctggtcctgatgtcacaggtccctggacatgacctccccaccagggcaggaccccagctcccttcctggttgtgatgtcacaggtcctgacattccacagtgtcctggagaccaaggatgggaaactgtcaaccttcagaacatccttctccctcagctggagggagcatggcagtgagccaaggagacgggaccctctgctttgtcctcctgctgtgctgttggcaagaaactgagctccggccgagaaccgtgattccaggtctcgaggttcccaaagttcctggatctgccagcaaatgaccttcttcactcacctgtgggatggggacccggtgagccaggtagcaggttcacctactgaaataccattcagttcaaaacaggaggatatgtctgaattattagatgaaattctggtccaggagattttggatctgaataaaacaacaccgagcgaaatgccaagtacagcatcaacattatcaacaccgttacatgctggtattgatgagaattatcaagctggtggttctgagaattaccatgaattattagagaatttacaattctctcctggcattgaggacaaaatttccaatgatgaagccaatgctaatgcaaatctccatggcgatccttctgagaattatcgtgggccacaggtgtctcctggcagtgagaagagtgtttccagtaaagaaaagaattcaaagaacactcagtatgaaaatctatccattctggaccaaatccttcaaaatattggaagatcttcaggaaacattttccataaagagcagcagaggaccagcgcacagaggaggagccaaggcagtcagtgaggccgcagccccagaccccctgcgcaggagaggagcctgctagaacccccacccaccagcctccggaacagggcacttgtgtgcacacgcccacgttctctgaaccattccacataaaggaaaatcgtttattcacacgatcccaattg

SEQ ID NO: 62850 - DNA, 1613 bp, Homo sapiens
ggtgggaggggacatggggccacgggcctctgttcttcaaggctctgttcttcaagggacctttaagaggtgattagaccctctggatctgtcggttctggcacttgctctgtaattcaaccacctctccagcatccttcaaatacgcctctttccatgggagcagattttgttggcttttggccactggcccttaagtcctgattagtatctaccccttgagtcctcagggtgctcaggacagaggaagtcaccagaacaggcaataagaaagagtggagaggatctctgttaccttaagaccccagtgagcctcctccctgcttcccagtcacagactctggacagaaaccctgccccccgcccctggcaagatgccagctcccttcctggtcctgatgtcacaggtccctggacatgacctccccaccagggcaggaccccagctcccttcctggttgtgatgtcacaggtcctgacattccacagtgtcctggagaccaaggatgggaaactgtcaaccttcagaacatccttctccctcagctggagggagcatggcagtgagccaaggagacgggaccctctgctttgtcctcctgctgtgctgttggcaagaaactgagctccggccgagaaccgtgattccaggtctcgaggttcccaaagttcctggatctgccagcaaatgaccttcttcactcacctgtgggatggggacccggtgagccaggtagcagagtctcactctgttgccagactggagtgcagaggcgcctctcgatttcttgacctcatggtccgcccgcctcagcctcccaaagtgctgggactacaggcatgagccaccgtgcctggccaataacaccttaatcttcaggtgcaggctgtgaagatgggaaaaggctgtcaatgctctggcttcttcccactgacaggggacgtagtgggaatgggaatgaaccccaaggttcacctactgaaataccattcagttcaaaacaggaggatatgtctgaattattagatgaaattctggtccaggagattttggatctgaataaaacaacaccgagcgaaatgccaagtacagcatcaacattatcaacaccgttacatgctggtattgatgagaattatcaagctggtggttctgagaattaccatgaattattagagaatttacaattctctcctggcattgaggacaaaatttccaatgatgaagccaatgctaatgcaaatctccatggcgatccttctgagaattatcgtgggccacaggtgtctcctggcagtgagaagagtgtttccagtaaagaaaagaattcaaagaacactcagtatgaaaatctatccattctggaccaaatccttcaaaatattggaagatcttcaggaaacattttccataaagagcagcagaggaccagcgcacagaggaggagccaaggcagtcagtgaggccgcagccccagaccccctgcgcaggagaggagcctgctagaacccccacccaccagcctccggaacagggcacttgtgtgcacacgcccacgttctctgaaccattccacataaaggaaaatcgtttattcacacgatcccaattg

SEQ ID NO: 62851 - DNA, 1294 bp, Homo sapiens
ggtgggaggggacatggggccacgggcctctgttcttcaaggctctgttcttcaagggacctttaagaggtgattagaccctctggatctgtcggttctggcacttgctctgtaattcaaccacctctccagcatccttcaaatacgcctctttccatgggagcagattttgttggcttttggccactggcccttaagtcctgattagtatctaccccttgagtcctcagggtgctcaggacagaggaagtcaccagaacaggcaataagaaagagtggagaggatctctgttaccttaagaccccagtgagcctcctccctgcttcccagtcacagactctggacagaaaccctgccccccgcccctggcaagatgccagctcccttcctggtcctgatgtcacaggtccctggacatgacctccccaccagggcaggaccccagctcccttcctggttgtgatgtcacaggtcctgacattccacagtgtcctggagaccaaggatgggaaactgtcaaccttcagaacatccttctccctcagctggagggagcatggcagtgagccaaggagacgggaccctctgctttgtcctcctgctgtgctgttggcaagaaactgagctccggccgagaaccgtgattccaggttcacctactgaaataccattcagttcaaaacaggaggatatgtctgaattattagatgaaattctggtccaggagattttggatctgaataaaacaacaccgagcgaaatgccaagtacagcatcaacattatcaacaccgttacatgctggtattgatgagaattatcaagctggtggttctgagaattaccatgaattattagagaatttacaattctctcctggcattgaggacaaaatttccaatgatgaagccaatgctaatgcaaatctccatggcgatccttctgagaattatcgtgggccacaggtgtctcctggcagtgagaagagtgtttccagtaaagaaaagaattcaaagaacactcagtatgaaaatctatccattctggaccaaatccttcaaaatattggaagatcttcaggaaacattttccataaagagcagcagaggaccagcgcacagaggaggagccaaggcagtcagtgaggccgcagccccagaccccctgcgcaggagaggagcctgctagaacccccacccaccagcctccggaacagggcacttgtgtgcacacgcccacgttctctgaaccattccacataaaggaaaatcgtttattcacacgatcccaattg

SEQ ID NO: 62852 - DNA, 1556 bp, Homo sapiens
ggtgggaggggacatggggccacgggcctctgttcttcaaggctctgttcttcaagggacctttaagaggtgattagaccctctggatctgtcggttctggcacttgctctgtaattcaaccacctctccagcatccttcaaatacgcctctttccatgggagcagattttgttggcttttggccactggcccttaagtcctgattagtatctaccccttgagtcctcagggtgctcaggacagaggaagtcaccagaacaggcaataagaaagagtggagaggatctctgttaccttaagaccccagtgagcctcctccctgcttcccagtcacagactctggacagaaaccctgccccccgcccctggcaagatgccagctcccttcctggtcctgatgtcacaggtccctggacatgacctccccaccagggcaggaccccagctcccttcctggttgtgatgtcacaggtcctgacattccacagtgtcctggagaccaaggatgggaaactgtcaaccttcagaacatccttctccctcagctggagggagcatggcagtgagccaaggagacgggaccctctgctttgtcctcctgctgtgctgttggcaagaaactgagctccggccgagaaccgtgattccaggtctcgaggttcccaaagttcctggatctgccagcaaatgaccttcttcactcacctgtgggatggggacccggtgagccaggtagcagagtctcactctgttgccagactggagtgcagaggcgcctctcgatttcttgacctcatggtccgcccgcctcagcctcccaaagtgctgggactacaggcatgagccaccgtgcctggccaataacaccttaatcttcaggtgcaggctgtgaagatgggaaaaggctgtcaatgctctggcttcttcccactgacaggggacgtagtgggaatgggaatgaaccccaagatgaaattctggtccaggagattttggatctgaataaaacaacaccgagcgaaatgccaagtacagcatcaacattatcaacaccgttacatgctggtattgatgagaattatcaagctggtggttctgagaattaccatgaattattagagaatttacaattctctcctggcattgaggacaaaatttccaatgatgaagccaatgctaatgcaaatctccatggcgatccttctgagaattatcgtgggccacaggtgtctcctggcagtgagaagagtgtttccagtaaagaaaagaattcaaagaacactcagtatgaaaatctatccattctggaccaaatccttcaaaatattggaagatcttcaggaaacattttccataaagagcagcagaggaccagcgcacagaggaggagccaaggcagtcagtgaggccgcagccccagaccccctgcgcaggagaggagcctgctagaacccccacccaccagcctccggaacagggcacttgtgtgcacacgcccacgttctctgaaccattccacataaaggaaaatcgtttattcacacgatcccaattg

SEQ ID NO: 62853 - DNA, 454 bp, Homo sapiens
atttgttgctggatttcatgtgggttgggagataaaggagtcaaggatcaccctaagatttttggcctgagcaaactggaaggatggagttactaggtactgagataaaggtgactgtttctgctgtgggtgggcaaacaccttttgaaggaaagtcagcaattcattcttgaacatgctatgattgagaacactcctagacgtctaaatggagatgtcaagtaggtataattagatttgggacatttgagttctggggagagattacatgtctgaatttactaggtgacagagtattggtttgctatttaaagccatatgatcagatgaaatcagtgtaagggacactagtatagtatagctgaagaagggaagtcctcttggttgaaatactgaggctaggggaactctggatttttagaatcagggagatgagaagaaacctgtagaaggt

SEQ ID NO: 62854 - DNA, 906 bp, Homo sapiens
tctactgaaccactttcttccatgtgcacacgctgatttctcaacctggaatcatttccctacacctttcctcaaaggactgttaatgagttttcagagcaggtacttcactgaaatgtaactaccacaatgcatcctttccatgtgactaacttcgctcatggaccagaatcactgtggctctgccctggagtggtgcaaagagctcgcattctgtttggaaagcaaattatttaaatccagtagaggactctcaaatgtggttggaaaatctaagaagacttcccagaggcagcagcactagtgttagggaaagagctcacaaattccattgctgtagaacccatgtgttgaagaccgctacactggaatctagttttctatcctaaaatctacctcctgagtttgagtaagacttgaactagtttgcaaatatctgtgatcttcaccttgcctgcctgcaaagcccataagcaagttcagaagagacttctacttgtccaaagcaacatggagtaaagtgggtcaactagaattaaaatatgctccagccaaaggtgaccatggaaacctattgataaggctctggggtcagattcatctctgttcagacaactctagcggtgtgactctgagcaagtgttttttaacctaagttcctgcttcctcaactgcaaatgtaggaatggtaacatcttcctcaaagttgtatgctggggataacacatgaaggagatgcctgggccatataattatttaagaaatgttcatttctttcttgaactaccttctaccaactatttggtctgagtttatgaaactgtaaattttgtctaacatttgcctaacaaagcattattaccttgcttaaagaaacacacaatacattctaaaccaaaaataaaa

SEQ ID NO: 62855 - DNA, 81 bp, Homo sapiens
ttccttggtacaatttgcccccagccccatcctcctgcaatgtacaagtccagcttggttgttttttgtttgttttttaag

SEQ ID NO: 62856 - DNA, 440 bp, Homo sapiens
aaagccaagaagaaactctcaaatgagccaaaaaggaaaaaaaaaattctctgaaaagaattttagggggaaaagttgtgctattttaaaaagctttgagggctgtaaagtgccacgtttttcacaccttctccatacttttttttcagatttttttagtatgtttaacatttgtgagatgacatcctttttgtatctcaaactggatgcttcaggatttgtaggggaggggttggtggtattcacgttctcttgtgagagaaagtttgtgcctaaaggcctccttcctggggaactgtttaaaccctcgcaggcagacctgtcaggttttactgtgttatttgccaccattttcaacatgcaaaagtaacatgcagttaatggtattggaatgagaccacagcaagagcagaaacctctcgtgacaacttttcagcgac

SEQ ID NO: 62857 - DNA, 303 bp, Homo sapiens
tgagactgctggcctgggcagcactgtactttttgcttttcctggaaggggaagaagagaacaatccactttctgtatggtcctgtccttcattcgagtttataacgttctccccagctgaagtctacacaatctttacccagacatcagaaacagctgtctcaggcagaaggcgcttgactccaggtgggcgctcagcagcaagggcaggtgaagggcatggacatcagattgttctcccctcagtcttcagtttttcagctaagttctgacatgacgacacagactgaacaccctcagaca

SEQ ID NO: 62858 - DNA, 3653 bp, Homo sapiens
agttattaatgaccgctgagcaggcagcaccatgtcagtgtgacaactgatcgggtgaacgatgcaccactaaccaccatggaaacaaggaaaaataaagccagctcacaggatctctcttcactggattgagagcctcagcctgccgactgagaaaaagagttccaggaaaaagaaggaatcccggctgcagcctcctgccttcctttatattttaaaatagagagataagattgcgtgcatgtgtgcatatctatagtatatattttgtacactttgttacacagacacacaaatgcacctatttataccgggcaagaacacaaccatgtgattatctcaaccaaggaactgaggaatccagcacgcaaggacatcggaggtgggctagcactgaaactgcttttcaaggaggtgaagcattccacagataatcagctactctattcagggaaggagtgtaaacatcaccactttttgcatgtttgcataaaaaaggcccactgaatcagttaaagacgaggaagaggaggagaaagagaaagaagaggaagatgttgggcaacatttatttaacatgctccacagcccggaccctggcatcatgctgctattcctgcaaatactgaagaagcatgggatttaaatattttacttctaaataaatgaattactcaatctcctatgaccatctatacatactccaccttcaaaaagtacatcaatattatatcattaaggaaatagtaaccttctcttctccaatatgcatgacatttttggacaatgcaattgtggcactggcacttatttcagtgaagaaaaactttgtggttctatggcattcatcatttgacaaatgcaagcatcttccttatcaatcagctcctattgaacttactagcactgactgtggaatccttaagggcccattacatttctgaagaagaaagctaagatgaaggacatgccactccgaattcatgtgctacttggcctagctatcactacactagtacaagctgtagataaaaaagtggattgtccacggttatgtacgtgtgaaatcaggccttggtttacacccagatccatttatatggaagcatctacagtggattgtaatgatttaggtcttttaactttcccagccagattgccagctaacacacagattcttctcctacagactaacaatattgcaaaaattgaatactccacagactttccagtaaaccttactggcctggatttatctcaaaacaatttatcttcagtcaccaatattaatgtaaaaaagatgcctcagctcctttctgtgtacctagaggaaaacaaacttactgaactgcctgaaaaatgtctgtccgaactgagcaacttacaagaactctatattaatcacaacttgctttctacaatttcacctggagcctttattggcctacataatcttcttcgacttcatctcaattcaaatagattgcagatgatcaacagtaagtggtttgatgctcttccaaatctagagattctgatgattggggaaaatccaattatcagaatcaaagacatgaactttaagcctcttatcaatcttcgcagcctggttatagctggtataaacctcacagaaataccagataacgccttggttggactggaaaacttagaaagcatctctttttacgataacaggcttattaaagtaccccatgttgctcttcaaaaagttgtaaatctcaaatttttggatctaaataaaaatcctattaatagaatacgaaggggtgattttagcaatatgctacacttaaaagagttggggataaataatatgcctgagctgatttccatcgatagtcttgctgtggataacctgccagatttaagaaaaatagaagctactaacaaccctagattgtcttacattcaccccaatgcatttttcagactccccaagctggaatcactcatgctgaacagcaatgctctcagtgccctgtaccatggtaccattgagtctctgccaaacctcaaggaaatcagcatacacagtaaccccatcaggtgtgactgtgtcatccgttggatgaacatgaacaaaaccaacattcgattcatggagccagattcactgttttgcgtggacccacctgaattccaaggtcagaatgttcggcaagtgcatttcagggacatgatggaaatttgtctccctcttatagctcctgagagctttccttctaatctaaatgtagaagctgggagctatgtttcctttcactgtagagctactgcagaaccacagcctgaaatctactggataacaccttctggtcaaaaactcttgcctaataccctgacagacaagttctatgtccattctgagggaacactagatataaatggcgtaactcccaaagaagggggtttatatacttgtatagcaactaacctagttggcgctgacttgaagtctgttatgatcaaagtggatggatcttttccacaagataacaatggctctttgaatattaaaataagagatattcaggccaattcagttttggtgtcctggaaagcaagttctaaaattctcaaatctagtgttaaatggacagcctttgtcaagactgaaaattctcatgctgcgcaaagtgctcgaataccatctgatgtcaaggtatataatcttactcatctgaatccatcaactgagtataaaatttgtattgatattcccaccatctatcagaaaaacagaaaaaaatgtgtaaatgtcaccaccaaaggtttgcaccctgatcaaaaagagtatgaaaagaataataccacaacacttatggcctgtcttggaggccttctggggattattggtgtgatatgtcttatcagctgcctctctccagaaatgaactgtgatggtggacacagctatgtgaggaattacttacagaaaccaacctttgcattaggtgagctttatcctcctctgataaatctctgggaagcaggaaaagaaaaaagtacatcactgaaagtaaaagcaactgttataggtttaccaacaaatatgtcctaaaaaccaccaaggaaacctactccaaaaatgaacaaaaaaaaaaaaaagcgaaagactgcagttgtgctaaaaacaaaacaaaacaaacaaacaaacaaaaaagtaaaaaaagattactttcgagagagaagtttaagcttcaccaatgctgctcctgaccaatggaaatatgtacaacttcagcattttaagtaactggcttcaaggggtactgtggcaaccaaataaaataactccattttctaaaactttcatgtaacttttatgtctggactacagttcaagtggacaaaaacatttctgtattttttttaagtaaataagagtagttgaactgagcaatacctcctcctgtgttgtattacacatattagccacgagtttttgcagtgaccagataaacttgaattgacacgtggtgtaataaaatggacaaattctgtagagtagacacagtgagtatgtggacctcttttataaggaaaaatacattttggattaaaatcaattgcttctgtcttgttttgtttctaaataaagaataatttctgggaaaaaaaaaactgat

SEQ ID NO: 62859 - DNA, 3464 bp, Homo sapiens
agttattaatgaccgctgagcaggcagcaccatgtcagtgtgacaactgatcgggtgaacgatgcaccactaaccaccatggaaacaaggaaaaataaagccagctcacaggatctctcttcactggattgagagcctcagcctgccgactgagaaaaagagttccaggaaaaagaaggaatcccggctgcagcctcctgccttcctttatattttaaaatagagagataagattgcgtgcatgtgtgcatatctatagtatatattttgtacactttgttacacagacacacaaatgcacctatttataccgggcaagaacacaaccatgtgattatctcaaccaaggaactgaggaatccagcacgcaaggacatcggaggtgggctagcactgaaactgcttttcaagcatcatgctgctattcctgcaaatactgaagaagcatgggatttaaatattttacttctaaataaatgaattactcaatctcctatgaccatctatacatactccaccttcaaaaagtacatcaatattatatcattaaggaaatagtaaccttctcttctccaatatgcatgacatttttggacaatgcaattgtggcactggcacttatttcagtgaagaaaaactttgtggttctatggcattcatcatttgacaaatgcaagcatcttccttatcaatcagctcctattgaacttactagcactgactgtggaatccttaagggcccattacatttctgaagaagaaagctaagatgaaggacatgccactccgaattcatgtgctacttggcctagctatcactacactagtacaagctgtagataaaaaagtggattgtccacggttatgtacgtgtgaaatcaggccttggtttacacccagatccatttatatggaagcatctacagtggattgtaatgatttaggtcttttaactttcccagccagattgccagctaacacacagattcttctcctacagactaacaatattgcaaaaattgaatactccacagactttccagtaaaccttactggcctggatttatctcaaaacaatttatcttcagtcaccaatattaatgtaaaaaagatgcctcagctcctttctgtgtacctagaggaaaacaaacttactgaactgcctgaaaaatgtctgtccgaactgagcaacttacaagaactctatattaatcacaacttgctttctacaatttcacctggagcctttattggcctacataatcttcttcgacttcatctcaattcaaatagattgcagatgatcaacagtaagtggtttgatgctcttccaaatctagagattctgatgattggggaaaatccaattatcagaatcaaagacatgaactttaagcctcttatcaatcttcgcagcctggttatagctggtataaacctcacagaaataccagataacgccttggttggactggaaaacttagaaagcatctctttttacgataacaggcttattaaagtaccccatgttgctcttcaaaaagttgtaaatctcaaatttttggatctaaataaaaatcctattaatagaatacgaaggggtgattttagcaatatgctacacttaaaagagttggggataaataatatgcctgagctgatttccatcgatagtcttgctgtggataacctgccagatttaagaaaaatagaagctactaacaaccctagattgtcttacattcaccccaatgcatttttcagactccccaagctggaatcactcatgctgaacagcaatgctctcagtgccctgtaccatggtaccattgagtctctgccaaacctcaaggaaatcagcatacacagtaaccccatcaggtgtgactgtgtcatccgttggatgaacatgaacaaaaccaacattcgattcatggagccagattcactgttttgcgtggacccacctgaattccaaggtcagaatgttcggcaagtgcatttcagggacatgatggaaatttgtctccctcttatagctcctgagagctttccttctaatctaaatgtagaagctgggagctatgtttcctttcactgtagagctactgcagaaccacagcctgaaatctactggataacaccttctggtcaaaaactcttgcctaataccctgacagacaagttctatgtccattctgagggaacactagatataaatggcgtaactcccaaagaagggggtttatatacttgtatagcaactaacctagttggcgctgacttgaagtctgttatgatcaaagtggatggatcttttccacaagataacaatggctctttgaatattaaaataagagatattcaggccaattcagttttggtgtcctggaaagcaagttctaaaattctcaaatctagtgttaaatggacagcctttgtcaagactgaaaattctcatgctgcgcaaagtgctcgaataccatctgatgtcaaggtatataatcttactcatctgaatccatcaactgagtataaaatttgtattgatattcccaccatctatcagaaaaacagaaaaaaatgtgtaaatgtcaccaccaaaggtttgcaccctgatcaaaaagagtatgaaaagaataataccacaacacttatggcctgtcttggaggccttctggggattattggtgtgatatgtcttatcagctgcctctctccagaaatgaactgtgatggtggacacagctatgtgaggaattacttacagaaaccaacctttgcattaggtgagctttatcctcctctgataaatctctgggaagcaggaaaagaaaaaagtacatcactgaaagtaaaagcaactgttataggtttaccaacaaatatgtcctaaaaaccaccaaggaaacctactccaaaaatgaacaaaaaaaaaaaaaagcgaaagactgcagttgtgctaaaaacaaaacaaaacaaacaaacaaacaaaaaagtaaaaaaagattactttcgagagagaagtttaagcttcaccaatgctgctcctgaccaatggaaatatgtacaacttcagcattttaagtaactggcttcaaggggtactgtggcaaccaaataaaataactccattttctaaaactttcatgtaacttttatgtctggactacagttcaagtggacaaaaacatttctgtattttttttaagtaaataagagtagttgaactgagcaatacctcctcctgtgttgtattacacatattagccacgagtttttgcagtgaccagataaacttgaattgacacgtggtgtaataaaatggacaaattctgtagagtagacacagtgagtatgtggacctcttttataaggaaaaatacattttggattaaaatcaattgcttctgtcttgttttgtttctaaataaagaataatttctgggaaaaaaaaaactgat

SEQ ID NO: 62860 - DNA, 2806 bp, Homo sapiens
agttattaatgaccgctgagcaggcagcaccatgtcagtgtgacaactgatcgggtgaacgatgcaccactaaccaccatggaaacaaggaaaaataaagccagctcacaggatctctcttcactggattgagagcctcagcctgccgactgagaaaaagagttccaggaaaaagaaggaatcccggctgcagcctcctgccttcctttatattttaaaatagagagataagattgcgtgcatgtgtgcatatctatagtatatattttgtacactttgttacacagacacacaaatgcacctatttataccgggcaagaacacaaccatgtgattatctcaaccaaggaactgaggaatccagcacgcaaggacatcggaggtgggctagcactgaaactgcttttcaaggaggtgaagcattccacagataatcagctactctattcagggaaggagtgtaaacatcaccactttttgcatgtttgcataaaaaaggcccactgaatcagttaaagacgaggaagaggaggagaaagagaaagaagaggaagatgttgggcaacatttatttaacatgctccacagcccggaccctggcatcatgctgctattcctgcaaatactgaagaagcatgggatttaaatattttacttctaaataaatgaattactcaatctcctatgaccatctatacatactccaccttcaaaaagtacatcaatattatatcattaaggaaatagtaaccttctcttctccaatatgcatgacatttttggacaatgcaattgtggcactggcacttatttcagtgaagaaaaactttgtggttctatggcattcatcatttgacaaatgcaagcatcttccttatcaatcagctcctattgaacttactagcactgactgtggaatccttaagggcccattacatttctgaagaagaaagctaagatgaaggacatgccactccgaattcatgtgctacttggcctagctatcactacactagtacaagctgtagataaaaaagtggattgtccacggttatgtacgtgtgaaatcaggccttggtttacacccagatccatttatatggaagcatctacagtggattgtaatgatttaggtcttttaactttcccagccagattgccagctaacacacagattcttctcctacagactaacaatattgcaaaaattgaatactccacagactttccagtaaaccttactggcctggatttatctcaaaacaatttatcttcagtcaccaatattaatgtaaaaaagatgcctcagctcctttctgtgtacctagaggaaaacaaacttactgaactgcctgaaaaatgtctgtccgaactgagcaacttacaagaactctatattaatcacaacttgctttctacaatttcacctggagcctttattggcctacataatcttcttcgacttcatctcaattcaaatagattgcagatgatcaacagtaagtggtttgatgctcttccaaatctagagattctgatgattggggaaaatccaattatcagaatcaaagacatgaactttaagcctcttatcaatcttcgcagcctggttatagctggtataaacctcacagaaataccagataacgccttggttggactggaaaacttagaaagcatctctttttacgataacaggcttattaaagtaccccatgttgctcttcaaaaagttgtaaatctcaaatttttggatctaaataaaaatcctattaatagaatacgaaggggtgattttagcaatatgctacacttaaaagagttggggataaataatatgcctgagctgatttccatcgatagtcttgctgtggataacctgccagatttaagaaaaatagaagctactaacaaccctagattgtcttacattcaccccaatgcatttttcagactccccaagctggaatcactcatgctgaacagcaatgctctcagtgccctgtaccatggtaccattgagtctctgccaaacctcaaggaaatcagcatacacagtaaccccatcaggtgtgactgtgtcatccgttggatgaacatgaacaaaaccaacattcgattcatggagccagattcactgttttgcgtggacccacctgaattccaaggtcagaatgttcggcaagtgcatttcagggacatgatggaaatttgtctccctcttatagctcctgagagctttccttctaatctaaatgtagaagctgggagctatgtttcctttcactgtagagctactgcagaaccacagcctgaaatctactggataacaccttctggtcaaaaactcttgcctaataccctgacagacaagttctatgtccattctgagggaacactagatataaatggcgtaactcccaaagaagggggtttatatacttgtatagcaactaacctagttggcgctgacttgaagtctgttatgatcaaagtggatggatcttttccacaagataacaatggctctttgaatattaaaataagagatattcaggccaattcagttttggtgtcctggaaagcaagttctaaaattctcaaatctagtgttaaatggacagcctttgtcaagactgaaaattctcatgctgcgcaaagtgctcgaataccatctgatgtcaaggtatataatcttactcatctgaaaccccacaccgggtaaaaaaaatgggtatggaatatcccccctctattcaaaaaacacaaaaaaagggggaaaaggccccccccaagggtttggccc

SEQ ID NO: 62861 - DNA, 3546 bp, Homo sapiens
agttattaatgaccgctgagcaggcagcaccatgtcagtgtgacaactgatcgggtgaacgatgcaccactaaccaccatggaaacaaggaaaaataaagccagctcacaggatctctcttcactggattgagagcctcagcctgccgactgagaaaaagagttccaggaaaaagaaggaatcccggctgcagcctcctgccttcctttatattttaaaatagagagataagattgcgtgcatgtgtgcatatctatagtatatattttgtacactttgttacacagacacacaaatgcacctatttataccgggcaagaacacaaccatgtgattatctcaaccaaggaactgaggaatccagcacgcaaggacatcggaggtgggctagcactgaaactgcttttcaagacgaggaagaggaggagaaagagaaagaagaggaagatgttgggcaacatttatttaacatgctccacagcccggaccctggcatcatgctgctattcctgcaaatactgaagaagcatgggatttaaatattttacttctaaataaatgaattactcaatctcctatgaccatctatacatactccaccttcaaaaagtacatcaatattatatcattaaggaaatagtaaccttctcttctccaatatgcatgacatttttggacaatgcaattgtggcactggcacttatttcagtgaagaaaaactttgtggttctatggcattcatcatttgacaaatgcaagcatcttccttatcaatcagctcctattgaacttactagcactgactgtggaatccttaagggcccattacatttctgaagaagaaagctaagatgaaggacatgccactccgaattcatgtgctacttggcctagctatcactacactagtacaagctgtagataaaaaagtggattgtccacggttatgtacgtgtgaaatcaggccttggtttacacccagatccatttatatggaagcatctacagtggattgtaatgatttaggtcttttaactttcccagccagattgccagctaacacacagattcttctcctacagactaacaatattgcaaaaattgaatactccacagactttccagtaaaccttactggcctggatttatctcaaaacaatttatcttcagtcaccaatattaatgtaaaaaagatgcctcagctcctttctgtgtacctagaggaaaacaaacttactgaactgcctgaaaaatgtctgtccgaactgagcaacttacaagaactctatattaatcacaacttgctttctacaatttcacctggagcctttattggcctacataatcttcttcgacttcatctcaattcaaatagattgcagatgatcaacagtaagtggtttgatgctcttccaaatctagagattctgatgattggggaaaatccaattatcagaatcaaagacatgaactttaagcctcttatcaatcttcgcagcctggttatagctggtataaacctcacagaaataccagataacgccttggttggactggaaaacttagaaagcatctctttttacgataacaggcttattaaagtaccccatgttgctcttcaaaaagttgtaaatctcaaatttttggatctaaataaaaatcctattaatagaatacgaaggggtgattttagcaatatgctacacttaaaagagttggggataaataatatgcctgagctgatttccatcgatagtcttgctgtggataacctgccagatttaagaaaaatagaagctactaacaaccctagattgtcttacattcaccccaatgcatttttcagactccccaagctggaatcactcatgctgaacagcaatgctctcagtgccctgtaccatggtaccattgagtctctgccaaacctcaaggaaatcagcatacacagtaaccccatcaggtgtgactgtgtcatccgttggatgaacatgaacaaaaccaacattcgattcatggagccagattcactgttttgcgtggacccacctgaattccaaggtcagaatgttcggcaagtgcatttcagggacatgatggaaatttgtctccctcttatagctcctgagagctttccttctaatctaaatgtagaagctgggagctatgtttcctttcactgtagagctactgcagaaccacagcctgaaatctactggataacaccttctggtcaaaaactcttgcctaataccctgacagacaagttctatgtccattctgagggaacactagatataaatggcgtaactcccaaagaagggggtttatatacttgtatagcaactaacctagttggcgctgacttgaagtctgttatgatcaaagtggatggatcttttccacaagataacaatggctctttgaatattaaaataagagatattcaggccaattcagttttggtgtcctggaaagcaagttctaaaattctcaaatctagtgttaaatggacagcctttgtcaagactgaaaattctcatgctgcgcaaagtgctcgaataccatctgatgtcaaggtatataatcttactcatctgaatccatcaactgagtataaaatttgtattgatattcccaccatctatcagaaaaacagaaaaaaatgtgtaaatgtcaccaccaaaggtttgcaccctgatcaaaaagagtatgaaaagaataataccacaacacttatggcctgtcttggaggccttctggggattattggtgtgatatgtcttatcagctgcctctctccagaaatgaactgtgatggtggacacagctatgtgaggaattacttacagaaaccaacctttgcattaggtgagctttatcctcctctgataaatctctgggaagcaggaaaagaaaaaagtacatcactgaaagtaaaagcaactgttataggtttaccaacaaatatgtcctaaaaaccaccaaggaaacctactccaaaaatgaacaaaaaaaaaaaaaagcgaaagactgcagttgtgctaaaaacaaaacaaaacaaacaaacaaacaaaaaagtaaaaaaagattactttcgagagagaagtttaagcttcaccaatgctgctcctgaccaatggaaatatgtacaacttcagcattttaagtaactggcttcaaggggtactgtggcaaccaaataaaataactccattttctaaaactttcatgtaacttttatgtctggactacagttcaagtggacaaaaacatttctgtattttttttaagtaaataagagtagttgaactgagcaatacctcctcctgtgttgtattacacatattagccacgagtttttgcagtgaccagataaacttgaattgacacgtggtgtaataaaatggacaaattctgtagagtagacacagtgagtatgtggacctcttttataaggaaaaatacattttggattaaaatcaattgcttctgtcttgttttgtttctaaataaagaataatttctgggaaaaaaaaaactgat

SEQ ID NO: 62862 - DNA, 453 bp, Homo sapiens
atcccctgttaaatgcagggctgcattacagctgctataagtttgtgtttcacgggtgggagaaagggataatttctgttacctgatcattaatatactctaaagagttctggaagaaagcaacaaacatgaaccccatgttcaacgaacataatatgggcccttcccgtgggcaaagtcctgtcctggagaatttgaggggtaacatttgatgaaggcatggtccctcactgttaataaatgcacagtctagtggaagtggcagtgtgattaccaaatactgagagttcgatgtagaatgcaatgaatgagatcacagaggtataaggcaagtgttatgggagcacaggaagggggagaaatgagttccatctgaaagggctgaggagggaggctcggaggaggagatgatgactagattgagtctggaaagagtgcagggtttagacaggc

SEQ ID NO: 62863 - DNA, 216 bp, Homo sapiens
agaggccaggtggaaagggagggaggcctctgggaatcaggacagcaggtggtgctggtagtgaaaagtccctgtggtttgagagactgtaagccacagaagagactgtccccgctgagagacaaggactgctgcagaaacagaaagcctggaggctggccagtgctcaagcctggaataggaacttctctgcaactaaataaaagaaaattagct

SEQ ID NO: 62864 - DNA, 301 bp, Homo sapiens
gggagggacaaatatcaaaccatgtgaagacaccaacagccttctcactgctcttcagtcttctatgtgttacttggtcccaaacatgtagcaattggctttaggttttcattccagtagtatttcatgttctggtgccaatttttattccagtcccctattgctgtgtaatgtcaatctgaaagaaagaactaagggccaggcacggtggctcacacctgtaatcccagcacattgggaggccgaggtaggaggatcacttgatccccagagtttgagaccagcctgagcaacataatga

SEQ ID NO: 62865 - DNA, 294 bp, Homo sapiens
atttatctaaagcttataaaacataccacctgatcaaatccttcagggtaacctctaactttacggcactgtaacactattggcccttttatcagttgtgggttgttagtcaaatatactttgtaaacaaagttacaatgcacactagaatcagaaagaatgaaccagaactacatggtttgactccacctctgggctagagagtctcctttcagtattaactttggaagttttccaagtttacctttgaaagggagccaatattcttttataccacaattgctagaattgtac

SEQ ID NO: 62866 - DNA, 2376 bp, Homo sapiens
tctctccctagttctgaaagagacttgctgtgtgatagagaacaggccatttgtgcctgaaatgttctaacctgcaaattgggtttaatggtaattatcctgcctttctgtctgggaggaaacagagatgctacatagatgaaagctctgattatcatttaaaacaaataaatgtactaaatgccatggtataatatagggaagaatggatgacttcaaagagaccatggttccgttggaggcataaaattgcctgcaaagaggcaaatataatttccagaccaattaatgacttgctgccctcgtaaatggatttaggacatctttgttccttgcttcttttgttaaaactcattcttagtttcattatcagctcactaataataccagtgttgttaagatgctcaaactagagaattgtatgctggatgtgacgctaggacctcagatcctttgatagtgcagttatgaccaggatctctttattctgtgcttcacgtcaacatcattaacccgatgaagcgaagcacaagtcataaaggcacatcagagaagccaagaaagcggggccgtacagagagcatcaaaatcaggtcagaaaaatgctgctttcctcttccaccaaaccttctccctgttgtttttacatgccccgtccctccagattcagcctccgttttgttctctctccttttccttttcctcctctcttccttactttcccctgtgagatgcttttctgtccttttactgcacctcttccagacctatggcatttggggacgggtcacccttcctagagtgatcctgaatccagctgcctcttctttttttgtttttgtttttgtttttgagacagagtctctttctgtcgtccaggctggagtgcagtagcgcaatcttggctcactgcaacctctgcctcctgggttcaagcgattcttgtgcctcaacctcacgaggagctgggattgcaggcgcccgccaccacacccggctaatttttgtatttttagtagagacggagtttcaccatgttggccacgctggtcttgaagcccagacctcaagtgatccgcccgccttggcctcccaaagtgctgggattacaggcatgagccaccgcgcctggcctagttccctcttcttagatggagatttctgcacatgagctgtgagatccacagacatgtcactgagctcccccactctgtcagtggaagatgaatggaataaagcctgcttgcattgtggagtgcagctgtggggacagttgtcatttttgtgttttcagcttaactgtccagcatctcccctcccttcctacagcagggacatcatgccttagatataaacttagtggtgtgcagtacccaccgtggaagctgaagaagggaagtatttcctgtctctcaggcacaccccgcttccagccccataccagtcgggaagtggtcattgacctggggtggactacctggacccttgcttggggctatgagcctggagaatgtgacacaaatgaagggatgctgagactcatttcaaggaagccaccgtggtccggggttggtagtcatacagcaaggcaggtgggtagggctggcaggctgcagggatggtgtgtccactggtagcaatgtccagggatggcagcgtcctgggaatgtcatttctgctccactccttggactcgctgagctgtctccgcctccacctatcttcctacagacctcccttctagttttctgtcaattctttgagccagcaaactccatccagtacattctttcttctttcatgaaagagcttgagttggatgtaaatatatatgacctaacaattccacccctaggtgtataccctacagaaatgtgtacatgtgttcatccagagacatgctctaaatcttcacaaaaacactctccataataaccctgaacaggaaagcaccccaatgcccatgttggctggataagcacattagggtatattcacacgatggaatcccagactgcaatgggaatgagctgcaactccacccccaacttggagtgtattcaccaaccctagtgttgaacgagataaggcaaaaatgcaccataggattccatttatataaagtttaaaacccagcaaaattcatccatgcggttgcaagtagagatcagtcctaagaagacagtaaccagaagggggcatgaggtggtgcttctggggtgttctgtttcttgatctggttgccggttacctgggtgctttccgtttgtgaacattcttggagctgtacacttttgatctgggcacttttctgtgtgtatgttatacttcaataaaaagttgggctttgtgactagcaatcaagaatcctacttt

SEQ ID NO: 62867 - DNA, 906 bp, Homo sapiens
gacatgtaccaagaaatatcttcaggtgtggagataagggacggtttatctattccctcttttcctttcattctttggaatggaatgactcttctaaagaacacgctgtaggaagtctgaatatatccaacctcttgcctcaaccagaaacgaaacttacaatgtgaaagacgatgaccaccctttataaaacatcctcagcccttgtccagccttgcgtggcatgagattggagaagaccttcaagcagtgtcactccttcgaacaaagagtgggggtcccacttatctgacagcagcatcctaccaaaatcccagtgacaaaagaatgacacaggcgtgaaaagcagcttcctgtcctggaaaaaccaagtaattttgtacctgatcaggtcaacatgagtaaactcgtcaagataattagaaggcccttaaagctcgatagtaatcaagccctcttcctagtggtgagcagagacagcttggtgagtatttccatgctgatttatgaagtgtatgaaagtgagaaggatgaagacgaattcctgtatgtgatagtatatacctctagggagacatttggagtgaagctgtcattataagactagaaacacacacacacaaaatgcatctattccagaatgtttaaatcattcccagagtcggggggagggggggaaggataacaaggggatgttaccaattgagattgatcagttcatctaatcacagatcatcaaaacagcagtgttcccacctaggagtttagaaagttgcatttgcatttaaagcagaaaaactgagctctgaatgagcaaattcaattttagaaaactatattatttatcctaggctatcttgttttcaaattttagaagttcaaaaataaaatactttgcatttgatg

SEQ ID NO: 62868 - DNA, 665 bp, Homo sapiens
gacatgtaccaagaaatatcttcaggtgtggagataagggacggtttatctattccctcttttcctttcattctttggaatggaatgactcttctaaagaacacgctgtaggaagtctgaatatatccaacctcttgcctcaaccagaaacgaaacttacaatgtgaaagacgatgaccaccctttataaaacatcctcagcccttgtccagccttgcgtggcatgagattggagaagaccttcaagcagtgtcactccttcgaacaaagagtgggggtcccacttatctgacagcagcatcctaccaaaatcccagtgacaaaagaatgacacaggcgtgaaaagcagcttcctgtcctggaaaaaccaagtaattttgtacctgatcaggtcaacatgagtaaactcgtcaagataattagaaggcccttaaagctcgatagtaatcaagccctcttcctagtggtgagcagagacagcttgcactacttcctgaagagtccaactgaattatattgggtaactttcattcaccaggtatccagttttgaatgcgatcacaacaaaagatctctttctgaattgtatagattgtgctatatgttaccacacttttgtttatacatttaatttagtgattacattaaaaactcagcttagtata

SEQ ID NO: 62869 - DNA, 609 bp, Homo sapiens
gacatgtaccaagaaatatcttcaggtgtggagataagggacggtttatctattccctcttttcctttcattctttggaatggaatgactcttctaaagaacacgctgtaggaagtctgaatatatccaacctcttgcctcaaccagaaacgaaacttacaatgtgaaagacgatgaccaccctttataaaacatcctcagcccttgtccagccttgcgtggcatgagattggagaagaccttcaagcagtgtcactccttcgaacaaagagtgggggtcccacttatctgacagcagcatcctaccaaaatcccagtgacaaaagaatgacacaggcgtgaaaagcagcttcctgtcctggaaaaaccaagtaattttgtacctgatcaggtcaacatgagtaaactcgtcaagataattagaaggcccttaaagctcgatagtaatcaagccctcttcctagtggtgagcagagacagcttgggaaaagcaacataactgtacatgaaccctcaactgatcattaaagggattcccatcacctactctcctcgctgcaggtgtctgtccacatgtctcacttttgaaatggactatacttttacatt

SEQ ID NO: 62870 - DNA, 558 bp, Homo sapiens
  misc_feature (517)..(517): n is a, c, g, or t
  misc_feature (541)..(541): n is a, c, g, or t
  misc_feature (552)..(552): n is a, c, g, or t
ggaggctggtactaatcagggagggtctcagacccactggaagaagtgtaggcttttttttcctggaggtagtagaaatccatgaattattctgaggcagaagtgatatgaaatctatattttattatgatggtttttagactcatttagaaattgggcaaatggaaagtgtagtgaccttgacagaacattataacatattaattaaaaatttaaattcataaattcataaatgtaggccaaatcaagataccatattttagattttgatatactatcaacaaacaataacagatttgctcatcgtcacttattcgactaatatttgaatgctttttatgtgcattatattctagatactagggatacaatagtgaaaaaaacaaacagctcctgtccttctggaacaacggaaatacatgaaaaaagactgttttgcatttgttttacttagggaggaccagatcaacaggcttattagaagaatgaactaaggtgtctaccatgattatttttntaagctggttggttaataaacagnacctgctctcnaattga

SEQ ID NO: 62871 - DNA, 401 bp, Homo sapiens
atttataccacaaataagaatagactatactaacatgttcctccttgagaaacaagcatttcctactaaaaataaaaaggcaaccaacactaatatagcagggcagtcttctacctctgaaataagtttgtcatttagaggaatagtctttaattatcagaatatccagaaatagacaatgtgtgaaaatggagaccaaagcaatccttgagtcttaatgaaagcgcagcctctgagggaagccagggcagaattttctcattatcgctccgcttcatctttatcttccacattccaaaccctaagagatattcttattgcgggaaaaacaacaaggctcccttgcccttgctgagttttcatacactgctacaaaagcagaactatttagaaggagttaa

SEQ ID NO: 62872 - DNA, 720 bp, Homo sapiens
tgttaaaccaaggtacctttggccaaggctgtgaaattctgtatgattcattcaagaacacttgaaggccagtgcacaaaaagatgtcttaatctcctgaacatcctagtgtccaggctcaactctggcaccaagaacagagttctacacaactttttcccagcatcaagaaaatccttgttccggctttaccaagtttacgctgggagcagtcagcttctgagtgacagtcaagtggagcatctctgaactcccagttattccgtgtttttagtgtttttgtatagttaaactttgtggctggttcagtcaatgtttttttcttgtgaatcagtataccaaggaagatttttgaatatcatctgcttaaaagtggtagatataaaaataaagaggaaattcagtagtgttagctttctaagtaagtgtgaagttgtcatatatgctatcttttttttataaaaagtaatatgaaacaattttaatatataacaatattatgatagtttgtgtgatgatttgaagtactgagtttaaagtcttcaggacttaatgtttcatgtgctacttgtaattagtgtgtataaaataaaggaacacctgttttcctaatagttttattctagtactctatgttgttggaatttcccccatttttgtatattttgtaaataaatgcatattttttttcttgacagatgcagattttaaaaaactgat

SEQ ID NO: 62873 - DNA, 461 bp, Homo sapiens
tgtagagagagagagattaaggatgtgcatggcagaatccagatctaaatctgggtctcactgattcaaagcacacagccctaaccactataaaatattgccacccacatggagaaatcatagaaataatcctcatctcaaatccagctggatcactggaaatttccccagaaatcctcttcctgatgctctttctccagaggagttagagatgttcttatttattaataacagttttcttgaaagccacacagggtagtatgttattggtcttatttatttgctgaggaactagaaagagaaaaacatagtaaggtcagtgatgaagtctatcaatgaatcactcaaatccccattcactttcctaatttaggtatcttcttactaagaattatttataccacatttaaaatatgtgcatataaaaatatactttaaatttgattttagttctaaattct

SEQ ID NO: 62874 - DNA, 226 bp, Homo sapiens
ttaatacatttacatttaaagtaattattgagaaggaaggacttttgccatttttgctatttgtatagcttttattgtccctcagtccttcatttctgccttcttttgtatgtagttgatttttctaatgtagttaactgatttgattcccttctgctgtcttcctttcctttcctttctgcttcttcctttcccctttcatctttctcctttttcttttcccttt

SEQ ID NO: 62875 - DNA, 372 bp, Homo sapiens
atgacttgtataatatttacaatttagactaaattttgtcttgctttgtatgctgactctcctgaatagaacttatttttttaaatagatataaaccagcaggtcaggcaagtaagaatggttgttttagttggtggggaattacataagggaaatcttgtgactctaggggatagaaattgtggattttttggtcctgatgaatttttacaatggcctaatcacacaggtgttggtcaatcaacacttcttgtaaatgtgatctgtcattttagctatggtttaaaaagcatatggtttaatagttacagtattttagaagcgaaccatgatatcatgataagatgtaaagaattaaaagagatactggcc

SEQ ID NO: 62876 - DNA, 1490 bp, Homo sapiens
ggggaaagtagcttggctattcccgacagatggacagttggtagaacggaccctcccacaggccctcatccccttgtgcagctgctggcctcgtagacaatcggctgtctccccagaagagggaaagaattgtgcagatgagaaagaggctctcagcgggagggaggcaggcgggcttgattgacacaggagagggctggctttttggagggctcttagcaacggccctggttgagccccctcagccatgagaaaatcaaatcaatgtgccattcttccaggcgcgaggcagcagcggctgcagttcaacatgaaaggaggcttcctccctgcctgctaattacctgctcttcccgatctcatcgtttctgcctttgcaaagtgctactgagaagggggaagaaacgtccgccacccatcccccttgctgcctgggggttcagacttgattgttgcccagccatatcccagccccgtctgcagggagccggaggctgctgctgctgctattgtgtggatgccgcgcgtgtcttctcttctttccagagatggctaacaggggcccgagctatggcttaagccgagaggtgcaggagaagatcgagcagaagtatgatgcggacctggagaacaagctggtggactggatcatcctgcagtgcgccgaggacatagagcacccgccccccggcagggcccattttcagaaatggttaatggacgggacggtcctgtgcaagctgataaatagtttatacccaccaggacaagagcccatacccaagatctcagagtcaaagatggcttttaagcagatggagcaaatctcccagttcctaaaagctgcggagacctatggtgtcagaaccaccgacatctttcagacggtggatctatgggaagggaaggacatggcagctgtgcagaggaccctgatggctttaggcagcgttgcagtcaccaaggatgatggctgctatcggggagagccatcctggtttcacaggaaagcccagcagaatcggagaggcttttccgaggagcagcttcgccagggacagaacgtaataggcctgcagatgggcagcaacaagggagcctcccaggcgggcatgacagggtacgggatgcccaggcagatcatgtaggacgcggcatcctgcccctggtagagaggacgaatgttccacaccatggtctctacgaaaaagaaatagttagtcaccttctgaccttctcctctttctcaaagccttctgtccctggtttttgcaagtgctgcatttccgccgagaatccgcgttgcctactgctgccacctcctgttcatttagaactatgcaaagactccgcttccgttttcctgagctcctcgggccccagagtctctgtttgattatttatttatttatttatttatttgccaaaaattctcctcttcaacttatagaatgcacctaataaagtaattagtcttgtgtcaaaaaaaa

SEQ ID NO: 62877 - DNA, 1569 bp, Homo sapiens
ggggaaagtagcttggctattcccgacagatggacagttggtagaacggaccctcccacaggccctcatccccttgtgcagctgctggcctcgtagacaatcggctgtctccccagaagagggaaagaattgtgcagatgagaaagaggctctcagcgggagggaggcaggcgggcttgattgacacaggagagggctggctttttggagggctcttagcaacggccctggttgagccccctcagccatgagaaaatcaaatcaatgtgccattcttccaggcgcgaggcagcagcggctgcagttcaacatgaaaggaggcttcctccctgcctgctaattacctgctcttcccgatctcatcgtttctgcctttgcaaagtgctactgagaagggggaagaaacgtccgccacccatcccccttgctgcctgggggttcagacttgattgtgaaaccccattggcttcattggctccttgatttaaaccacgcccggctttctgccctctttgctgctgctgggccaggttgcccagccatatcccagccccgtctgcagggagccggaggctgctgctgctgctattgtgtggatgccgcgcgtgtcttctcttctttccagagatggctaacaggggcccgagctatggcttaagccgagaggtgcaggagaagatcgagcagaagtatgatgcggacctggagaacaagctggtggactggatcatcctgcagtgcgccgaggacatagagcacccgccccccggcagggcccattttcagaaatggttaatggacgggacggtcctgtgcaagctgataaatagtttatacccaccaggacaagagcccatacccaagatctcagagtcaaagatggcttttaagcagatggagcaaatctcccagttcctaaaagctgcggagacctatggtgtcagaaccaccgacatctttcagacggtggatctatgggaagggaaggacatggcagctgtgcagaggaccctgatggctttaggcagcgttgcagtcaccaaggatgatggctgctatcggggagagccatcctggtttcacaggaaagcccagcagaatcggagaggcttttccgaggagcagcttcgccagggacagaacgtaataggcctgcagatgggcagcaacaagggagcctcccaggcgggcatgacagggtacgggatgcccaggcagatcatgtaggacgcggcatcctgcccctggtagagaggacgaatgttccacaccatggtctctacgaaaaagaaatagttagtcaccttctgaccttctcctctttctcaaagccttctgtccctggtttttgcaagtgctgcatttccgccgagaatccgcgttgcctactgctgccacctcctgttcatttagaactatgcaaagactccgcttccgttttcctgagctcctcgggccccagagtctctgtttgattatttatttatttatttatttatttgccaaaaattctcctcttcaacttatagaatgcacctaataaagtaattagtcttgtgtcaaaaaaaa

SEQ ID NO: 62878 - DNA, 1150 bp, Homo sapiens
gtgagccggggtgaatcggacgaggaggtgaagtgaaaccccattggcttcattggctccttgatttaaaccacgcccggctttctgccctctttgctgctgctgggccaggttgcccagccatatcccagccccgtctgcagggagccggaggctgctgctgctgctattgtgtggatgccgcgcgtgtcttctcttctttccagagatggctaacaggggcccgagctatggcttaagccgagaggtgcaggagaagatcgagcagaagtatgatgcggacctggagaacaagctggtggactggatcatcctgcagtgcgccgaggacatagagcacccgccccccggcagggcccattttcagaaatggttaatggacgggacggtcctgtgcaagctgataaatagtttatacccaccaggacaagagcccatacccaagatctcagagtcaaagatggcttttaagcagatggagcaaatctcccagttcctaaaagctgcggagacctatggtgtcagaaccaccgacatctttcagacggtggatctatgggaagggaaggacatggcagctgtgcagaggaccctgatggctttaggcagcgttgcagtcaccaaggatgatggctgctatcggggagagccatcctggtttcacaggaaagcccagcagaatcggagaggcttttccgaggagcagcttcgccagggacagaacgtaataggcctgcagatgggcagcaacaagggagcctcccaggcgggcatgacagggtacgggatgcccaggcagatcatgtaggacgcggcatcctgcccctggtagagaggacgaatgttccacaccatggtctctacgaaaaagaaatagttagtcaccttctgaccttctcctctttctcaaagccttctgtccctggtttttgcaagtgctgcatttccgccgagaatccgcgttgcctactgctgccacctcctgttcatttagaactatgcaaagactccgcttccgttttcctgagctcctcgggccccagagtctctgtttgattatttatttatttatttatttatttgccaaaaattctcctcttcaacttatagaatgcacctaataaagtaattagtcttgtgtcaaaaaaaa

SEQ ID NO: 62879 - DNA, 1136 bp, Homo sapiens
ggggaaagtagcttggctattcccgacagatggacagttggtagaacggaccctcccacaggccctcatccccttgtgcagctgctggcctcgtagacaatcggctgtctccccagaagagggaaagaattgtgcagatgagaaagaggctctcagcgggagggaggcaggcgggcttgattgacacaggagagggctggctttttggagggctcttagcaacggccctggttgagccccctcagccatgagaaaatcaaatcaatgtgccattcttccaggcgcgaggcagcagcggctgcagttcaacatgaaaggaggcttcctccctgcctgctaattacctgctcttcccgatctcatcgtttctgcctttgcaaagtgctactgagaagggggaagaaacgtccgccacccatcccccttgctgcctgggggttcagacttgattagatggctaacaggggcccgagctatggcttaagccgagaggtgcaggagaagatcgagcagaagtatgatgcggacctggagaacaagctggtggactggatcatcctgcagtgcgccgaggacatagagcacccgccccccggcagggcccattttcagaaatggttaatggacgggacggtcctgtgcaagctgataaatagtttatacccaccaggacaagagcccatacccaagatctcagagtcaaagatggcttttaagcagatggagcaaatctcccagttcctaaaagctgcggagacctatggtgtcagaaccaccgacatctttcagacggtggatctatgggaagggaaggacatggcagctgtgcagaggaccctgatggctttaggcagcgttgcagtcaccaaggatgatggctgctatcggggagagccatcctggtttcacaggtttttgcaagtgctgcatttccgccgagaatccgcgttgcctactgctgccacctcctgttcatttagaactatgcaaagactccgcttccgttttcctgagctcctcgggccccagagtctctgtttgattatttatttatttatttatttatttgccaaaaattctcctcttcaacttatagaatgcacctaataaagtaattagtcttgtgtcaaaaaaaa

SEQ ID NO: 62880 - DNA, 1039 bp, Homo sapiens
ggggaaagtagcttggctattcccgacagatggacagttggtagaacggaccctcccacaggccctcatccccttgtgcagctgctggcctcgtagacaatcggctgtctccccagaagagggaaagaattgtgcagatgagaaagaggctctcagcgggagggaggcaggcgggcttgattgacacaggagagggctggctttttggagggctcttagcaacggccctggttgagccccctcagccatgagaaaatcaaatcaatgtgccattcttccaggcgcgaggcagcagcggctgcagttcaacatgaaaggaggcttcctccctgcctgctaattacctgctcttcccgatctcatcgtttctgcctttgcaaagtgctactgagaagggggaagaaacgtccgccacccatcccccttgctgcctgggggttcagacttgattgtgaaaccccattggcttcattggctccttgatttaaaccacgcccggctttctgccctctttgctgctgctgggccaggttgcccagccatatcccagccccgtctgcagggagccggaggctgctgctgctgctattgtgtggatgccgcgcgtgtcttctcttctttccagagatggctaacaggggcccgagctatggcttaagccgagaggtgcaggagaagatcgagcagaagtatgatgcggacctggagaacaagctggtggactggatcatcctgcagtgcgccgaggacatagagcacccgccccccggcagggcccattttcagaaatggttaatggacgggacggtcctgtgcaagctgataaatagtttatacccaccaggacaagagcccatacccaagatctcagagtcaaagatggcttttaagcagatggagcaaatctcccagttcctaaaagctgcggagacctatggtgtcagaaccaccgacatctttcagacggtggatctatgggaagggaagacatggccagctgtgcatagacctgatgctgtcggctatcgggtaagctcct

SEQ ID NO: 62881 - DNA, 1395 bp, Homo sapiens
ggggaaagtagcttggctattcccgacagatggacagttggtagaacggaccctcccacaggccctcatccccttgtgcagctgctggcctcgtagacaatcggctgtctccccagaagagggaaagaattgtgcagatgagaaagaggctctcagcgggagggaggcaggcgggcttgattgacacaggagagggctggctttttggagggctcttagcaacggccctggttgagccccctcagccatgagaaaatcaaatcaatgtgccattcttccaggcgcgaggcagcagcggctgcagttcaacatgaaaggaggcttcctccctgcctgctaattacctgctcttcccgatctcatcgtttctgcctttgcaaagtgctactgagaagggggaagaaacgtccgccacccatcccccttgctgcctgggggttcagacttgattagatggctaacaggggcccgagctatggcttaagccgagaggtgcaggagaagatcgagcagaagtatgatgcggacctggagaacaagctggtggactggatcatcctgcagtgcgccgaggacatagagcacccgccccccggcagggcccattttcagaaatggttaatggacgggacggtcctgtgcaagctgataaatagtttatacccaccaggacaagagcccatacccaagatctcagagtcaaagatggcttttaagcagatggagcaaatctcccagttcctaaaagctgcggagacctatggtgtcagaaccaccgacatctttcagacggtggatctatgggaagggaaggacatggcagctgtgcagaggaccctgatggctttaggcagcgttgcagtcaccaaggatgatggctgctatcggggagagccatcctggtttcacaggaaagcccagcagaatcggagaggcttttccgaggagcagcttcgccagggacagaacgtaataggcctgcagatgggcagcaacaagggagcctcccaggcgggcatgacagggtacgggatgcccaggcagatcatgtaggacgcggcatcctgcccctggtagagaggacgaatgttccacaccatggtctctacgaaaaagaaatagttagtcaccttctgaccttctcctctttctcaaagccttctgtccctggtttttgcaagtgctgcatttccgccgagaatccgcgttgcctactgctgccacctcctgttcatttagaactatgcaaagactccgcttccgttttcctgagctcctcgggccccagagtctctgtttgattatttatttatttatttatttatttgccaaaaattctcctcttcaacttatagaatgcacctaataaagtaattagtcttgtgtcaaaaaaaa

SEQ ID NO: 62882 - DNA, 865 bp, Homo sapiens
ggggaaagtagcttggctattcccgacagatggacagttggtagaacggaccctcccacaggccctcatccccttgtgcagctgctggcctcgtagacaatcggctgtctccccagaagagggaaagaattgtgcagatgagaaagaggctctcagcgggagggaggcaggcgggcttgattgacacaggagagggctggctttttggagggctcttagcaacggccctggttgagccccctcagccatgagaaaatcaaatcaatgtgccattcttccaggcgcgaggcagcagcggctgcagttcaacatgaaaggaggcttcctccctgcctgctaattacctgctcttcccgatctcatcgtttctgcctttgcaaagtgctactgagaagggggaagaaacgtccgccacccatcccccttgctgcctgggggttcagacttgattagatggctaacaggggcccgagctatggcttaagccgagaggtgcaggagaagatcgagcagaagtatgatgcggacctggagaacaagctggtggactggatcatcctgcagtgcgccgaggacatagagcacccgccccccggcagggcccattttcagaaatggttaatggacgggacggtcctgtgcaagctgataaatagtttatacccaccaggacaagagcccatacccaagatctcagagtcaaagatggcttttaagcagatggagcaaatctcccagttcctaaaagctgcggagacctatggtgtcagaaccaccgacatctttcagacggtggatctatgggaagggaagacatggccagctgtgcatagacctgatgctgtcggctatcgggtaagctcct

SEQ ID NO: 62883 - DNA, 1704 bp, Homo sapiens
ggggaaagtagcttggctattcccgacagatggacagttggtagaacggaccctcccacaggccctcatccccttgtgcagctgctggcctcgtagacaatcggctgtctccccagaagagggaaagaattgtgcagatgagaaagaggctctcagcgggagggaggcaggcgggcttgattgacacaggagagggctggctttttggagggctcttagcaacggccctggttgagccccctcagccatgagaaaatcaaatcaatgtgccattcttccaggcgcgaggcagcagcggctgcagttcaacatgaaaggaggcttcctccctgcctgctaattacctgctcttcccgatctcatcgtttctgcctttgcaaagtgctactgagaagggggaagaaacgtccgccacccatcccccttgctgcctgggggttcagacttgattgtgagtccgtgttatatcatctggtctcattgataggcgggatagggagggggattccagcccccctggaccggccggaggtttattctagagttactggcgggtagctgtgcttttctttcccgtttgtaggtggtgaaaccccattggcttcattggctccttgatttaaaccacgcccggctttctgccctctttgctgctgctgggccaggttgcccagccatatcccagccccgtctgcagggagccggaggctgctgctgctgctattgtgtggatgccgcgcgtgtcttctcttctttccagagatggctaacaggggcccgagctatggcttaagccgagaggtgcaggagaagatcgagcagaagtatgatgcggacctggagaacaagctggtggactggatcatcctgcagtgcgccgaggacatagagcacccgccccccggcagggcccattttcagaaatggttaatggacgggacggtcctgtgcaagctgataaatagtttatacccaccaggacaagagcccatacccaagatctcagagtcaaagatggcttttaagcagatggagcaaatctcccagttcctaaaagctgcggagacctatggtgtcagaaccaccgacatctttcagacggtggatctatgggaagggaaggacatggcagctgtgcagaggaccctgatggctttaggcagcgttgcagtcaccaaggatgatggctgctatcggggagagccatcctggtttcacaggaaagcccagcagaatcggagaggcttttccgaggagcagcttcgccagggacagaacgtaataggcctgcagatgggcagcaacaagggagcctcccaggcgggcatgacagggtacgggatgcccaggcagatcatgtaggacgcggcatcctgcccctggtagagaggacgaatgttccacaccatggtctctacgaaaaagaaatagttagtcaccttctgaccttctcctctttctcaaagccttctgtccctggtttttgcaagtgctgcatttccgccgagaatccgcgttgcctactgctgccacctcctgttcatttagaactatgcaaagactccgcttccgttttcctgagctcctcgggccccagagtctctgtttgattatttatttatttatttatttatttgccaaaaattctcctcttcaacttatagaatgcacctaataaagtaattagtcttgtgtcaaaaaaaa

SEQ ID NO: 62884 - DNA, 1319 bp, Homo sapiens
ggggaaagtagcttggctattcccgacagatggacagttggtagaacggaccctcccacaggccctcatccccttgtgcagctgctggcctcgtagacaatcggctgtctccccagaagagggaaagaattgtgcagatgagaaagaggctctcagcgggagggaggcaggcgggcttgattgacacaggagagggctggctttttggagggctcttagcaacggccctggttgagccccctcagccatgagaaaatcaaatcaatgtgccattcttccaggcgcgaggcagcagcggctgcagttcaacatgaaaggaggcttcctccctgcctgctaattacctgctcttcccgatctcatcgtttctgcctttgcaaagtgctactgagaagggggaagaaacgtccgccacccatcccccttgctgcctgggggttcagacttgattagatggctaacaggggcccgagctatggcttaagcagtgcgccgaggacatagagcacccgccccccggcagggcccattttcagaaatggttaatggacgggacggtcctgtgcaagctgataaatagtttatacccaccaggacaagagcccatacccaagatctcagagtcaaagatggcttttaagcagatggagcaaatctcccagttcctaaaagctgcggagacctatggtgtcagaaccaccgacatctttcagacggtggatctatgggaagggaaggacatggcagctgtgcagaggaccctgatggctttaggcagcgttgcagtcaccaaggatgatggctgctatcggggagagccatcctggtttcacaggaaagcccagcagaatcggagaggcttttccgaggagcagcttcgccagggacagaacgtaataggcctgcagatgggcagcaacaagggagcctcccaggcgggcatgacagggtacgggatgcccaggcagatcatgtaggacgcggcatcctgcccctggtagagaggacgaatgttccacaccatggtctctacgaaaaagaaatagttagtcaccttctgaccttctcctctttctcaaagccttctgtccctggtttttgcaagtgctgcatttccgccgagaatccgcgttgcctactgctgccacctcctgttcatttagaactatgcaaagactccgcttccgttttcctgagctcctcgggccccagagtctctgtttgattatttatttatttatttatttatttgccaaaaattctcctcttcaacttatagaatgcacctaataaagtaattagtcttgtgtcaaaaaaaa

SEQ ID NO: 62885 - DNA, 686 bp, Homo sapiens
acaaggctgagaaaacatcaagaaagaggagaagctggggaaaagccatttcaaaccccttctaggagtgaagctgcatttgaagaggatggtaagacacgtgggtttagatatgattagtcaagccttcagctggggttcttagacagtcatgcttatttctaatcttttatttctaatttaatttgacttataactaaccccagtgtttttgttttatttcagcttcctttttcttcatccaagaaattctttaaaaatgtgaccattagttatcccgcccttttaggccaaattttttcagttcttcttgagagtggattataccatgctttctgtctggaaaatctcctgatagcaaaaacttactataatattcccccttgaaagtattcgggaaatccaggaaagctatgaaagacaagaaactagtcttaaaaaaatggttctgttttttacaaaattcaactgataaataagtatatgtgacctgtttttagataacgcactgtattataaaattgccatttttatgggtccaaatagaatggcagctactttaagtggctcaacctggtaacttatcagacattttggatttatatacactgttcaaataacaacatgtcaaatataactgtaaaataaatttacaatttttaatttcaaccgctgagcagaaaaaa

SEQ ID NO: 62886 - DNA, 5837 bp, Homo sapiens
  misc_feature (1)..(2): n is a, c, g, or t
nncgagtcttccttttcctaagttcactgtcaattcaaatcgcttaaggaagcaatctattaatgagacacctttgggaagtttgtcaaaggatgatggagctagaggggctcatgggaagaaactcaatttctctgaaagccatcttgtgattataaccaaagaggaagagcaaaaggcagaccccaaagaggtctctaattctaaaaccaaaacaatatttcctaaagtattgggtaaaagccaaagtaaacacatttccaggaatagaagtgagatgtcttcctcttcacttgctccacatagagtgccactgtcccaaactaaccatgctttaactggagggctagagccagcaaaaatcaacataactgccaaagccccctctacagaatacaaccagagtcatataaaagcccttttacctgaagacagtggaacgcaccaggtgttaagaattgatgtgacactttctccaagggaccccaaagctccagggcagtttgggcgtcctgtagttgtcccccatggaaaggagaaggaggcagaaagaagatggaaagaaggaaacttcaatgtctaccttagcgatttgatcccagtggatagagccattgaagacaccagacctgctggatgtgcagagcagctagttcacaataacctcccaaccaccagtgtcatcatgtgctttgtggatgaagtgtggtccactctcctgagatctgttcacagtgtcatcaatcgctctcctccacacctcatcaaggagattctgctggtagatgacttcagcaccaaagactatctaaaagataatttggataaatacatgtcccagtttccaaaagttcggattcttcgcctcaaagagagacatggcttaataagggccaggctggcaggagcacagaatgcaacaggtgatgtgttgacatttttagattctcatgtggaatgtaacgttggttggttggaacctcttctggaaagagtttatttaagtagaaagaaagtggcctgtccagtaatcgaagtcatcaatgataaggatatgagttacatgacagtggataactttcaaagaggcatctttgtgtggcccatgaactttggttggagaacaattcctccagatgtcattgcaaaaaacagaattaaagaaactgatacaataaggtgccctgtcatggctggtggattgttttctattgacaaaagttacttttttgaacttggaacatacgaccctggccttgatgtttggggtggggaaaatatggagctctcattcaaggtgtggatgtgtggtggtgaaattgagatcattccctgctcccgagtgggccatatattcagaaatgacaatccatattccttccccaaagaccggatgaagacagtggagcggaacttggtgcgggttgccgaggtctggctggatgagtataaggagctgttctatggccatggagaccacctcatcgaccaagggctagatgttggcaacctcacccagcaaagggagctgcgaaagaaactgaagtgcaaaagtttcaaatggtacttggagaatgtctttcctgacttaagggctcccattgtgagagctagtggtgtgcttattaatgtggctttgggtaaatgcatttccattgaaaacactacagtcattctggaagactgcgatgggagcaaagagcttcaacaatttaattacacctggttaagacttattaaatgtggagaatggtgtatagcccccatccctgataaaggagccgtaaggctgcacccttgtgataacagaaacaaagggctaaaatggctgcataaatcaacatcagtctttcatccagaactggtgaatcacattgtttttgaaaacaatcagcaattattatgcttggaaggaaatttttctcaaaagatcctgaaagtagctgcctgtgacccagtgaagccatatcaaaagtggaaatttgaaaaatattatgaagcctgaagtgtaactgatgtttttatatagtaaacccattaaatactgtgaaaataacactgaacttggaaactatatttctcagcggtagtttaaattttcaattttaataacatttgaatggaagattttttataaatcacaatatttggaataccaaaagatgactcaggaaaacagtccaacattggactgaagtccttcttcggaactgggtggcctttgaattgcctgctttccaccctatgctagacctcatcatgcaaatttccctgtgaaagctaacaggtaactggaaatgaagacagaaggacttgagaaagcatgaggatattcccaatgactatgtttggtaataatcagctcttctggcccacaagtaggaatgatcaatgagaacttaacttagtcctttatttggggattttttcatcaaacaaaaatttcttgagttcttatggctagaagacctcagatgcccacagctgtcacgtttgtgaaatccctccagactacatgcatgcttacctaacagtttgaaatagtattgatctactgctggtaaccctgcttgatggcagcattttgatctaaattacataatggtttttcccaatctgaatcagtggaaaaaaatttaagtgaggaagaagaggccttcaaatgcttatttaattctaggtatgaacactatttcagttcattttgtgcttttaaaactacagttttaaagatttatgataccaataacttcctagattcatgtggattttttttaaggcaatgaaaaaaggctggattataacacactgtagtaatcaaaaatgcatttaagcattgaatgcactctagtgcagggccaagtaagaggagttgaaatgagtaaagcagaaatagagctgctgaaagtttcttttatataaaaataataaaatactactttagatatagtagcattcacagggatgaaatatgcgaaaaatgggttctaaaatatttcaaagggaaaatgaagtgaaggaaacatcatgaaaggggaaaggaatgaggtaaacaagtcttaggaagagagttaagaaaaaattccgctggacttggccaaagaaagaaggggatctagtatctctatgaaggaaaaaagagtaaagccctcagtgtgaacccagtgagaacactgacaaatttgggaaaagttaaatactgatttcatccaaataaagcctctaatcttaagcataccaatactttggcataccagaagacaccttagaaatcaggatagcctttgcattcattttggtaagaaaactgatgctgagaggataaattacctaaaaatcttaaaacccaggcaagttagtcaaagaatcaagattagaattcaggtttccagagacagggctcattctaatgcctcaggtcactggcccgaacaaatctgcttcacagaattccttagaaagagatacacaattctttgctgggattgggtccctggaggacaaccatactatattcttgttaatatgttttttctttttttaaatttaaacttttgttcagttgagatgattgtgaaactaggtatctttcattctgactcctagtttaacatttaattttgactcccaatgagttacgtaaaagcaaaactataactaagaatgggaaaaagaactatttctgcacatttgtaacatatttaagatgttttcttcatataattgaaaactgcagatgagtaagagaatgactaggaaatgagatacagttatatgacacataatgatgttttagtcaacaatgaaccacatatttgacattggtcccaaaagattatattaataatatggtatctttagtgtgcttttctatgtttagacacacaaatactcaccatgatgttacaatagcctacagtgttcaatacagtaacatgcacaagtttgtaacctaggagcaacagggattccatatagcctaggtgtgtagtaggctacctacaccatctaggtttgtgtaagtacactctgatattcacacaatgatgaaattgcctaatgacacatttctcagaatgtatttgtgttattaaatgatgcatgactctaattcttttcaaaacagagccatatggggcaagggggatggggggacgcaagtcagttgtcaaaagactaattgagttactgacaaactgaacatgctaggtgcctcatgtaattcttcatgtaactaaaaaatgttgagaggtttttttcccccgggtatataggctctctttttatccgaaaatagtttccacaaagaagtcaactctgttctgaaaaaaaatgaattgcattttgaatacacttatctttgggtatatcaactaaaggaagttggatttttttccttaacagaaacttctgcagtcctctcagttcacatcctttctgactttaccctgacaaacttattatataaagctatatttaaatctatattgtcaatataacaaaggattgtttttgaacatcacaaatttgttcttggatagaattttatacattgcttttcatcatatatttgctcagttactctaagaagcaaggaactgatcactagttgggaatctatatgggcctaaacttgagtgtattgatttattattacatctactaccaacattttcttaagcatagccttctaaattttttcaggagattagaataaaggtatacatgctactcggtcttctggtaattctagtgataaacctttggatgagacaggtcctaatcagcactgaattcttcaataggaggctgtgttacaggagctacagatttttccctggattagcttaggtcattgcctttactttaaaaaaaaaaaaaaaaagtctatgcatcttgttaccttgaatacaagggtggtcttgataatatttgacagcactaaccaacttaccaagccatctaagtgcttctgagacttttcagtttgcacaatttctttctccttttcaacagttacccagcgcttctgccctactctcttgtaagctgacacagttgttgttggtacaatcttgttctatcaccagcatcaaatttgcttaatactgcttgttgacatcccctcagctgtcattcacagcaaaccaccatgtgccatgatcacaatgtattattagcttcgccacactaatttggaaacattcttttagatattaaaacaccttacttctagtattagtttgggactgcagaggggcaaagataccatttacagtatataggagtccaatattcccaaccaaccttgatttcatgaatggcttgtaattatttctagcaggcactcatgcaatagaataagattgaaacatgccagagagtaccatctttctttgttttaacatctctgattgaattcctatattcagaatacaagaaaaaaaatttaccaaccaggcgcagtggctcacacctgtaatcctagcactttaggaggccaaggtgggtggatcatgaggtcaggagttcaagaccagcctgggcaacatggtgaaaccccgtctctactaaaaatacaaaaattagctgggcatggtggtgggcgcctgtaatcccagctacctgggaggctgaagcaggagaattgcttgtacccgggaggtggaggttgcagtgagctgaaattgcgccactgcactccagcctagacaacagagcaagactctatctcaaaaaataataataataatttttacctcagaagaaagccccaaaatcttggattaaaacaaaaaaatgacattgggtgatgggaaaaaagaaaggaactaatt

SEQ ID NO: 62887 - DNA, 4888 bp, Homo sapiens
ttaagtagatcattattttagatagacaatcgtggaaagttccaagaaaataaactccacaacttctttttgttacttgcttcgtttcccttctttcaacctccactacggaatttagatccagtgaaagttttgtgttttgtaataagaacaaacattttcttatcgaaccaacaatatttgaagctaataatctcaccaataatgtatttttcactggattaaactgctggcaaacagtctatagctccgtttcccttttttcaacctccacaagcagaaatttaaatccagtgaaagttttggttttttgtaataagaagaaatattttcttattgaaacgacaacatttgaagctaatgaaagaatctcaccaataatgtatttttacactggattaaaccgctggcaaatagcctaatgtttaacaattctgtcataaattgtgcggaatgtctacttcctaaattggaaaatgaaataatacaacatggataatttaaaattcatacactgcctattttttttaaagattaaaatggtttacagtaaaaacatggatcaattatttttaaataaaaaggaaaattctgaaaacaactaataatgaaatgaagaataacaattccaaaacacttcagagatgatgtctatatgaagaaaagtattagcttattaatgtggctttgggtaaatgcatttccattgaaaacactacagtcattctggaagactgcgatgggagcaaagagcttcaacaatttaattacacctggttaagacttattaaatgtggagaatggtgtatagcccccatccctgataaaggagccgtaaggctgcacccttgtgataacagaaacaaagggctaaaatggctgcataaatcaacatcagtctttcatccagaactggtgaatcacattgtttttgaaaacaatcagcaattattatgcttggaaggaaatttttctcaaaagatcctgaaagtagctgcctgtgacccagtgaagccatatcaaaagtggaaatttgaaaaatattatgaagcctgaagtgtaactgatgtttttatatagtaaacccattaaatactgtgaaaataacactgaacttggaaactatatttctcagcggtagtttaaattttcaattttaataacatttgaatggaagattttttataaatcacaatatttggaataccaaaagatgactcaggaaaacagtccaacattggactgaagtccttcttcggaactgggtggcctttgaattgcctgctttccaccctatgctagacctcatcatgcaaatttccctgtgaaagctaacaggtaactggaaatgaagacagaaggacttgagaaagcatgaggatattcccaatgactatgtttggtaataatcagctcttctggcccacaagtaggaatgatcaatgagaacttaacttagtcctttatttggggattttttcatcaaacaaaaatttcttgagttcttatggctagaagacctcagatgcccacagctgtcacgtttgtgaaatccctccagactacatgcatgcttacctaacagtttgaaatagtattgatctactgctggtaaccctgcttgatggcagcattttgatctaaattacataatggtttttcccaatctgaatcagtggaaaaaaatttaagtgaggaagaagaggccttcaaatgcttatttaattctaggtatgaacactatttcagttcattttgtgcttttaaaactacagttttaaagatttatgataccaataacttcctagattcatgtggattttttttaaggcaatgaaaaaaggctggattataacacactgtagtaatcaaaaatgcatttaagcattgaatgcactctagtgcagggccaagtaagaggagttgaaatgagtaaagcagaaatagagctgctgaaagtttcttttatataaaaataataaaatactactttagatatagtagcattcacagggatgaaatatgcgaaaaatgggttctaaaatatttcaaagggaaaatgaagtgaaggaaacatcatgaaaggggaaaggaatgaggtaaacaagtcttaggaagagagttaagaaaaaattccgctggacttggccaaagaaagaaggggatctagtatctctatgaaggaaaaaagagtaaagccctcagtgtgaacccagtgagaacactgacaaatttgggaaaagttaaatactgatttcatccaaataaagcctctaatcttaagcataccaatactttggcataccagaagacaccttagaaatcaggatagcctttgcattcattttggtaagaaaactgatgctgagaggataaattacctaaaaatcttaaaacccaggcaagttagtcaaagaatcaagattagaattcaggtttccagagacagggctcattctaatgcctcaggtcactggcccgaacaaatctgcttcacagaattccttagaaagagatacacaattctttgctgggattgggtccctggaggacaaccatactatattcttgttaatatgttttttctttttttaaatttaaacttttgttcagttgagatgattgtgaaactaggtatctttcattctgactcctagtttaacatttaattttgactcccaatgagttacgtaaaagcaaaactataactaagaatgggaaaaagaactatttctgcacatttgtaacatatttaagatgttttcttcatataattgaaaactgcagatgagtaagagaatgactaggaaatgagatacagttatatgacacataatgatgttttagtcaacaatgaaccacatatttgacattggtcccaaaagattatattaataatatggtatctttagtgtgcttttctatgtttagacacacaaatactcaccatgatgttacaatagcctacagtgttcaatacagtaacatgcacaagtttgtaacctaggagcaacagggattccatatagcctaggtgtgtagtaggctacctacaccatctaggtttgtgtaagtacactctgatattcacacaatgatgaaattgcctaatgacacatttctcagaatgtatttgtgttattaaatgatgcatgactctaattcttttcaaaacagagccatatggggcaagggggatggggggacgcaagtcagttgtcaaaagactaattgagttactgacaaactgaacatgctaggtgcctcatgtaattcttcatgtaactaaaaaatgttgagaggtttttttcccccgggtatataggctctctttttatccgaaaatagtttccacaaagaagtcaactctgttctgaaaaaaaatgaattgcattttgaatacacttatctttgggtatatcaactaaaggaagttggatttttttccttaacagaaacttctgcagtcctctcagttcacatcctttctgactttaccctgacaaacttattatataaagctatatttaaatctatattgtcaatataacaaaggattgtttttgaacatcacaaatttgttcttggatagaattttatacattgcttttcatcatatatttgctcagttactctaagaagcaaggaactgatcactagttgggaatctatatgggcctaaacttgagtgtattgatttattattacatctactaccaacattttcttaagcatagccttctaaattttttcaggagattagaataaaggtatacatgctactcggtcttctggtaattctagtgataaacctttggatgagacaggtcctaatcagcactgaattcttcaataggaggctgtgttacaggagctacagatttttccctggattagcttaggtcattgcctttactttaaaaaaaaaaaaaaaaagtctatgcatcttgttaccttgaatacaagggtggtcttgataatatttgacagcactaaccaacttaccaagccatctaagtgcttctgagacttttcagtttgcacaatttctttctccttttcaacagttacccagcgcttctgccctactctcttgtaagctgacacagttgttgttggtacaatcttgttctatcaccagcatcaaatttgcttaatactgcttgttgacatcccctcagctgtcattcacagcaaaccaccatgtgccatgatcacaatgtattattagcttcgccacactaatttggaaacattcttttagatattaaaacaccttacttctagtattagtttgggactgcagaggggcaaagataccatttacagtatataggagtccaatattcccaaccaaccttgatttcatgaatggcttgtaattatttctagcaggcactcatgcaatagaataagattgaaacatgccagagagtaccatctttctttgttttaacatctctgattgaattcctatattcagaatacaagaaaaaaaatttaccaaccaggcgcagtggctcacacctgtaatcctagcactttaggaggccaaggtgggtggatcatgaggtcaggagttcaagaccagcctgggcaacatggtgaaaccccgtctctactaaaaatacaaaaattagctgggcatggtggtgggcgcctgtaatcccagctacctgggaggctgaagcaggagaattgcttgtacccgggaggtggaggttgcagtgagctgaaattgcgccactgcactccagcctagacaacagagcaagactctatctcaaaaaataataataataatttttacctcagaagaaagccccaaaatcttggattaaaacaaaaaaatgacattgggtgatgggaaaaaagaaaggaactaatt

SEQ ID NO: 62888 - DNA, 318 bp, Homo sapiens
tgaacctaatctagctctgccaccatgatccagggatcgcatcacttaagccctatttgtgactccatcccagggcttccctgcatcaggtagctattctgaaaagcctcctacctcccgtacagatgtacagaggaacaactctaaaagtcgagctttcatgagatgcaagtttaaaaaacaaacttttctttttgtaggtgccctgtcatggctggtggattgttttctattgacaaaagttacttttttgaacttggaacatacgaccctggccttgatgtttggggtggggaaaatatggagctctcattcaag

SEQ ID NO: 62889 - DNA, 2050 bp, Homo sapiens
  misc_feature (1)..(2): n is a, c, g, or t
nncgagtcttccttttcctaagttcactgtcaattcaaatcgcttaaggaagcaatctattaatgagacacctttgggaagtttgtcaaaggatgatggagctagaggggctcatgggaagaaactcaatttctctgaaagccatcttgtgattataaccaaagaggaagagcaaaaggcagaccccaaagaggtctctaattctaaaaccaaaacaatatttcctaaagtattgggtaaaagccaaagtaaacacatttccaggaatagaagtgagatgtcttcctcttcacttgctccacatagagtgccactgtcccaaactaaccatgctttaactggagggctagagccagcaaaaatcaacataactgccaaagccccctctacagaatacaaccagagtcatataaaagcccttttacctgaagacagtggaacgcaccaggtgttaagaattgatgtgacactttctccaagggaccccaaagctccagggcagtttgggcgtcctgtagttgtcccccatggaaaggagaaggaggcagaaagaagatggaaagaaggaaacttcaatgtctaccttagcgatttgatcccagtggatagagccattgaagacaccagacctgctggatgtgcagagcagctagttcacaataacctcccaaccaccagtgtcatcatgtgctttgtggatgaagtgtggtccactctcctgagatctgttcacagtgtcatcaatcgctctcctccacacctcatcaaggagattctgctggtagatgacttcagcaccaaagactatctaaaagataatttggataaatacatgtcccagtttccaaaagttcggattcttcgcctcaaagagagacatggcttaataagggccaggctggcaggagcacagaatgcaacaggtgatgtgttgacatttttagattctcatgtggaatgtaacgttggttggttggaacctcttctggaaagagtttatttaagtagaaagaaagtggcctgtccagtaatcgaagtcatcaatgataaggatatgagttacatgacagtggataactttcaaagaggcatctttgtgtggcccatgaactttggttggagaacaattcctccagatgtcattgcaaaaaacagaattaaagaaactgatacaataaggtgccctgtcatggctggtggattgttttctattgacaaaagttacttttttgaacttggaacatacgaccctggccttgatgtttggggtggggaaaatatggagctctcattcaaggtgtggatgtgtggtggtgaaattgagatcattccctgctcccgagtgggccatatattcagaaatgacaatccatattccttccccaaagaccggatgaagacagtggagcggaacttggtgcgggttgccgaggtctggctggatgagtataaggagctgttctatggccatggagaccacctcatcgaccaagggctagatgttggcaacctcacccagcaaagggagctgcgaaagaaactgaagtgcaaaagtttcaaatggtacttggagaatgtctttcctgacttaagggctcccattgtgagagctagtggtgtgcttattaatgtggctttgggtaaatgcatttccattgaaaacactacagtcattctggaagactgcgatgggagcaaagagcttcaacaatttaattacacctggttaagacttattaaatgtggagaatggtgtatagcccccatccctgataaaggagccgtaaggctgcacccttgtgataacagaaacaaagggctaaaatggctgcataaatcaacatcagtctttcatccagaactggtgaatcacattgtttttgaaaacaatcagcaattattatgcttggaaggaaatttttctcaaaagatcctgaaagtagctgcctgtgacccagtgaagccatatcaaaagtggaaatttgaaaaatattatgaagcctgaagtgtaactgatgtttttatatagtaaacccattaaatactgtga

SEQ ID NO: 62890 - DNA, 2082 bp, Homo sapiens
  misc_feature (1)..(2): n is a, c, g, or t
nncgagtcttccttttcctaagttcactgtcaattcaaatcgcttaaggaagcaatctattaatgagacacctttgggaagtttgtcaaaggatgatggagctagaggggctcatgggaagaaactcaatttctctgaaagccatcttgtgattataaccaaagaggaagagcaaaaggcagaccccaaagaggtctctaattctaaaaccaaaacaatatttcctaaagtattgggtaaaagccaaagtaaacacatttccaggaatagaagtgagatgtcttcctcttcacttgctccacatagagtgccactgtcccaaactaaccatgctttaactggagggctagagccagcaaaaatcaacataactgccaaagccccctctacagaatacaaccagagtcatataaaagcccttttacctgaagacagtggaacgcaccaggtgttaagaattgatgtgacactttctccaagggaccccaaagctccagggcagtttgggcgtcctgtagttgtcccccatggaaaggagaaggaggcagaaagaagatggaaagaaggaaacttcaatgtctaccttagcgatttgatcccagtggatagagccattgaagacaccagacctgctggatgtgcagagcagctagttcacaataacctcccaaccaccagtgtcatcatgtgctttgtggatgaagtgtggtccactctcctgagatctgttcacagtgtcatcaatcgctctcctccacacctcatcaaggagattctgctggtagatgacttcagcaccaaagactatctaaaagataatttggataaatacatgtcccagtttccaaaagttcggattcttcgcctcaaagagagacatggcttaataagggccaggctggcaggagcacagaatgcaacaggtgatgtgttgacatttttagattctcatgtggaatgtaacgttggttggttggaacctcttctggaaagagtttatttaagtagaaagaaagtggcctgtccagtaatcgaagtcatcaatgataaggatatgagttacatgacagtggataactttcaaagaggcatctttgtgtggcccatgaactttggttggagaacaattcctccagatgtcattgcaaaaaacagaattaaagaaactgatacaataaggtgccctgtcatggctggtggattgttttctattgacaaaagttacttttttgaacttggaacatacgaccctggccttgatgtttggggtggggaaaatatggagctctcattcaaggtgtggatgtgtggtggtgaaattgagatcattccctgctcccgagtgggccatatattcagaaatgacaatccatattccttccccaaagaccggatgaagacagtggagcggaacttggtgcgggttgccgaggtctggctggatgagtataaggagctgttctatggccatggagaccacctcatcgaccaagggctagatgttggcaacctcacccagcaaagggagctgcgaaagaaactgaagtgcaaaagtttcaaatggtacttggagaatgtctttcctgacttaagggctcccattgtgagagctagtggtgtgcttcctttttcttcatccaagaaattctttaaaaatgtgaccattagttatcccgcccttttaggccaaattttttcagttcttcttgagagtggattataccatgctttctgtctggaaaatctcctgatagcaaaaacttactataatattcccccttgaaagtattcgggaaatccaggaaagctatgaaagacaagaaactagtcttaaaaaaatggttctgttttttacaaaattcaactgataaataagtatatgtgacctgtttttagataacgcactgtattataaaattgccatttttatgggtccaaatagaatggcagctactttaagtggctcaacctggtaacttatcagacattttggatttatatacactgttcaaataacaacatgtcaaatataactgtaaaataaatttacaatttttaatttcaaccgctgagcagaaaaaa

SEQ ID NO: 62891 - DNA, 1811 bp, Homo sapiens
agaaaggaacacagtaaactgaattgatccgtttagaagtttacaatgaagtttcttctaatactgctcctgcaggccactgcttctggagctcttcccctgaacagctctacaagcctggaaaaaaataatgtgctatttggtgagagatacttagaaaaattttatggccttgagataaacaaacttccagtgacaaaaatgaaatatagtggaaacttaatgaaggaaaaaatccaagaaatgcagcacttcttgggtctgaaagtgaccgggcaactggacacatctaccctggagatgatgcacgcacctcgatgtggagtccccgatgtccatcatttcagggaaatgccaggggggcccgtatggaggaaacattatatcacctacagaatcaataattacacacctgacatgaaccgtgaggatgttgactacgcaatccggaaagctttccaagtatggagtaatgttacccccttgaaattcagcaagattaacacaggcatggctgacattttggtggtttttgcccgtggagctcatggagacttccatgcttttgatggcaaaggtggaatcctagcccatgcttttggacctggatctggcattggaggggatgcacatttcgatgaggacgaattctggactacacattcaggaggcacaaacttgttcctcactgctgttcacgagattggccattccttaggtcttggccattctagtgatccaaaggccgtaatgttccccacctacaaatatgttgacatcaacacatttcgcctctctgctgatgacatacgtggcattcagtccctgtatggagacccaaaagagaaccaacgcttgccaaatcctgacaattcagaaccagctctctgtgaccccaatttgagttttgatgctgtcactaccgtgggaaataagatctttttcttcaaagacaggttcttctggctgaaggtttctgagagaccaaagaccagtgttaatttaatttcttccttatggccaaccttgccatctggcattgaagctgcttatgaaattgaagccagaaatcaagtttttctttttaaagatgacaaatactggttaattagcagtttaagaccagagccaaattatcccaagagcatacattcttttggttttcctaactttgtgaaaaaaattgatgcagctgtttttaacccacgtttttataggacctacttctttgtagataaccagtattggaggtatgatgaaaggagacagatgatggaccctggttatcccaaactgattaccaagaacttccaaggaatcgggcctaaaattgatgcagtcttctattctaaaaacaaatactactatttcttccaaggatctaaccaatttgaatatgacttcctactccaacgtatcaccaaaacactgaaaagcaatagctggtttggttgttagaaatggtgtaattaatggtttttgttagttcacttcagcttaataagtatttattgcatatttgctatgtcctcagtgtaccactacttagagatatgtatcataaaaataaaatctgtaaaccataggtaatgattatataaaatacataatatttttcaattttgaaaactctaattgtccattcttgcttgactctactattaagtttgaaaatagttaccttcaaagcaagataattctatttgaagcatgctctgtaagttgcttcctaacatccttggactgagaaattatacttacttctggcataactaaaattaagtatatatattttggctcaaataaaattg

SEQ ID NO: 62892 - DNA, 1757 bp, Homo sapiens
agaaaggaacacagtaaactgaattgatccgtttagaagtttacaatgaagtttcttctaatactgctcctgcaggccactgcttctggagctcttcccctgaacagctctacaagcctggaaaaaaataatgtgctatttggtgagagatacttagaaaaattttatggccttgagataaacaaacttccagtgacaaaaatgaaatatagtggaaacttaatgaaggaaacatctaccctggagatgatgcacgcacctcgatgtggagtccccgatgtccatcatttcagggaaatgccaggggggcccgtatggaggaaacattatatcacctacagaatcaataattacacacctgacatgaaccgtgaggatgttgactacgcaatccggaaagctttccaagtatggagtaatgttacccccttgaaattcagcaagattaacacaggcatggctgacattttggtggtttttgcccgtggagctcatggagacttccatgcttttgatggcaaaggtggaatcctagcccatgcttttggacctggatctggcattggaggggatgcacatttcgatgaggacgaattctggactacacattcaggaggcacaaacttgttcctcactgctgttcacgagattggccattccttaggtcttggccattctagtgatccaaaggccgtaatgttccccacctacaaatatgttgacatcaacacatttcgcctctctgctgatgacatacgtggcattcagtccctgtatggagacccaaaagagaaccaacgcttgccaaatcctgacaattcagaaccagctctctgtgaccccaatttgagttttgatgctgtcactaccgtgggaaataagatctttttcttcaaagacaggttcttctggctgaaggtttctgagagaccaaagaccagtgttaatttaatttcttccttatggccaaccttgccatctggcattgaagctgcttatgaaattgaagccagaaatcaagtttttctttttaaagatgacaaatactggttaattagcagtttaagaccagagccaaattatcccaagagcatacattcttttggttttcctaactttgtgaaaaaaattgatgcagctgtttttaacccacgtttttataggacctacttctttgtagataaccagtattggaggtatgatgaaaggagacagatgatggaccctggttatcccaaactgattaccaagaacttccaaggaatcgggcctaaaattgatgcagtcttctattctaaaaacaaatactactatttcttccaaggatctaaccaatttgaatatgacttcctactccaacgtatcaccaaaacactgaaaagcaatagctggtttggttgttagaaatggtgtaattaatggtttttgttagttcacttcagcttaataagtatttattgcatatttgctatgtcctcagtgtaccactacttagagatatgtatcataaaaataaaatctgtaaaccataggtaatgattatataaaatacataatatttttcaattttgaaaactctaattgtccattcttgcttgactctactattaagtttgaaaatagttaccttcaaagcaagataattctatttgaagcatgctctgtaagttgcttcctaacatccttggactgagaaattatacttacttctggcataactaaaattaagtatatatattttggctcaaataaaattg

SEQ ID NO: 62893 - DNA, 552 bp, Homo sapiens
tggcaactgtaaactgacacagcacactgttgggcgtgccttagcgggaggtgcttctgccacgcacctgttttagctagtccctcaatttggtctggtgtcagagcaccgcctccagagtccagtcccacttcctaccccaggttgaatgatagtcctccaaaagataagtctactgcctaacacttagaacctgtgaatgtgacattttttggaaagcgagtatttgcagatttgattatattaaggatgccaatttgagattatcctggattaagtgggtgggccctaaattcagtaacaagtgtcctgataagcaacacagaggagagacttggagagaagtgagaagaccatgtgaagacagaggcagggatttgaggtatacagccacaagccaaggagtggctggagccacaaggagctggaagagacaaagaaggattcttctccagagcctttggaggaagcatggccctactgacaccttgatttcagacttctggtctccagaactgtgagacaataaatttctgtttttttaagtcacca

SEQ ID NO: 62894 - DNA, 822 bp, Homo sapiens
  misc_feature (690)..(690): n is a, c, g, or t
  misc_feature (757)..(757): n is a, c, g, or t
  misc_feature (767)..(767): n is a, c, g, or t
  misc_feature (805)..(806): n is a, c, g, or t
gacgcccacccacctcccctaaccccacgaatgaatcagctgtgcttcaaatgacatctctgtcccacggaggccggctgggcctctcatgggggtgctcattgtggtttaagtcagctttgattcttgacctccaaggctgcctctgagtagctaactggagaatcgggtggggaggtgaaaaacaccgcagtcaaatgactcaatctttaatcctgtgcttaagacaccactgttgctgttttttatatttgaagcacccaaagactgggcgtccgctcagccttgatgagcgagcagctattttgtcaggccatctatgatgttgggataatggacaaaggcctgattgggccatatatggccttctttagggcctcctggaggtggaggaagttgtgggtaatttctaataaagacgggaaatgacaagccgtgtgtctaggtctggaaaaatggttctcgctgaaaaagcaccaggaatagacagaaaaacatgcacatggggagctgtggtcctgagctttgaggtaatgaattcccactcatgtgatcatttttaccataaccaaagtttctaaccatcaaaatcaagtgacaattaaaacaggcattaatggataaatccgtctttaaatattaatggggttaattttgttaacagctatgtgttggttgcaagtggaatgntctctgttcatttgacttttgaatataactggttccagaatattgtaaaattaagtatgtgaatgtntcttgtattnagattaaacatttggtgttaaaatccaggattagagannactccttgaaattaat

SEQ ID NO: 62895 - DNA, 876 bp, Homo sapiens
  misc_feature (744)..(744): n is a, c, g, or t
  misc_feature (811)..(811): n is a, c, g, or t
  misc_feature (821)..(821): n is a, c, g, or t
  misc_feature (859)..(860): n is a, c, g, or t
gacgcccacccacctcccctaaccccacgaatgaatcagctgtgcttcaaatgacatctctgtcccacggaggccggctgggcctctcatgggggtgctcattgtggtttaagtcagctttgattcttgacctccaaggctgcctctgagtagctaactggagaatcgggtggggaggtgaaaaacaccgcagtcaaatgactcaatctttaatcctgtgcttaagacaccactgttgctgttttttatatttgaagcacccaaagactgggcgtccgctcagccttgatgagcgagcagctattttgtcaggccatctatgatgttgggataatggacaaaggcctgattgggccatatatggccttctttagggcctcctggaggtggaggaagttgtgggtaatttctaataaagacgggaaatgacaagccgtgtgtctaggtctggaaaaatggttctcgctgaaaaagcaccaggaataaaatctcatacaattttaggtgtctattttgttgtctcaccttgaaatactgcagacagaaaaacatgcacatggggagctgtggtcctgagctttgaggtaatgaattcccactcatgtgatcatttttaccataaccaaagtttctaaccatcaaaatcaagtgacaattaaaacaggcattaatggataaatccgtctttaaatattaatggggttaattttgttaacagctatgtgttggttgcaagtggaatgntctctgttcatttgacttttgaatataactggttccagaatattgtaaaattaagtatgtgaatgtntcttgtattnagattaaacatttggtgttaaaatccaggattagagannactccttgaaattaat

SEQ ID NO: 62896 - DNA, 1189 bp, Homo sapiens
  misc_feature (1057)..(1057): n is a, c, g, or t
  misc_feature (1124)..(1124): n is a, c, g, or t
  misc_feature (1134)..(1134): n is a, c, g, or t
  misc_feature (1172)..(1173): n is a, c, g, or t
cacgcgtcgcggacgcggtgggcaggattgggggaacccactgtgggaaatgacagagaagccagtgggggaagacaaagaaagaagaaggtggaggcagaataaaggtgagaagaagggaaggggaggataaaacaagtccagatttagatcttccttcatgcagccatgcatagctgtctgaggccagcagggaaggaggagaaagggaaggtgtggtggaggaggctgtgctcgtgatgtcatgctttcgtgtattcccaggtgcagctgcatatacttggcacagtttcttgggatttctagccagtttcttggcctcatttgtgcattagttaatatgtggctggccctgtactgggatggtgggatagagaagtgaatgtatgaggcctctgcctgagtttataacctagaaagaaataaagacacacacacacaaaggtgttggagtgtgacaagccttaaggtacccgtgtgtccaagtaaagtagaaccagcaagggtggagtgcccaggtcagtctggggactctggaggcttcgcactgcaggcgtcagatactgagtgttagtggcacggagaagagtgtggaaggctcaggatgggggtggacagcctggagttgtcactctcagtagagatgctagaaggggcgggaggtgatcccagcctcccttctttcctcctcctggctgtcacagatgctctgaattgatgaatccttcaggccaaaaacacacaggctccttccctaggtctggaaaaatggttctcgctgaaaaagcaccaggaataaaatctcatacaattttaggtgtctattttgttgtctcaccttgaaatactgcagacagaaaaacatgcacatggggagctgtggtcctgagctttgaggtaatgaattcccactcatgtgatcatttttaccataaccaaagtttctaaccatcaaaatcaagtgacaattaaaacaggcattaatggataaatccgtctttaaatattaatggggttaattttgttaacagctatgtgttggttgcaagtggaatgntctctgttcatttgacttttgaatataactggttccagaatattgtaaaattaagtatgtgaatgtntcttgtattnagattaaacatttggtgttaaaatccaggattagagannactccttgaaattaat

SEQ ID NO: 62897 - DNA, 1434 bp, Homo sapiens
  misc_feature (1302)..(1302): n is a, c, g, or t
  misc_feature (1369)..(1369): n is a, c, g, or t
  misc_feature (1379)..(1379): n is a, c, g, or t
  misc_feature (1417)..(1418): n is a, c, g, or t
atgtgaattgcatatgtatatacatatacgcatatacttacattgattaaaaacggatctgcatctctgtacacacgcagattggctctgtgttgtgcaccttgggactcctccctgggctttggttttacagctaagtaggaagtcaaacaaacgtgaagaatttgggaattggcaggctgtggcatcagccatggaggatggtcctggatgctgtaggatgtgagatccagcacaaagagaacaagaacaggacatgaggaccacagggattgggggaacccactgtgggaaatgacagagaagccagtgggggaagacaaagaaagaagaaggtggaggcagaataaaggtgagaagaagggaaggggaggataaaacaagtccagatttagatcttccttcatgcagccatgcatagctgtctgaggccagcagggaaggaggagaaagggaaggtgtggtggaggaggctgtgctcgtgatgtcatgctttcgtgtattcccaggtgcagctgcatatacttggcacagtttcttgggatttctagccagtttcttggcctcatttgtgcattagttaatatgtggctggccctgtactgggatggtgggatagagaagtgaatgtatgaggcctctgcctgagtttataacctagaaagaaataaagacacacacacacaaaggtgttggagtgtgacaagccttaaggtacccgtgtgtccaagtaaagtagaaccagcaagggtggagtgcccaggtcagtctggggactctggaggcttcgcactgcaggcgtcagatactgagtgttagtggcacggagaagagtgtggaaggctcaggatgggggtggacagcctggagttgtcactctcagtagagatgctagaaggggcgggaggtgatcccagcctcccttctttcctcctcctggctgtcacagatgctctgaattgatgaatccttcaggccaaaaacacacaggctccttccctaggtctggaaaaatggttctcgctgaaaaagcaccaggaataaaatctcatacaattttaggtgtctattttgttgtctcaccttgaaatactgcagacagaaaaacatgcacatggggagctgtggtcctgagctttgaggtaatgaattcccactcatgtgatcatttttaccataaccaaagtttctaaccatcaaaatcaagtgacaattaaaacaggcattaatggataaatccgtctttaaatattaatggggttaattttgttaacagctatgtgttggttgcaagtggaatgntctctgttcatttgacttttgaatataactggttccagaatattgtaaaattaagtatgtgaatgtntcttgtattnagattaaacatttggtgttaaaatccaggattagagannactccttgaaattaat

SEQ ID NO: 62898 - DNA, 3241 bp, Homo sapiens
cctggtacggtcccgaattcctctgtggatcgcctccttctgcgaaccgcaccacccagatcccggggtgcgcggagggcgcgtctctgacggaagccggggcggacggtcggagtccggaagaaaaacagtccgcgacagctaggcgcgtgagaccggccgcccgcaggctgctctggccgggacccgctggccgggagacgcgaacctgccggaccaccgcgcggggacgacggcggccatgagctcgcggaagctgagcgggccgaaaggcaggaggctcagcatacacgtcgtgacttggaacgtggcttcggcagcgccccctctagatctcagtgacctgcttcagctgaacaaccggaacctcaatcttgacatatatgttattggtttgcaggaattgaactctgggatcataagcctcctttccgatgctgcctttaatgactcgtggagcagtttcctcatggatgtgctttcccctctgagcttcatcaaggtctcccatgtccgtatgcaggggatcctcttactggtctttgccaagtatcagcatttgccctatatccagattctgtctactaaatccacccccactggcctgtttgggtactgggggaacaaaggtggagtcaacatctgcctgaagctttatggctactatgtcagcatcatcaactgccacctgcctccccacatttccaacaattaccagcggctggagcactttgaccggatcctggagatgcagaattgtgaggggcgagacatcccaaacatcctggaccacgacctcattatctggtttggagacatgaactttcggatcgaggactttgggttgcactttgttcgggaatccattaaaaatcggtgctacggtggcctgtgggagaaggaccagctcagcattgccaagaaacatgacccgctgctccgggagttccaggagggccgcctactcttcccgcccacctacaagtttgataggaactccaacgactatgacaccagtgagaaaaaacgcaagcctgcatggaccgatcgcatcctgtggaggctgaagcggcagccctgtgctggccccgacactcccataccgccggcgtcacacttctccttgtctctgaggggctacagcagccacatgacgtacggcatcagcgaccacaagcctgtctccggcacgttcgacttggagctgaagccattggtgtctgctccgctgatcgtcctgatgcccgaggacctgtggaccgtggaaaatgacatgatggtcagctactcttcaacctcggacttccccagcagcccgtgggactggattggactgtacaaggtggggctgcgggacgttaatgactacgtgtcctatgcctgggtcggggacagcaaggtctcctgcagcgacaacctgaaccaggtttacatcgacatcagcaatatccctaccactgaagatgagtttctcctctgttactacagcaacagtctgcgttctgtggtggggataagcagacccttccagatcccgcctggctccttgagggaggacccactgggtgaagcacagccacagatctgagccaggatgggagtgaatcccaggcggaggccagagctggcagccagctctgcctttccactgccgggagtgctgggggcccagcctggccccctgaagagacagccaagtgtcgtccacatactcctcccagagtgagctctaaccaggctcatttgctctctccactactcatctctggaattagccgcttaaatacaggtttttgttgctgagatgtgagtgaaaccagctagtgtgtcaacagtgaagacctggggacagttctgcgtctcatttctggattcctaccccctcttctagtcttgcccaagtagtcctgccaggcacatgccccatttggcacaggcctgcattcttgtcgtgccgtcctgggcctcaggctgtctgggaggggagatgctcacatttgtacaggctacatagactggtgcaagcagtgctggattccaggagtcttggcatctcatagcttgtccccgtgaggagtgagcagagggtctgggatttctgctttcagcaaaagcagtctgactcagtgggcagaatggaggggcccctctagccaggctcttacgccatggttatgagcaggttgatgagggtccttcggccagcacaaccttcctccctactcacggcatggagtctgactgcatggaagttccagatcctgacagagagaactgggaaggatccaggttcgcttccgttggtagcttgagtcccatgcctccaccctgccatctgaggaaggggtgacaagtggtcaaggagctgtggccacagacttttccagggtggtccttggcaggtgaggtgcgtctgtgccacccttgtcaggagccattgacgacgggccccccctggaccccccgggacctcagagtgggggcaggcagaagggagaaccagctcaagacattttggaggatctggccctggggttcttcagagaacaccctctaggggctttggggacatggcctgtccccacatccagcacttgcctccgccatggtcactcggcagcccttttcccaggagaagacacctctgggagcctgctcagtgcttgtcctgccatcctgtgtcctgggactgagggttactccagttgctctgtgttgcatactctcccccgcaagcctgtgtatgaagaattgtcccctggcttccagcaggccatggctggctgttttgtgactgttacattgtgcaggggtaattattagcgtggcttttaaaaaaaaaaaaaaaaaaaaaaaaaaaaaaaaaaaaaaacaaaaaaaaaaaaaaaaaaaaaaaaaaaaaaaaaaaaaaaaaaaaaaaagagagggggggcgcgcgcccaaaaacccccgcgggggggcgcccacacatctcacgcgccgacaccgccgactattcttcgtctgcaacaaggggggcccccacaataagatggggagggacgcgcttttattaaagcacgcaccgagagcgcggcgggcgccggcggtggtatacacacacagaccgagtggagacggtgggagaaaaaacacgttgggacgaacggggggcgatcacttgggtgaggagaagagacgacccctctcttaccttgggggggggggggaacaacataccggtgggcaaacacctacccat

SEQ ID NO: 62899 - DNA, 3340 bp, Homo sapiens
cggccgcacacctcgcgtcgtctggggcagtgttgcgcgtgcgctgatgacaggcccgacacgcccctcttacgtccgcgaacccgtcttcgctcagcctctcgcagctttgcgctcgtgggagagtcccgcctccttctgcgaaccgcaccacccagatcccggggtgcgcggagggcgcgtctctgacggaagccggggcggacggtcggagtccggaagaaaaacagtccgcgacagctaggcgcgtgagaccggccgcccgcaggctgctctggccgggacccgctggccgggagacgcgaacctgccggaccaccgcgcggggacgacggcggccatgagctcgcggaagctgagcgggccgaaaggcaggaggctcagcatacacgtcgtgacttggaacgtggcttcggcagcgccccctctagatctcagtgacctgcttcagctgaacaaccggaacctcaatcttgacatatatgttattggtttgcaggaattgaactctgggatcataagcctcctttccgatgctgcctttaatgactcgtggagcagtttcctcatggatgtgctttcccctctgagcttcatcaaggtctcccatgtccgtatgcaggggatcctcttactggtctttgccaagtatcagcatttgccctatatccagattctgtctactaaatccacccccactggcctgtttgggtactgggggaacaaaggtggagtcaacatctgcctgaagctttatggctactatgtcagcatcatcaactgccacctgcctccccacatttccaacaattaccagcggctggagcactttgaccggatcctggagatgcagaattgtgaggggcgagacatcccaaacatcctggaccacgacctcattatctggtttggagacatgaactttcggatcgaggactttgggttgcactttgttcgggaatccattaaaaatcggtgctacggtggcctgtgggagaaggaccagctcagcattgccaagaaacatgacccgctgctccgggagttccaggagggccgcctactcttcccgcccacctacaagtttgataggaactccaacgactatgacaccagtgagaaaaaacgcaagcctgcatggaccgatcgcatcctgtggaggctgaagcggcagccctgtgctggccccgacactcccataccgccggcgtcacacttctccttgtctctgaggggctacagcagccacatgacgtacggcatcagcgaccacaagcctgtctccggcacgttcgacttggagctgaagccattggtgtctgctccgctgatcgtcctgatgcccgaggacctgtggaccgtggaaaatgacatgatggtcagctactcttcaacctcggacttccccagcagcccgtgggactggattggactgtacaaggtggggctgcgggacgttaatgactacgtgtcctatgcctgggtcggggacagcaaggtctcctgcagcgacaacctgaaccaggtttacatcgacatcagcaatatccctaccactgaagatgagtttctcctctgttactacagcaacagtctgcgttctgtggtggggataagcagacccttccagatcccgcctggctccttgagggaggacccactgggtgaagcacagccacagatctgagccaggatgggagtgaatcccaggcggaggccagagctggcagccagctctgcctttccactgccgggagtgctgggggcccagcctggccccctgaagagacagccaagtgtcgtccacatactcctcccagagtgagctctaaccaggctcatttgctctctccactactcatctctggaattagccgcttaaatacaggtttttgttgctgagatgtgagtgaaaccagctagtgtgtcaacagtgaagacctggggacagttctgcgtctcatttctggattcctaccccctcttctagtcttgcccaagtagtcctgccaggcacatgccccatttggcacaggcctgcattcttgtcgtgccgtcctgggcctcaggctgtctgggaggggagatgctcacatttgtacaggctacatagactggtgcaagcagtgctggattccaggagtcttggcatctcatagcttgtccccgtgaggagtgagcagagggtctgggatttctgctttcagcaaaagcagtctgactcagtgggcagaatggaggggcccctctagccaggctcttacgccatggttatgagcaggttgatgagggtccttcggccagcacaaccttcctccctactcacggcatggagtctgactgcatggaagttccagatcctgacagagagaactgggaaggatccaggttcgcttccgttggtagcttgagtcccatgcctccaccctgccatctgaggaaggggtgacaagtggtcaaggagctgtggccacagacttttccagggtggtccttggcaggtgaggtgcgtctgtgccacccttgtcaggagccattgacgacgggccccccctggaccccccgggacctcagagtgggggcaggcagaagggagaaccagctcaagacattttggaggatctggccctggggttcttcagagaacaccctctaggggctttggggacatggcctgtccccacatccagcacttgcctccgccatggtcactcggcagcccttttcccaggagaagacacctctgggagcctgctcagtgcttgtcctgccatcctgtgtcctgggactgagggttactccagttgctctgtgttgcatactctcccccgcaagcctgtgtatgaagaattgtcccctggcttccagcaggccatggctggctgttttgtgactgttacattgtgcaggggtaattattagcgtggcttttaaaaaaaaaaaaaaaaaaaaaaaaaaaaaaaaaaaaaaacaaaaaaaaaaaaaaaaaaaaaaaaaaaaaaaaaaaaaaaaaaaaaaaagagagggggggcgcgcgcccaaaaacccccgcgggggggcgcccacacatctcacgcgccgacaccgccgactattcttcgtctgcaacaaggggggcccccacaataagatggggagggacgcgcttttattaaagcacgcaccgagagcgcggcgggcgccggcggtggtatacacacacagaccgagtggagacggtgggagaaaaaacacgttgggacgaacggggggcgatcacttgggtgaggagaagagacgacccctctcttaccttgggggggggggggaacaacataccggtgggcaaacacctacccat

SEQ ID NO: 62900 - DNA, 3730 bp, Homo sapiens
cggccgcacacctcgcgtcgtctggggcagtgttgcgcgtgcgctgatgacaggcccgacacgcccctcttacgtccgcgaacccgtcttcgctcagcctctcgcagctttgcgctcgtgggagagtcccgcctccttctgcgaaccgcaccacccagatcccggggtgcgcggagggcgcgtctctgacggaagccggggcggacggtcggagtccggaagaaaaacagtccgcgacagctaggcgcgtgagaccggccgcccgcaggctgctctggccgggacccgctggccgggagacgcgaacctgccggaccaccgcgcggggacgacggcggccatgagctcgcggaagctgagcgggccgaaaggcaggaggctcagcacatacatcaggaggtctgcctgatcccatggtgaaccccgggaatccgaaatcagattgagataagatcctttagggaagtgacttagcctggtctcttgcctgctctttcacggggaacaacgctaatcgcccacttagtctaagtcacgatgcttggatttgctgctaatcgtcggatttgagagtgggaacaagaaatccggacttttgctctccatcctcttagaatctccagctgctgcaggtactcctcatcgtgtgcctaggactcatgctaggctgttcctggtctctgcagggtctgtagctcctgcccgctctgtgctccgcacagtctgaggcttcttgaagagctgctgtgactgactgttccactaaagacatctcatacacgtcgtgacttggaacgtggcttcggcagcgccccctctagatctcagtgacctgcttcagctgaacaaccggaacctcaatcttgacatatatgttattggtttgcaggaattgaactctgggatcataagcctcctttccgatgctgcctttaatgactcgtggagcagtttcctcatggatgtgctttcccctctgagcttcatcaaggtctcccatgtccgtatgcaggggatcctcttactggtctttgccaagtatcagcatttgccctatatccagattctgtctactaaatccacccccactggcctgtttgggtactgggggaacaaaggtggagtcaacatctgcctgaagctttatggctactatgtcagcatcatcaactgccacctgcctccccacatttccaacaattaccagcggctggagcactttgaccggatcctggagatgcagaattgtgaggggcgagacatcccaaacatcctggaccacgacctcattatctggtttggagacatgaactttcggatcgaggactttgggttgcactttgttcgggaatccattaaaaatcggtgctacggtggcctgtgggagaaggaccagctcagcattgccaagaaacatgacccgctgctccgggagttccaggagggccgcctactcttcccgcccacctacaagtttgataggaactccaacgactatgacaccagtgagaaaaaacgcaagcctgcatggaccgatcgcatcctgtggaggctgaagcggcagccctgtgctggccccgacactcccataccgccggcgtcacacttctccttgtctctgaggggctacagcagccacatgacgtacggcatcagcgaccacaagcctgtctccggcacgttcgacttggagctgaagccattggtgtctgctccgctgatcgtcctgatgcccgaggacctgtggaccgtggaaaatgacatgatggtcagctactcttcaacctcggacttccccagcagcccgtgggactggattggactgtacaaggtggggctgcgggacgttaatgactacgtgtcctatgcctgggtcggggacagcaaggtctcctgcagcgacaacctgaaccaggtttacatcgacatcagcaatatccctaccactgaagatgagtttctcctctgttactacagcaacagtctgcgttctgtggtggggataagcagacccttccagatcccgcctggctccttgagggaggacccactgggtgaagcacagccacagatctgagccaggatgggagtgaatcccaggcggaggccagagctggcagccagctctgcctttccactgccgggagtgctgggggcccagcctggccccctgaagagacagccaagtgtcgtccacatactcctcccagagtgagctctaaccaggctcatttgctctctccactactcatctctggaattagccgcttaaatacaggtttttgttgctgagatgtgagtgaaaccagctagtgtgtcaacagtgaagacctggggacagttctgcgtctcatttctggattcctaccccctcttctagtcttgcccaagtagtcctgccaggcacatgccccatttggcacaggcctgcattcttgtcgtgccgtcctgggcctcaggctgtctgggaggggagatgctcacatttgtacaggctacatagactggtgcaagcagtgctggattccaggagtcttggcatctcatagcttgtccccgtgaggagtgagcagagggtctgggatttctgctttcagcaaaagcagtctgactcagtgggcagaatggaggggcccctctagccaggctcttacgccatggttatgagcaggttgatgagggtccttcggccagcacaaccttcctccctactcacggcatggagtctgactgcatggaagttccagatcctgacagagagaactgggaaggatccaggttcgcttccgttggtagcttgagtcccatgcctccaccctgccatctgaggaaggggtgacaagtggtcaaggagctgtggccacagacttttccagggtggtccttggcaggtgaggtgcgtctgtgccacccttgtcaggagccattgacgacgggccccccctggaccccccgggacctcagagtgggggcaggcagaagggagaaccagctcaagacattttggaggatctggccctggggttcttcagagaacaccctctaggggctttggggacatggcctgtccccacatccagcacttgcctccgccatggtcactcggcagcccttttcccaggagaagacacctctgggagcctgctcagtgcttgtcctgccatcctgtgtcctgggactgagggttactccagttgctctgtgttgcatactctcccccgcaagcctgtgtatgaagaattgtcccctggcttccagcaggccatggctggctgttttgtgactgttacattgtgcaggggtaattattagcgtggcttttaaaaaaaaaaaaaaaaaaaaaaaaaaaaaaaaaaaaaaacaaaaaaaaaaaaaaaaaaaaaaaaaaaaaaaaaaaaaaaaaaaaaaaagagagggggggcgcgcgcccaaaaacccccgcgggggggcgcccacacatctcacgcgccgacaccgccgactattcttcgtctgcaacaaggggggcccccacaataagatggggagggacgcgcttttattaaagcacgcaccgagagcgcggcgggcgccggcggtggtatacacacacagaccgagtggagacggtgggagaaaaaacacgttgggacgaacggggggcgatcacttgggtgaggagaagagacgacccctctcttaccttgggggggggggggaacaacataccggtgggcaaacacctacccat

SEQ ID NO: 62901 - DNA, 3462 bp, Homo sapiens
cggccgcacacctcgcgtcgtctggggcagtgttgcgcgtgcgctgatgacaggcccgacacgcccctcttacgtccgcgaacccgtcttcgctcagcctctcgcagctttgcgctcgtgggagagtcccgcctccttctgcgaaccgcaccacccagatcccggggtgcgcggagggcgcgtctctgacggaagccggggcggacggtcggagtccggaagaaaaacagtccgcgacagctaggcgcgtgagaccggccgcccgcaggctgctctggccgggacccgctggccgggagacgcgaacctgccggaccaccgcgcggggacgacggcggccatgagctcgcggaagctgagcgggccgaaaggcaggaggctcagcacatacatcaggaggtctgcctgatcccatggtgaaccccgggaatccgaaatcagattgagataagatcctttagggaagtgacttagcctggtctcttgcctgctctttcacggggaacaacgctaatcgcccacttagtctaagtcacgatgcttggatttgctgctaatcgtcggatttgagagtgggaacaagaaatccggacttttgctctccatcctcttagacatacacgtcgtgacttggaacgtggcttcggcagcgccccctctagatctcagtgacctgcttcagctgaacaaccggaacctcaatcttgacatatatgttattgggtctcccatgtccgtatgcaggggatcctcttactggtctttgccaagtatcagcatttgccctatatccagattctgtctactaaatccacccccactggcctgtttgggtactgggggaacaaaggtggagtcaacatctgcctgaagctttatggctactatgtcagcatcatcaactgccacctgcctccccacatttccaacaattaccagcggctggagcactttgaccggatcctggagatgcagaattgtgaggggcgagacatcccaaacatcctggaccacgacctcattatctggtttggagacatgaactttcggatcgaggactttgggttgcactttgttcgggaatccattaaaaatcggtgctacggtggcctgtgggagaaggaccagctcagcattgccaagaaacatgacccgctgctccgggagttccaggagggccgcctactcttcccgcccacctacaagtttgataggaactccaacgactatgacaccagtgagaaaaaacgcaagcctgcatggaccgatcgcatcctgtggaggctgaagcggcagccctgtgctggccccgacactcccataccgccggcgtcacacttctccttgtctctgaggggctacagcagccacatgacgtacggcatcagcgaccacaagcctgtctccggcacgttcgacttggagctgaagccattggtgtctgctccgctgatcgtcctgatgcccgaggacctgtggaccgtggaaaatgacatgatggtcagctactcttcaacctcggacttccccagcagcccgtgggactggattggactgtacaaggtggggctgcgggacgttaatgactacgtgtcctatgcctgggtcggggacagcaaggtctcctgcagcgacaacctgaaccaggtttacatcgacatcagcaatatccctaccactgaagatgagtttctcctctgttactacagcaacagtctgcgttctgtggtggggataagcagacccttccagatcccgcctggctccttgagggaggacccactgggtgaagcacagccacagatctgagccaggatgggagtgaatcccaggcggaggccagagctggcagccagctctgcctttccactgccgggagtgctgggggcccagcctggccccctgaagagacagccaagtgtcgtccacatactcctcccagagtgagctctaaccaggctcatttgctctctccactactcatctctggaattagccgcttaaatacaggtttttgttgctgagatgtgagtgaaaccagctagtgtgtcaacagtgaagacctggggacagttctgcgtctcatttctggattcctaccccctcttctagtcttgcccaagtagtcctgccaggcacatgccccatttggcacaggcctgcattcttgtcgtgccgtcctgggcctcaggctgtctgggaggggagatgctcacatttgtacaggctacatagactggtgcaagcagtgctggattccaggagtcttggcatctcatagcttgtccccgtgaggagtgagcagagggtctgggatttctgctttcagcaaaagcagtctgactcagtgggcagaatggaggggcccctctagccaggctcttacgccatggttatgagcaggttgatgagggtccttcggccagcacaaccttcctccctactcacggcatggagtctgactgcatggaagttccagatcctgacagagagaactgggaaggatccaggttcgcttccgttggtagcttgagtcccatgcctccaccctgccatctgaggaaggggtgacaagtggtcaaggagctgtggccacagacttttccagggtggtccttggcaggtgaggtgcgtctgtgccacccttgtcaggagccattgacgacgggccccccctggaccccccgggacctcagagtgggggcaggcagaagggagaaccagctcaagacattttggaggatctggccctggggttcttcagagaacaccctctaggggctttggggacatggcctgtccccacatccagcacttgcctccgccatggtcactcggcagcccttttcccaggagaagacacctctgggagcctgctcagtgcttgtcctgccatcctgtgtcctgggactgagggttactccagttgctctgtgttgcatactctcccccgcaagcctgtgtatgaagaattgtcccctggcttccagcaggccatggctggctgttttgtgactgttacattgtgcaggggtaattattagcgtggcttttaaaaaaaaaaaaaaaaaaaaaaaaaaaaaaaaaaaaaaacaaaaaaaaaaaaaaaaaaaaaaaaaaaaaaaaaaaaaaaaaaaaaaaagagagggggggcgcgcgcccaaaaacccccgcgggggggcgcccacacatctcacgcgccgacaccgccgactattcttcgtctgcaacaaggggggcccccacaataagatggggagggacgcgcttttattaaagcacgcaccgagagcgcggcgggcgccggcggtggtatacacacacagaccgagtggagacggtgggagaaaaaacacgttgggacgaacggggggcgatcacttgggtgaggagaagagacgacccctctcttaccttgggggggggggggaacaacataccggtgggcaaacacctacccat

SEQ ID NO: 62902 - DNA, 3504 bp, Homo sapiens
cctggtacggtcccgaattcctctgtggatcgcctccttctgcgaaccgcaccacccagatcccggggtgcgcggagggcgcgtctctgacggaagccggggcggacggtcggagtccggaagaaaaacagtccgcgacagctaggcgcgtgagaccggccgcccgcaggctgctctggccgggacccgctggccgggagacgcgaacctgccggaccaccgcgcggggacgacggcggccatgagctcgcggaagctgagcgggccgaaaggcaggaggctcagcatacacgtcgtgacttggaacgtggcttcggcagcgccccctctagatctcagtgacctgcttcagctgaacaaccggaacctcaatcttgacatatatgttattggtttgcaggaattgaactctgggatcataagcctcctttccgatgctgcctttaatgactcgtggagcagtttcctcatggatgtgctttcccctctgagcttcatcaaggtctcccatgtccgtatgcaggggatcctcttactggtctttgccaagtatcagcatttgccctatatccagattctgtctactaaatccacccccactggcctgtttgggtactgggggaacaaaggtggagtcaacatctgcctgaagctttatggctactatgtcagcatcatcaactgccacctgcctccccacatttccaacaattaccagcggctggagcactttgaccggatcctggagatgcagaattgtgaggggcgagacatcccaaacatcctggaccacgacctcattatctggtttggagacatgaactttcggatcgaggactttgggttgcactttgttcgggaatccattaaaaatcggtgctacggtggcctgtgggagaaggaccagctcagcattgccaagaaacatgacccgctgctccgggagttccaggagggccgcctactcttcccgcccacctacaagtttgataggaactccaacgactatgacaccagtgagaaaaaacgcaagcctgcatggaccgatcgcatcctgtggaggctgaagcggcagccctgtgctggccccgacactcccataccgccggcgtcacacttctccttgtctctgaggggctacagcagccacatgacgtacggcatcagcgaccacaagcctgtctccggcacgttcgacttggagctgaagccattggtgtctgctccgctgatcgtcctgatgcccgaggacctgtggaccgtggaaaatgacatgatggtcagctactcttcaacctcggacttccccagcagcccgtgggactggattggactgtacaaggtgatgtggtggcaaggcaggaagtccatcagcgacagcccctggttcatccttcccgagggctcctgggagctgggcagatgctgacgaactcaccctcatccaccccagcggttcttctgtagctaaaggctggcagtgaagggcggcggggaggcacacagtacggtagccaggcccagcagggagaccatctcttccttaggacttgccttaggtcccatgtcctccctgaccactgatggcctgactccccctcacaggtggggctgcgggacgttaatgactacgtgtcctatgcctgggtcggggacagcaaggtctcctgcagcgacaacctgaaccaggtttacatcgacatcagcaatatccctaccactgaagatgagtttctcctctgttactacagcaacagtctgcgttctgtggtggggataagcagacccttccagatcccgcctggctccttgagggaggacccactgggtgaagcacagccacagatctgagccaggatgggagtgaatcccaggcggaggccagagctggcagccagctctgcctttccactgccgggagtgctgggggcccagcctggccccctgaagagacagccaagtgtcgtccacatactcctcccagagtgagctctaaccaggctcatttgctctctccactactcatctctggaattagccgcttaaatacaggtttttgttgctgagatgtgagtgaaaccagctagtgtgtcaacagtgaagacctggggacagttctgcgtctcatttctggattcctaccccctcttctagtcttgcccaagtagtcctgccaggcacatgccccatttggcacaggcctgcattcttgtcgtgccgtcctgggcctcaggctgtctgggaggggagatgctcacatttgtacaggctacatagactggtgcaagcagtgctggattccaggagtcttggcatctcatagcttgtccccgtgaggagtgagcagagggtctgggatttctgctttcagcaaaagcagtctgactcagtgggcagaatggaggggcccctctagccaggctcttacgccatggttatgagcaggttgatgagggtccttcggccagcacaaccttcctccctactcacggcatggagtctgactgcatggaagttccagatcctgacagagagaactgggaaggatccaggttcgcttccgttggtagcttgagtcccatgcctccaccctgccatctgaggaaggggtgacaagtggtcaaggagctgtggccacagacttttccagggtggtccttggcaggtgaggtgcgtctgtgccacccttgtcaggagccattgacgacgggccccccctggaccccccgggacctcagagtgggggcaggcagaagggagaaccagctcaagacattttggaggatctggccctggggttcttcagagaacaccctctaggggctttggggacatggcctgtccccacatccagcacttgcctccgccatggtcactcggcagcccttttcccaggagaagacacctctgggagcctgctcagtgcttgtcctgccatcctgtgtcctgggactgagggttactccagttgctctgtgttgcatactctcccccgcaagcctgtgtatgaagaattgtcccctggcttccagcaggccatggctggctgttttgtgactgttacattgtgcaggggtaattattagcgtggcttttaaaaaaaaaaaaaaaaaaaaaaaaaaaaaaaaaaaaaaacaaaaaaaaaaaaaaaaaaaaaaaaaaaaaaaaaaaaaaaaaaaaaaaagagagggggggcgcgcgcccaaaaacccccgcgggggggcgcccacacatctcacgcgccgacaccgccgactattcttcgtctgcaacaaggggggcccccacaataagatggggagggacgcgcttttattaaagcacgcaccgagagcgcggcgggcgccggcggtggtatacacacacagaccgagtggagacggtgggagaaaaaacacgttgggacgaacggggggcgatcacttgggtgaggagaagagacgacccctctcttaccttgggggggggggggaacaacataccggtgggcaaacacctacccat

SEQ ID NO: 62903 - DNA, 1820 bp, Homo sapiens
cctggtacggtcccgaattcctctgtggatcgcctccttctgcgaaccgcaccacccagatcccggggtgcgcggagggcgcgtctctgacggaagccggggcggacggtcggagtccggaagaaaaacagtccgcgacagctaggcgcgtgagaccggccgcccgcaggctgctctggccgggacccgctggccgggagacgcgaacctgccggaccaccgcgcggggacgacggcggccatgagctcgcggaagctgagcgggccgaaaggcaggaggctcagcatacacgtcgtgacttggaacgtggcttcggcagcgccccctctagatctcagtgacctgcttcagctgaacaaccggaacctcaatcttgacatatatgttattggtttgcaggaattgaactctgggatcataagcctcctttccgatgctgcctttaatgactcgtggagcagtttcctcatggatgtgctttcccctctgagcttcatcaaggtctcccatgtccgtatgcaggggatcctcttactggtctttgccaagtatcagcatttgccctatatccagattctgtctactaaatccacccccactggcctgtttgggtactgggggaacaaaggtggagtcaacatctgcctgaagctttatggctactatgtcagcatcatcaactgccacctgcctccccacatttccaacaattaccagcggctggagcactttgaccggatcctggagatgcagaattgtgaggggcgagacatcccaaacatcctggaccacgacctcattatctggtttggagacatgaactttcggatcgaggactttgggttgcactttgttcgggaatccattaaaaatcggtgctacggtggcctgtgggagaaggaccagctcagcattgccaagaaacatgacccgctgctccgggagttccaggagggccgcctactcttcccgcccacctacaagtttgataggaactccaacgactatgacaccagtgagaaaaaacgcaagcctgcatggaccgatcgcatcctgtggaggctgaagcggcagccctgtgctggccccgacactcccataccgccggcgtcacacttctccttgtctctgaggggctacagcagccacatgacgtacggcatcagcgaccacaagcctgtctccggcacgttcgacttggagctgaagccattggtgtctgctccgctgatcgtcctgatgcccgaggacctgtggaccgtggaaaatgacatgatggtcagctactcttcaacctcggacttccccagcagcccgtgggactggattggactgtacaaggtggggctgcgggacgttaatgactacgtgtcctatgcctgggtcggggacagcaaggtctcctgcagcgacaacctgaaccaggtttacatcgacatcagcaatatccctaccactgaagatgagtttctcctctgttactacagcaacagtctgcgttctgtggtggggataagcagacccttccagatcccgcctggctccttgagggaggacccactgggtgaagcacagccacagatctgagccaggatgggagtgaatcccaggcggaggccagagctggcagccagctctgcctttccactgccgggagtgctgggggcccagcctggccccctgaagagacagccaagtgtcgtccacatactcctcccagagtgagctctaaccaggctcatttgctctctccactactcatctctggaattagccgcttaaatacaggtttttgttgctgagatgtgagtgaaaccag

SEQ ID NO: 62904 - DNA, 2236 bp, Homo sapiens
  misc_feature (10)..(10): n is a, c, g, or t
agtggatccnccgggctgctggaattcggcacgatggaccgatcgcatcctgtggaggctgaagcggcagccctgtgctggccccgacactcccataccgccggcgtcacacttctccttgtctctgaggggctacagcagccacatgacgtacggcatcagcgaccacaagcctgtctccggcacgttcgacttggagctgaagccattggtgtctgctccgctgatcgtcctgatgcccgaggacctgtggaccgtggaaaatgacatgatggtcagctactcttcaacctcggacttccccagcagcccgtgggactggattggactgtacaaggtggggctgcgggacgttaatgactacgtgtcctatgcctgggtcggggacagcaaggtctcctgcagcgacaacctgaaccaggtttacatcgacatcagcaatatccctaccactgaagatgagtttctcctctgttactacagcaacagtctgcgttctgtggtggggataagcagacccttccagatcccgcctggctccttgagggaggacccactgggtgaagcacagccacagatctgagccaggatgggagtgaatcccaggcggaggccagagctggcagccagctctgcctttccactgccgggagtgctgggggcccagcctggccccctgaagagacagccaagtgtcgtccacatactcctcccagagtgagctctaaccaggctcatttgctctctccactactcatctctggaattagccgcttaaatacaggtttttgttgctgagatgtgagtgaaaccagctagtgtgtcaacagtgaagacctggggacagttctgcgtctcatttctggattcctaccccctcttctagtcttgcccaagtagtcctgccaggcacatgccccatttggcacaggcctgcattcttgtcgtgccgtcctgggcctcaggctgtctgggaggggagatgctcacatttgtacaggctacatagactggtgcaagcagtgctggattccaggagtcttggcatctcatagcttgtccccgtgaggagtgagcagagggtctgggatttctgctttcagcaaaagcagtctgactcagtgggcagaatggaggggcccctctagccaggctcttacgccatggttatgagcaggttgatgagggtccttcggccagcacaaccttcctccctactcacggcatggagtctgactgcatggaagttccagatcctgacagagagaactgggaaggatccaggttcgcttccgttggtagcttgagtcccatgcctccaccctgccatctgaggaaggggtgacaagtggtcaaggagctgtggccacagacttttccagggtggtccttggcaggtgaggtgcgtctgtgccacccttgtcaggagccattgacgacgggccccccctggaccccccgggacctcagagtgggggcaggcagaagggagaaccagctcaagacattttggaggatctggccctggggttcttcagagaacaccctctaggggctttggggacatggcctgtccccacatccagcacttgcctccgccatggtcactcggcagcccttttcccaggagaagacacctctgggagcctgctcagtgcttgtcctgccatcctgtgtcctgggactgagggttactccagttgctctgtgttgcatactctcccccgcaagcctgtgtatgaagaattgtcccctggcttccagcaggccatggctggctgttttgtgactgttacattgtgcaggggtaattattagcgtggcttttaaaaaaaaaaaaaaaaaaaaaaaaaaaaaaaaaaaaaaacaaaaaaaaaaaaaaaaaaaaaaaaaaaaaaaaaaaaaaaaaaaaaaaagagagggggggcgcgcgcccaaaaacccccgcgggggggcgcccacacatctcacgcgccgacaccgccgactattcttcgtctgcaacaaggggggcccccacaataagatggggagggacgcgcttttattaaagcacgcaccgagagcgcggcgggcgccggcggtggtatacacacacagaccgagtggagacggtgggagaaaaaacacgttgggacgaacggggggcgatcacttgggtgaggagaagagacgacccctctcttaccttgggggggggggggaacaacataccggtgggcaaacacctacccat

SEQ ID NO: 62905 - DNA, 1908 bp, Homo sapiens
  misc_feature (1888)..(1888): n is a, c, g, or t
  misc_feature (1891)..(1891): n is a, c, g, or t
cctggtacggtcccgaattcctctgtggatcgcctccttctgcgaaccgcaccacccagatcccggggtgcgcggagggcgcgtctctgacggaagccggggcggacggtcggagtccggaagaaaaacagtccgcgacagctaggcgcgtgagaccggccgcccgcaggctgctctggccgggacccgctggccgggagacgcgaacctgccggaccaccgcgcggggacgacggcggccatgagctcgcggaagctgagcgggccgaaaggcaggaggctcagcatacacgtcgtgacttggaacgtggcttcggcagcgccccctctagatctcagtgacctgcttcagctgaacaaccggaacctcaatcttgacatatatgttattggtttgcaggaattgaactctgggatcataagcctcctttccgatgctgcctttaatgactcgtggagcagtttcctcatggatgtgctttcccctctgagcttcatcaaggtctcccatgtccgtatgcaggggatcctcttactggtctttgccaagtatcagcatttgccctatatccagattctgtctactaaatccacccccactggcctgtttgggtactgggggaacaaaggtggagtcaacatctgcctgaagctttatggctactatgtcagcatcatcaactgccacctgcctccccacatttccaacaattaccagcggctggagcactttgaccggatcctggagatgcagaattgtgaggggcgagacatcccaaacatcctggaccacgacctcattatctggtttggagacatgaactttcggatcgaggactttgggttgcactttgttcgggaatccattaaaaatcggtgctacggtggcctgtgggagaaggaccagctcagcattgccaagaaacatgacccgctgctccgggagttccaggagggccgcctactcttcccgcccacctacaagtttgataggaactccaacgactatgacaccagtgagaaaaaacgcaagcctgcatggaccgatcgcatcctgtggaggctgaagcggcagccctgtgctggccccgacactcccataccgccggcgtcacacttctccttgtctctgaggggctacagcagccacatgacgtacggcatcagcgaccacaagcctgtctccggcacgttcgacttggagctgaagccattggtgtctgctccgctgatcgtcctgatgcccgaggacctgtggaccgtggaaaatgacatgatggtcagctactcttcaacctcggacttccccagcagcccgtgggactggattggactgtacaaggtggggctgcgggacgttaatgactacgtgtcctatgcctgggtcggggacagcaaggtctcctgcagcgacaacctgaaccaggtttacatcgacatcagcaatatccctaccactgaagatgagtttctcctctgttactacagcaacagtctgcgttctgtggtggggataagcagacccttccagatcccgcctggctccttgagggaggacccactgggtgaagcacagccacagatctgagccaggatgggagtgaatcccaggcggaggccagagctggcagccagctctgcctttccactgccgggagtgctgggggcccagcctggccccctgaagagacagccaagtgtcgtccacatactcctcccagagtgagctctaaccaggctcatttgctctctccactactcatctctggaattagccgcttaaatacaggtttttgttgctgagatgtgagtgaaaccagctagtgtgtcaacagtgaagacctggggacagttctgcgtctcattccagagatgagtagtggagagnggnaatgagcctggttagag

SEQ ID NO: 62906 - DNA, 2304 bp, Homo sapiens
cctggtacggtcccgaattcctctgtggatcgcctccttctgcgaaccgcaccacccagatcccggggtgcgcggagggcgcgtctctgacggaagccggggcggacggtcggagtccggaagaaaaacagtccgcgacagctaggcgcgtgagaccggccgcccgcaggctgctctggccgggacccgctggccgggagacgcgaacctgccggaccaccgcgcggggacgacggcggccatgagctcgcggaagctgagcgggccgaaaggcaggaggctcagcatacacgtcgtgacttggaacgtggcttcggcagcgccccctctagatctcagtgacctgcttcagctgaacaaccggaacctcaatcttgacatatatgttattggtttgcaggaattgaactctgggatcataagcctcctttccgatgctgcctttaatgactcgtggagcagtttcctcatggatgtgctttcccctctgagcttcatcaaggtctcccatgtccgtatgcaggggatcctcttactggtctttgccaagtatcagcatttgccctatatccagattctgtctactaaatccacccccactggcctgtttgggtactgggggaacaaaggtggagtcaacatctgcctgaagctttatggctactatgtcagcatcatcaactgccacctgcctccccacatttccaacaattaccagcggctggagcactttgaccggatcctggagatgcagaattgtgaggggcgagacatcccaaacatcctggaccacgacctcattatctggtttggagacatgaactttcggatcgaggactttgggttgcactttgttcgggaatccattaaaaatcggtgctacggtggcctgtgggagaaggaccagctcagcattgccaagaaacatgacccgctgctccgggagttccaggagggccgcctactcttcccgcccacctacaagtttgataggaactccaacgactatgacaccagtgagaaaaaacgcaagcctgcatggaccgatcgcatcctgtggaggctgaagcggcagccctgtgctggccccgacactcccataccgccggcgtcacacttctccttgtctctgaggggctacagcagccacatgacgtacggcatcagcgaccacaagcctgtctccggcacgttcgacttggagctgaagccattggtgtctgctccgctgatcgtcctgatgcccgaggacctgtggaccgtggaaaatgacatgatggtcagctactcttcaacctcggacttccccagcagcccgtgggactggattggactgtacaaggtggggctgcgggacgttaatgactacgtgtcctatgcctgggtcggggacagcaaggtctcctgcagcgacaacctgaaccaggtttacatcgacatcagcaatatccctaccactgaagatgagtttctcctctgttactacagcaacagtctgcgttctgtggtggggataagcagacccttccagatcccgcctggctccttgagggaggacccactgggtgaagcacagccacagatctgagccaggatgggagtgaatcccaggcggaggccagagctggcagccagctctgcctttccactgccgggagtgctgggggcccagcctggccccctgaagagacagccaagtgtcgtccacatactcctcccagagtgagctctaaccaggctcatttgctctctccactactcatctctggaattagccgcttaaatacaggtttttgttgctgagatgtgagtgaaaccagcctggcttccagcaggccatggctggctgttttgtgactgttacattgtgcaggggtaattattagcgtggcttttaaaaaaaaaaaaaaaaaaaaaaaaaaaaaaaaaaaaaaacaaaaaaaaaaaaaaaaaaaaaaaaaaaaaaaaaaaaaaaaaaaaaaaagagagggggggcgcgcgcccaaaaacccccgcgggggggcgcccacacatctcacgcgccgacaccgccgactattcttcgtctgcaacaaggggggcccccacaataagatggggagggacgcgcttttattaaagcacgcaccgagagcgcggcgggcgccggcggtggtatacacacacagaccgagtggagacggtgggagaaaaaacacgttgggacgaacggggggcgatcacttgggtgaggagaagagacgacccctctcttaccttgggggggggggggaacaacataccggtgggcaaacacctacccat

SEQ ID NO: 62907 - DNA, 393 bp, Homo sapiens
ggacttgccttaggtcccatgtcctccctgaccactgatggcctgactccccctcacaggtggggctgcgggacgttaatgactacgtgtcctatgcctgggtcggggacagcaaggtctcctgcagcgacaacctgaaccaggtacgtcaccagcaccaggtacatcaccagcaggcaggcctgcctcagcactcctgtcttgtggaaggaacagagtgctgaataacttgtcactcagagctgggtggagcccagagccctggagctgaccccagtcctgtccatccccctccaggtttacatcgacatcagcaatatccctaccactgaagatgagtttctcctctgttactacagcaacagtctgcgttctgtggtggggataagcaga

SEQ ID NO: 62908 - DNA, 938 bp, Homo sapiens
ctgccgcccaggctggagtgcagtggcggtatcatagctcactgaagcctccacctcctgggctcaagtgattgatccttccacctcagcctccctagtagcgggactacaggtgcacgccaccacgcctggctgttatgtattttttgtagacacagggtttcactatgttgcccaggctagtctcgaactcctgggctcaagtgatcctcccaaactgttgggattatgggtgtgagccaccgtgcctggcccccgctggtatctgcgttgtgttcttgcacgttcacagctgttctcaccagagcatccccccatgtggggctttgggtcagataaggcgggaggcctgagagcagctgcctggccgcctccttaagcctctcagccgtgcctctgctctccgccattcctaccccccagcgctgggccccatgggattccgacagggccagccacccgccgactggtgttcggccctctttcctgatggccagccaaggtccgttggagcagcccagtggagttccatgcccaccccctctgggtgccccaccttccccactatgttggaagggcacagtgaggaacacttggcctcagaggagggaatgatgctgcgagattcagcccccttcccacccccgtgtctagctgaagccattggtgtctgctccgctgatcgtcctgatgcccgaggacctgtggaccgtggaaaatgacatgatggtcagctactcttcaacctcggacttccccagcagcccgtgggactggattggactgtacaaggtgatgtggtggcaaggcaggaagtccatcagcgacagcccctggttcatccttcccgagggctcctgggagctgggcagatgctgacgaactcaccctcatccaccccagcggttcttctgtagctaaaggctggcagtgaaggg

SEQ ID NO: 62909 - DNA, 149 bp, Homo sapiens
gggactgagggttactccagttgctctgtgttgcatactctcccccgcaagcctgtgtatgaagaattgtcccctggcttccagcaggccatggctggctgttttgtgactgttacattgtgcaggggtaattattagcgtggctttta

SEQ ID NO: 62910 - DNA, 3571 bp, Homo sapiens
cggccgcacacctcgcgtcgtctggggcagtgttgcgcgtgcgctgatgacaggcccgacacgcccctcttacgtccgcgaacccgtcttcgctcagcctctcgcagctttgcgctcgtgggagagtcccgcctccttctgcgaaccgcaccacccagatcccggggtgcgcggagggcgcgtctctgacggaagccggggcggacggtcggagtccggaagaaaaacagtccgcgacagctaggcgcgtgagaccggccgcccgcaggctgctctggccgggacccgctggccgggagacgcgaacctgccggaccaccgcgcggggacgacggcggccatgagctcgcggaagctgagcgggccgaaaggcaggaggctcagcacatacatcaggaggtctgcctgatcccatggtgaaccccgggaatccgaaatcagattgagataagatcctttagggaagtgacttagcctggtctcttgcctgctctttcacggggaacaacgctaatcgcccacttagtctaagtcacgatgcttggatttgctgctaatcgtcggatttgagagtgggaacaagaaatccggacttttgctctccatcctcttagacatacacgtcgtgacttggaacgtggcttcggcagcgccccctctagatctcagtgacctgcttcagctgaacaaccggaacctcaatcttgacatatatgttattggtttgcaggaattgaactctgggatcataagcctcctttccgatgctgcctttaatgactcgtggagcagtttcctcatggatgtgctttcccctctgagcttcatcaaggtctcccatgtccgtatgcaggggatcctcttactggtctttgccaagtatcagcatttgccctatatccagattctgtctactaaatccacccccactggcctgtttgggtactgggggaacaaaggtggagtcaacatctgcctgaagctttatggctactatgtcagcatcatcaactgccacctgcctccccacatttccaacaattaccagcggctggagcactttgaccggatcctggagatgcagaattgtgaggggcgagacatcccaaacatcctggaccacgacctcattatctggtttggagacatgaactttcggatcgaggactttgggttgcactttgttcgggaatccattaaaaatcggtgctacggtggcctgtgggagaaggaccagctcagcattgccaagaaacatgacccgctgctccgggagttccaggagggccgcctactcttcccgcccacctacaagtttgataggaactccaacgactatgacaccagtgagaaaaaacgcaagcctgcatggaccgatcgcatcctgtggaggctgaagcggcagccctgtgctggccccgacactcccataccgccggcgtcacacttctccttgtctctgaggggctacagcagccacatgacgtacggcatcagcgaccacaagcctgtctccggcacgttcgacttggagctgaagccattggtgtctgctccgctgatcgtcctgatgcccgaggacctgtggaccgtggaaaatgacatgatggtcagctactcttcaacctcggacttccccagcagcccgtgggactggattggactgtacaaggtggggctgcgggacgttaatgactacgtgtcctatgcctgggtcggggacagcaaggtctcctgcagcgacaacctgaaccaggtttacatcgacatcagcaatatccctaccactgaagatgagtttctcctctgttactacagcaacagtctgcgttctgtggtggggataagcagacccttccagatcccgcctggctccttgagggaggacccactgggtgaagcacagccacagatctgagccaggatgggagtgaatcccaggcggaggccagagctggcagccagctctgcctttccactgccgggagtgctgggggcccagcctggccccctgaagagacagccaagtgtcgtccacatactcctcccagagtgagctctaaccaggctcatttgctctctccactactcatctctggaattagccgcttaaatacaggtttttgttgctgagatgtgagtgaaaccagctagtgtgtcaacagtgaagacctggggacagttctgcgtctcatttctggattcctaccccctcttctagtcttgcccaagtagtcctgccaggcacatgccccatttggcacaggcctgcattcttgtcgtgccgtcctgggcctcaggctgtctgggaggggagatgctcacatttgtacaggctacatagactggtgcaagcagtgctggattccaggagtcttggcatctcatagcttgtccccgtgaggagtgagcagagggtctgggatttctgctttcagcaaaagcagtctgactcagtgggcagaatggaggggcccctctagccaggctcttacgccatggttatgagcaggttgatgagggtccttcggccagcacaaccttcctccctactcacggcatggagtctgactgcatggaagttccagatcctgacagagagaactgggaaggatccaggttcgcttccgttggtagcttgagtcccatgcctccaccctgccatctgaggaaggggtgacaagtggtcaaggagctgtggccacagacttttccagggtggtccttggcaggtgaggtgcgtctgtgccacccttgtcaggagccattgacgacgggccccccctggaccccccgggacctcagagtgggggcaggcagaagggagaaccagctcaagacattttggaggatctggccctggggttcttcagagaacaccctctaggggctttggggacatggcctgtccccacatccagcacttgcctccgccatggtcactcggcagcccttttcccaggagaagacacctctgggagcctgctcagtgcttgtcctgccatcctgtgtcctgggactgagggttactccagttgctctgtgttgcatactctcccccgcaagcctgtgtatgaagaattgtcccctggcttccagcaggccatggctggctgttttgtgactgttacattgtgcaggggtaattattagcgtggcttttaaaaaaaaaaaaaaaaaaaaaaaaaaaaaaaaaaaaaaacaaaaaaaaaaaaaaaaaaaaaaaaaaaaaaaaaaaaaaaaaaaaaaaagagagggggggcgcgcgcccaaaaacccccgcgggggggcgcccacacatctcacgcgccgacaccgccgactattcttcgtctgcaacaaggggggcccccacaataagatggggagggacgcgcttttattaaagcacgcaccgagagcgcggcgggcgccggcggtggtatacacacacagaccgagtggagacggtgggagaaaaaacacgttgggacgaacggggggcgatcacttgggtgaggagaagagacgacccctctcttaccttgggggggggggggaacaacataccggtgggcaaacacctacccat

SEQ ID NO: 62911 - DNA, 3231 bp, Homo sapiens
cggccgcacacctcgcgtcgtctggggcagtgttgcgcgtgcgctgatgacaggcccgacacgcccctcttacgtccgcgaacccgtcttcgctcagcctctcgcagctttgcgctcgtgggagagtcccgcctccttctgcgaaccgcaccacccagatcccggggtgcgcggagggcgcgtctctgacggaagccggggcggacggtcggagtccggaagaaaaacagtccgcgacagctaggcgcgtgagaccggccgcccgcaggctgctctggccgggacccgctggccgggagacgcgaacctgccggaccaccgcgcggggacgacggcggccatgagctcgcggaagctgagcgggccgaaaggcaggaggctcagcatacacgtcgtgacttggaacgtggcttcggcagcgccccctctagatctcagtgacctgcttcagctgaacaaccggaacctcaatcttgacatatatgttattgggtctcccatgtccgtatgcaggggatcctcttactggtctttgccaagtatcagcatttgccctatatccagattctgtctactaaatccacccccactggcctgtttgggtactgggggaacaaaggtggagtcaacatctgcctgaagctttatggctactatgtcagcatcatcaactgccacctgcctccccacatttccaacaattaccagcggctggagcactttgaccggatcctggagatgcagaattgtgaggggcgagacatcccaaacatcctggaccacgacctcattatctggtttggagacatgaactttcggatcgaggactttgggttgcactttgttcgggaatccattaaaaatcggtgctacggtggcctgtgggagaaggaccagctcagcattgccaagaaacatgacccgctgctccgggagttccaggagggccgcctactcttcccgcccacctacaagtttgataggaactccaacgactatgacaccagtgagaaaaaacgcaagcctgcatggaccgatcgcatcctgtggaggctgaagcggcagccctgtgctggccccgacactcccataccgccggcgtcacacttctccttgtctctgaggggctacagcagccacatgacgtacggcatcagcgaccacaagcctgtctccggcacgttcgacttggagctgaagccattggtgtctgctccgctgatcgtcctgatgcccgaggacctgtggaccgtggaaaatgacatgatggtcagctactcttcaacctcggacttccccagcagcccgtgggactggattggactgtacaaggtggggctgcgggacgttaatgactacgtgtcctatgcctgggtcggggacagcaaggtctcctgcagcgacaacctgaaccaggtttacatcgacatcagcaatatccctaccactgaagatgagtttctcctctgttactacagcaacagtctgcgttctgtggtggggataagcagacccttccagatcccgcctggctccttgagggaggacccactgggtgaagcacagccacagatctgagccaggatgggagtgaatcccaggcggaggccagagctggcagccagctctgcctttccactgccgggagtgctgggggcccagcctggccccctgaagagacagccaagtgtcgtccacatactcctcccagagtgagctctaaccaggctcatttgctctctccactactcatctctggaattagccgcttaaatacaggtttttgttgctgagatgtgagtgaaaccagctagtgtgtcaacagtgaagacctggggacagttctgcgtctcatttctggattcctaccccctcttctagtcttgcccaagtagtcctgccaggcacatgccccatttggcacaggcctgcattcttgtcgtgccgtcctgggcctcaggctgtctgggaggggagatgctcacatttgtacaggctacatagactggtgcaagcagtgctggattccaggagtcttggcatctcatagcttgtccccgtgaggagtgagcagagggtctgggatttctgctttcagcaaaagcagtctgactcagtgggcagaatggaggggcccctctagccaggctcttacgccatggttatgagcaggttgatgagggtccttcggccagcacaaccttcctccctactcacggcatggagtctgactgcatggaagttccagatcctgacagagagaactgggaaggatccaggttcgcttccgttggtagcttgagtcccatgcctccaccctgccatctgaggaaggggtgacaagtggtcaaggagctgtggccacagacttttccagggtggtccttggcaggtgaggtgcgtctgtgccacccttgtcaggagccattgacgacgggccccccctggaccccccgggacctcagagtgggggcaggcagaagggagaaccagctcaagacattttggaggatctggccctggggttcttcagagaacaccctctaggggctttggggacatggcctgtccccacatccagcacttgcctccgccatggtcactcggcagcccttttcccaggagaagacacctctgggagcctgctcagtgcttgtcctgccatcctgtgtcctgggactgagggttactccagttgctctgtgttgcatactctcccccgcaagcctgtgtatgaagaattgtcccctggcttccagcaggccatggctggctgttttgtgactgttacattgtgcaggggtaattattagcgtggcttttaaaaaaaaaaaaaaaaaaaaaaaaaaaaaaaaaaaaaaacaaaaaaaaaaaaaaaaaaaaaaaaaaaaaaaaaaaaaaaaaaaaaaaagagagggggggcgcgcgcccaaaaacccccgcgggggggcgcccacacatctcacgcgccgacaccgccgactattcttcgtctgcaacaaggggggcccccacaataagatggggagggacgcgcttttattaaagcacgcaccgagagcgcggcgggcgccggcggtggtatacacacacagaccgagtggagacggtgggagaaaaaacacgttgggacgaacggggggcgatcacttgggtgaggagaagagacgacccctctcttaccttgggggggggggggaacaacataccggtgggcaaacacctacccat

SEQ ID NO: 62912 - DNA, 3349 bp, Homo sapiens
cctggtacggtcccgaattcctctgtggatcgcctccttctgcgaaccgcaccacccagatcccggggtgcgcggagggcgcgtctctgacggaagccggggcggacggtcggagtccggaagaaaaacagtccgcgacagctaggcgcgtgagaccggccgcccgcaggctgctctggccgggacccgctggccgggagacgcgaacctgccggaccaccgcgcggggacgacggcggccatgagctcgcggaagctgagcgggccgaaaggcaggaggctcagcatacacgtcgtgacttggaacgtggcttcggcagcgccccctctagatctcagtgacctgcttcagctgaacaaccggaacctcaatcttgacatatatgttattggtttgcaggaattgaactctgggatcataagcctcctttccgatgctgcctttaatgactcgtggagcagtttcctcatggatgtgctttcccctctgagcttcatcaaggtctcccatgtccgtatgcaggggatcctcttactggtctttgccaagtatcagcatttgccctatatccagattctgtctactaaatccacccccactggcctgtttgggtactgggggaacaaaggtggagtcaacatctgcctgaagctttatggctactatgtcagcatcatcaactgccacctgcctccccacatttccaacaattaccagcggctggagcactttgaccggatcctggagatgcagaattgtgaggggcgagacatcccaaacatcctggaccacgacctcattatctggtttggagacatgaactttcggatcgaggactttgggttgcactttgttcgggaatccattaaaaatcggtgctacggtggcctgtgggagaaggaccagctcagcattgccaagaaacatgacccgctgctccgggagttccaggagggccgcctactcttcccgcccacctacaagtttgataggaactccaacgactatgacaccagaaaaacgcaagcctgcatggaccgatcgcatcctgtggaggctgaagcggcagccctgtgctggcccacctacaagtttgataggaactccaacgactatgacaccagtgagaaaaaacgcaagcctgcatggaccgatcgcatcctgtggaggctgaagcggcagccctgtgctggccccgacactcccataccgccggcgtcacacttctccttgtctctgaggggctacagcagccacatgacgtacggcatcagcgaccacaagcctgtctccggcacgttcgacttggagctgaagccattggtgtctgctccgctgatcgtcctgatgcccgaggacctgtggaccgtggaaaatgacatgatggtcagctactcttcaacctcggacttccccagcagcccgtgggactggattggactgtacaaggtggggctgcgggacgttaatgactacgtgtcctatgcctgggtcggggacagcaaggtctcctgcagcgacaacctgaaccaggtttacatcgacatcagcaatatccctaccactgaagatgagtttctcctctgttactacagcaacagtctgcgttctgtggtggggataagcagacccttccagatcccgcctggctccttgagggaggacccactgggtgaagcacagccacagatctgagccaggatgggagtgaatcccaggcggaggccagagctggcagccagctctgcctttccactgccgggagtgctgggggcccagcctggccccctgaagagacagccaagtgtcgtccacatactcctcccagagtgagctctaaccaggctcatttgctctctccactactcatctctggaattagccgcttaaatacaggtttttgttgctgagatgtgagtgaaaccagctagtgtgtcaacagtgaagacctggggacagttctgcgtctcatttctggattcctaccccctcttctagtcttgcccaagtagtcctgccaggcacatgccccatttggcacaggcctgcattcttgtcgtgccgtcctgggcctcaggctgtctgggaggggagatgctcacatttgtacaggctacatagactggtgcaagcagtgctggattccaggagtcttggcatctcatagcttgtccccgtgaggagtgagcagagggtctgggatttctgctttcagcaaaagcagtctgactcagtgggcagaatggaggggcccctctagccaggctcttacgccatggttatgagcaggttgatgagggtccttcggccagcacaaccttcctccctactcacggcatggagtctgactgcatggaagttccagatcctgacagagagaactgggaaggatccaggttcgcttccgttggtagcttgagtcccatgcctccaccctgccatctgaggaaggggtgacaagtggtcaaggagctgtggccacagacttttccagggtggtccttggcaggtgaggtgcgtctgtgccacccttgtcaggagccattgacgacgggccccccctggaccccccgggacctcagagtgggggcaggcagaagggagaaccagctcaagacattttggaggatctggccctggggttcttcagagaacaccctctaggggctttggggacatggcctgtccccacatccagcacttgcctccgccatggtcactcggcagcccttttcccaggagaagacacctctgggagcctgctcagtgcttgtcctgccatcctgtgtcctgggactgagggttactccagttgctctgtgttgcatactctcccccgcaagcctgtgtatgaagaattgtcccctggcttccagcaggccatggctggctgttttgtgactgttacattgtgcaggggtaattattagcgtggcttttaaaaaaaaaaaaaaaaaaaaaaaaaaaaaaaaaaaaaaacaaaaaaaaaaaaaaaaaaaaaaaaaaaaaaaaaaaaaaaaaaaaaaaagagagggggggcgcgcgcccaaaaacccccgcgggggggcgcccacacatctcacgcgccgacaccgccgactattcttcgtctgcaacaaggggggcccccacaataagatggggagggacgcgcttttattaaagcacgcaccgagagcgcggcgggcgccggcggtggtatacacacacagaccgagtggagacggtgggagaaaaaacacgttgggacgaacggggggcgatcacttgggtgaggagaagagacgacccctctcttaccttgggggggggggggaacaacataccggtgggcaaacacctacccat

SEQ ID NO: 62913 - DNA, 2519 bp, Homo sapiens
tcctgtgtatacgacgggctgtgggagctgcatccttgtgagagccgtgtcgtgcaaacattctggaccacaacctcattatctggtttggagacatgaactttcggatcgaggactttgggttgcactttgttcgggaatccattaaaaatcggtgctacggtggcctgtgggagaaggaccagctcagcattgccaagaaacatgacccgctgctccgggagttccaggagggccgcctactcttcccgcccacctacaagtttgataggaactccaacgactatgacaccagtgagaaaaaacgcaagcctgcatggaccgatcgcatcctgtggaggctgaagcggcagccctgtgctggccccgacactcccataccgccggcgtcacacttctccttgtctctgaggggctacagcagccacatgacgtacggcatcagcgaccacaagcctgtctccggcacgttcgacttggagctgaagccattggtgtctgctccgctgatcgtcctgatgcccgaggacctgtggaccgtggaaaatgacatgatggtcagctactcttcaacctcggacttccccagcagcccgtgggactggattggactgtacaaggtggggctgcgggacgttaatgactacgtgtcctatgcctgggtcggggacagcaaggtctcctgcagcgacaacctgaaccaggtttacatcgacatcagcaatatccctaccactgaagatgagtttctcctctgttactacagcaacagtctgcgttctgtggtggggataagcagacccttccagatcccgcctggctccttgagggaggacccactgggtgaagcacagccacagatctgagccaggatgggagtgaatcccaggcggaggccagagctggcagccagctctgcctttccactgccgggagtgctgggggcccagcctggccccctgaagagacagccaagtgtcgtccacatactcctcccagagtgagctctaaccaggctcatttgctctctccactactcatctctggaattagccgcttaaatacaggtttttgttgctgagatgtgagtgaaaccagctagtgtgtcaacagtgaagacctggggacagttctgcgtctcatttctggattcctaccccctcttctagtcttgcccaagtagtcctgccaggcacatgccccatttggcacaggcctgcattcttgtcgtgccgtcctgggcctcaggctgtctgggaggggagatgctcacatttgtacaggctacatagactggtgcaagcagtgctggattccaggagtcttggcatctcatagcttgtccccgtgaggagtgagcagagggtctgggatttctgctttcagcaaaagcagtctgactcagtgggcagaatggaggggcccctctagccaggctcttacgccatggttatgagcaggttgatgagggtccttcggccagcacaaccttcctccctactcacggcatggagtctgactgcatggaagttccagatcctgacagagagaactgggaaggatccaggttcgcttccgttggtagcttgagtcccatgcctccaccctgccatctgaggaaggggtgacaagtggtcaaggagctgtggccacagacttttccagggtggtccttggcaggtgaggtgcgtctgtgccacccttgtcaggagccattgacgacgggccccccctggaccccccgggacctcagagtgggggcaggcagaagggagaaccagctcaagacattttggaggatctggccctggggttcttcagagaacaccctctaggggctttggggacatggcctgtccccacatccagcacttgcctccgccatggtcactcggcagcccttttcccaggagaagacacctctgggagcctgctcagtgcttgtcctgccatcctgtgtcctgggactgagggttactccagttgctctgtgttgcatactctcccccgcaagcctgtgtatgaagaattgtcccctggcttccagcaggccatggctggctgttttgtgactgttacattgtgcaggggtaattattagcgtggcttttaaaaaaaaaaaaaaaaaaaaaaaaaaaaaaaaaaaaaaacaaaaaaaaaaaaaaaaaaaaaaaaaaaaaaaaaaaaaaaaaaaaaaaagagagggggggcgcgcgcccaaaaacccccgcgggggggcgcccacacatctcacgcgccgacaccgccgactattcttcgtctgcaacaaggggggcccccacaataagatggggagggacgcgcttttattaaagcacgcaccgagagcgcggcgggcgccggcggtggtatacacacacagaccgagtggagacggtgggagaaaaaacacgttgggacgaacggggggcgatcacttgggtgaggagaagagacgacccctctcttaccttgggggggggggggaacaacataccggtgggcaaacacctacccat

SEQ ID NO: 62914 - DNA, 1967 bp, Homo sapiens
cccttccaccaccctccaccagcctcccttccaccagcagcccgtgggactggattggactgtacaaggtggggctgcgggacgttaatgactacgtgtcctatgcctgggtcggggacagcaaggtctcctgcagcgacaacctgaaccaggtttacatcgacatcagcaatatccctaccactgaagatgagtttctcctctgttactacagcaacagtctgcgttctgtggtggggataagcagacccttccagatcccgcctggctccttgagggaggacccactgggtgaagcacagccacagatctgagccaggatgggagtgaatcccaggcggaggccagagctggcagccagctctgcctttccactgccgggagtgctgggggcccagcctggccccctgaagagacagccaagtgtcgtccacatactcctcccagagtgagctctaaccaggctcatttgctctctccactactcatctctggaattagccgcttaaatacaggtttttgttgctgagatgtgagtgaaaccagctagtgtgtcaacagtgaagacctggggacagttctgcgtctcatttctggattcctaccccctcttctagtcttgcccaagtagtcctgccaggcacatgccccatttggcacaggcctgcattcttgtcgtgccgtcctgggcctcaggctgtctgggaggggagatgctcacatttgtacaggctacatagactggtgcaagcagtgctggattccaggagtcttggcatctcatagcttgtccccgtgaggagtgagcagagggtctgggatttctgctttcagcaaaagcagtctgactcagtgggcagaatggaggggcccctctagccaggctcttacgccatggttatgagcaggttgatgagggtccttcggccagcacaaccttcctccctactcacggcatggagtctgactgcatggaagttccagatcctgacagagagaactgggaaggatccaggttcgcttccgttggtagcttgagtcccatgcctccaccctgccatctgaggaaggggtgacaagtggtcaaggagctgtggccacagacttttccagggtggtccttggcaggtgaggtgcgtctgtgccacccttgtcaggagccattgacgacgggccccccctggaccccccgggacctcagagtgggggcaggcagaagggagaaccagctcaagacattttggaggatctggccctggggttcttcagagaacaccctctaggggctttggggacatggcctgtccccacatccagcacttgcctccgccatggtcactcggcagcccttttcccaggagaagacacctctgggagcctgctcagtgcttgtcctgccatcctgtgtcctgggactgagggttactccagttgctctgtgttgcatactctcccccgcaagcctgtgtatgaagaattgtcccctggcttccagcaggccatggctggctgttttgtgactgttacattgtgcaggggtaattattagcgtggcttttaaaaaaaaaaaaaaaaaaaaaaaaaaaaaaaaaaaaaaacaaaaaaaaaaaaaaaaaaaaaaaaaaaaaaaaaaaaaaaaaaaaaaaagagagggggggcgcgcgcccaaaaacccccgcgggggggcgcccacacatctcacgcgccgacaccgccgactattcttcgtctgcaacaaggggggcccccacaataagatggggagggacgcgcttttattaaagcacgcaccgagagcgcggcgggcgccggcggtggtatacacacacagaccgagtggagacggtgggagaaaaaacacgttgggacgaacggggggcgatcacttgggtgaggagaagagacgacccctctcttaccttgggggggggggggaacaacataccggtgggcaaacacctacccat

SEQ ID NO: 62915 - DNA, 298 bp, Homo sapiens
ttctagcaccgggatctttgcttctaataccattcttcaataatataaaccagggctctttagagaaatggctgattataggtctgggaagaatatacacaagatgagcctggagcatcttgtgctaaacaggaagtgctaaaaaaaataaaataaatggtggaagtatgtcaaagggacacaggagcaaatcaagagtttttcatggccaaagctaaaacaatttgagcaacaaaatatattaataagtgttgtattataactccaagtataaatagatattcttgcatctatgttg

SEQ ID NO: 62916 - DNA, 608 bp, Homo sapiens
  misc_feature (92)..(92): n is a, c, g, or t
tgccccaagagatatcccccccaccaacccaagagtggaagggagcctctgcttccccccctcacaaagcttaaatcaaaagaataacgcanctttcctatttcaagatattgacttcgtggccagggaaaccacatgttccaaggaaagtaatgaagagttgaccgaaagctgtgagaccaaaaaacttggccaaagcctagattgcaacgctgaagtttatgtggtaccctgggagaaaaaaatttaccctactgtcaactgtcaaccactgggaatgatctcactgatgaaaaggcctccaggtttttcacctttccgatcatcacgaataggggaaataaaagaagaaacaactagtcacctaaggtcctgcgagtacaagggtcgacccccaaaggcaggggcagagccagcatctgagagggaggtctcttgaccaatgggcagaatcttcactccaggcacatagccccaaccacctctgccagcaaccttgagaggaaggacaagaagaaagatgggatagaatttaaatagagaagaatgccattttatcactctgcctctgggtgaaataaagatcagtcttgatgttctaactctaa

SEQ ID NO: 62917 - DNA, 545 bp, Homo sapiens
ccctatagtgcaaagaaagtatatgcttcataaccaatgttgtacttttgcctagaaaaacaagatatggctttaaatagctacaatcatctttggatgtatatgtcactgctgcttcaagttattggatgcatttgaacctctgagtttgtctttcattttaaatattgtctgttcttttaaataaacaaccacagatgtcaggaaaaagtcttaccttgtcaactggttgctccactttttaaaaatgattgaatgataacatcatattaactgcgttttactatacttacagagtcacctaaggtcctgcgagtacaagggtcgacccccaaaggcaggggcagagccagcatctgagagggaggtctcttgaccaatgggcagaatcttcactccaggcacatagccccaaccacctctgccagcaaccttgagaggaaggacaagaagaaagatgggatagaatttaaatagagaagaatgccattttatcactctgcctctgggtgaaataaagatcagtcttgatgttctaactctaa

SEQ ID NO: 62918 - DNA, 196 bp, Homo sapiens
ggaagtcagggggacacactgctggggagatagagagggtctcttgaccagttgtgaggggaactaacttcttgtccagcaaccttgagaggaaggacaagaagaaagatgggatagaatttaaatagagaagaatgccattttatcactctgcctctgggtgaaataaagatcagtcttgatgttctaactctaa

SEQ ID NO: 62919 - DNA, 451 bp, Homo sapiens
gaatgcacagcaaccgtggggaagaggagcagtacgaaattctccgtggctacccagacctgccagattactccagccgagggccctgtggtgacagcccagtacgactgcctcggctgtgtgcatcctatatcaacgcagagcccaggtttttcacctttccgatcatcacgaataggggaaataaaagaagaaacaactagtcacctaaggtcctgcgagtacaagggtcgacccccaaaggcaggggcagagccagcatctgagagggaggtctcttgaccaatgggcagaatcttcactccaggcacatagccccaaccacctctgccagcaaccttgagaggaaggacaagaagaaagatgggatagaatttaaatagagaagaatgccattttatcactctgcctctgggtgaaataaagatcagtcttgatgttctaactctaa

SEQ ID NO: 62920 - DNA, 687 bp, Homo sapiens
  misc_feature (92)..(92): n is a, c, g, or t
  misc_feature (631)..(631): n is a, c, g, or t
tgccccaagagatatcccccccaccaacccaagagtggaagggagcctctgcttccccccctcacaaagcttaaatcaaaagaataacgcanctttcctatttcaagatattgacttcgtggccagggaaaccacatgttccaaggaaagtaatgaagagttgaccgaaagctgtgagaccaaaaaacttggccaaagcctagattgcaacgctgaagtttatgtggtaccctgggagaaaaaaatttaccctactgtcaactgtcaaccactgggaatgatctcactgatgaaaaggcctccaggtttttcacctttccgatcatcacgaataggggaaataaaagaagaaacaactagtcacctaaggtcctgcgagtacaagggtcgacccccaaaggcaggggcagagccagcatctgagagggaggtctcttgaccaatgggcagaatcttcactccaggcacatagccccaaccacctctgccagcaaccttgagaggaaggacaagaagaaagatgggatagaatttaaatagagaagaatgccattttatcactctgcctctgggtgaaataaagatcagtcttgatgttctaactctaagagcatatgaaagcaagtgttanggaggttagagggttaaaatcttctgcaatgggttgtaagaataaaaaaaactcga

SEQ ID NO: 62921 - DNA, 4574 bp, Homo sapiens
gaattccgggagcccgcggaggctgctgcagcagcccgaaccggcgtccgagtccggggaaggcccccgcgagcgcagggaggggccggaaagttccggcgaactgggggagcggcagtgggagagcgtcgggcgggaggcggtggtcctgggagcggccccggcgcccgaagccgccccgagctggtggggagggtcccggccggtggggccgggctggcgggggaggggcgcctgggggtgcaagaggcgaattggctgcccggggtgcaggagggacaggtggtgcgggctgtcaggaaacctacctgaacgggaaggagccccaggagggagagggacccggcgagggctcaggacccggaggcgccggcggaggaggaggtggtgactggcaggcccgggccccacggtacctccggggctgaaggggacgcaggatgtaggggcatggggagtcgggcgcagaagagtgcggggaacgctgagctctgggagccactgcctgagggcaggccgcggccggcgggaacctcttctgccgtctcagcctgggcgtcgctgaagctgtgtctgcggggaggcagcggaaggcggcagaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgtgcccccgagagcctgaagacacgcaccttctcccatgccagcgacacctggatgttcggggtgacactgtgggaaatgttcacctacggccaggagccctggatcggcctcaacggcagtcagatcctgcataagatcgacaaggagggggagcggctgccccggcccgaggactgtccccaggacatctacaacgtcatggtccagtgctgggctcacaagccagaggacagacccacgtttgtggccctgcgggacttcctgctggaggcccagcccacagacatgcgggcccttcaggactttgaggaaccggacaagctgcacatccagatgaatgatgtcatcaccgtcatcgagggaagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgaactgtatctgggaaaccccatggacccccccgacctcctgagcgtggaactgagcacctcccggcccccccagcatctaggaggggtgaaaaaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgcccgcctatgacgacgtggcccaggatgaggatgactttgagatctgctccatcaacagcaccctcgtgggcgcgggggtccctgccgggcccagccagggccagaccaactacgcctttgtgcctgagcaggcgcggccgccccctcccctggaggacaacctgttcctcccgccccagggtgggggcaagccgcccagctccgcacagaccgcagagatcttccaggcgctacagcaggagtgcatgaggcaactgcaggctccggccggctccccggccccctctcccagcccggggggtgacgacaagccccaggtgcctcctcgggtacccatcccccctcggcccacgcgcccacacgtccagctgtctccagcccccccgggcgaggaggagaccagccagtggcctggacctgcttcccctccccgggtgcctccgcgggagcccctgtcccctcaaggctcgaggacacccagccccctggtaccacctggcagctccccgctgccaccccggctctcaagctcacctgggaagaccatgcccaccacccagagctttgcctcagaccccaagtacgccaccccccaggtgatccaggcccctggcccgcgggctggtccctgcatcctgcccatcgtccgggatggcaagaaggtcagcagcacccactattacttgctgcccgagcgaccatcctacctggagcgctaccagcgcttcctgcgtgaggcccagagccccgaggagcctaccgcccctgcctgtgcctctgctgctgcccccacccagcaccccagcccccgccgcccccacggccaccgtgcggccgatgccccaggctgccttggaccccaaggccaacttctccaccaacaacagcaacccaggggcccggccaccacccccgagggccactgctcggctgccacagaggggctgccctggcgatgggccagaggcgggccggccagcagacaagatccagatggccatggtgcatggggtgaccacagaggagtgccaggcggccctgcagtgccacggctggagcgtgcagagggctgcccagtatctgaaggtggagcagctcttcgggctgggtctgcggcccagaggggagtgccacaaagtgctggagatgttcgactggaacctggagcaggccggctgccaccttctgggctcctggggccctgcccaccacaagcgctgagatgcgtctggagagccagagggcctgcctgaaggaatcacctgagcctgtccgtccaccaggagtggggagatgcccccatccagtcctggaggacccgctgctcctgctgctcccggggatggagcaaggccaaggctgcgggaggctgggagccctgccctgcccatccctcccgcaccagcgctgtccctgcacactttggttcagtcccggtgcccctgccaagatgtggaaggggccgggtgaagacaggcttgagggctgccccagcaggctctgggtatgacctgcctctggccctggtcctgggcggggcctgtgggtggagtagtacccccaggccctgccctgggtgacagactgggaggaaaccaggctggacctgggcaggcgggatgtgttggccacagggagaggcggaccggcacccggtgggacctcctaggactgggccttcttccagggggcccctggcagcagctggggtgtcgggcagaatgtgacttgtggccttaccatggacttgaatgggacttggctggcctcaggatcttgtgcctggaaatagcctgaggtggctcaggaagcggagaaagggtgccagaccattctctggcggggaccagggcccaaggccccagggctggaaggagaccaaggggcagccgccctggagggacatcagtgcttcctcttccacccaattcccccacgcggttccatgttttcccaccagcctgttggcgaagttgctgctccggcattcagtacctgcttcttccagagaaataaagttagtttctattttatgttaaaaaacaaaaaaagtcgacga

SEQ ID NO: 62922 - DNA, 1935 bp, Homo sapiens
ggcacgagggagagagaacctggagcaggccggctgccaccttctgggctcctggggccctgcccaccacaagcgctgagatgcgtctggagagccagagggcctgcctgaaggaatcacctgagcctgtccgtccaccaggagtggggagatgcccccatccagtcctggaggacccgctgctcctgctgctcccggggatggagcaaggccaaggctgcgggaggctgggagccctgccctgcccatccctcccgcaccagcgctgtccctgcacatcttggcaggggcacgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtg

SEQ ID NO: 62923 - DNA, 2166 bp, Homo sapiens
  misc_feature (922)..(922): n is a, c, g, or t
  misc_feature (1489)..(1489): n is a, c, g, or t
tgtcttcagtgaaatgataccggtccccactgcccagctcacctcccggggctgcaggaggcaccggagataatggctgtagagggtcttgtaacctgaacattgcttgcaaacataaggaattctagttactgggaggaagcacagggcagaggccagaagaggccctcagatttgaggcaccctagcccagacggataaggatccaccagctctgggggcgtgagacccaagctggcaagaatctgcaatctggagccaaggctgtgggtgcctcagtggaggccgagtcagaccgacgtggccagctttgaccctcatggcctcctttcttctgtcccttgaccttcggctcctccctgtccaccctggcctccgagtctcctccacttttccttccgtctcagccctcagctctaggcgcccctccagagacccagctgtcttcccaggccccttcccagcaaggactagcttcatctgaaccacacacacactcacggttcaacctcagactaaaattatcctctcccctgggcaggatgaagggcagccgactccctggtgagggtggagacagacagcaccaaatggtcaggccagagaaggggccagggctaaaaatggacaaggaggtgtctgtggagggcccctgcggctccatcgatgcgggttagggctggagtctgcggggtggcgggtgcaggaagggagggtggggcaggactgggaggagactccgaccttggctgggcggtgccctccctctccacacagctgggtgtggggccgctcagccacaggctgcatgcctgtcggtctctttctggcaccctccttgaggccagcatcaggctttgggttcatgtttgggggtgtgccctggacggagtgtgggcctccagccaggctgccccactgncagtttggcaaaaccaggacctatctggaagccgaagccggggatcaccaggtggacccagcggggtgggactgagtgactgaccctggggtgttggattccatctggcccccggctgccttcaaacaggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagctctctgtgtcctgccagcgcagcagaggcatgggacccggggctggtagtggctcttctgcccccaaccagggtgtggatgggactggggatgcgtcacagtgtggctcatcccagagtccgtgctcaggatttttggggttttatttatttatttatttttgagatggagtctcgctctgtcgcccaggctggagtgcagtaggcacgntctcggcttcctgcaacctccactttccgggttcaagcaatcctcctgcctcagcctcctgagtagctgggattacaggcatgcaccaccacactcagttaatttttgtatttttagtagagacggggtttcaccatgttggccaggctggtctcgaactcctgacctcagatgatctgcccactttagcctcccaaagtgcttggattacaggtgtgagccaccacgtccagcccatgctcaggtttaactaagcacatttattatttcaactataaaaataatttattataaaagtttggaaagtatttgaaaaacaagaaaaaaaaaatcgcctgtaatcccaccactcagaggaagccgagcctcttcctcccactttaggtattttgttggatttagttaagatacaaattctggatacagcttttaaaatcttgttctttcttctcggcgttgcatttaacattttcccctcagggataacgtgtcaccacagcatacagttctggtgtgactgtttcctgtgcagcagccgtgtccttactgctcagatcacgtgcggtgcattcccagcacctcagagggctcctcattctccgtccactcagtgcgtccttctcccggggaagccgctgtcactcagtgcatccttctcccggggaagccgctgtgca

SEQ ID NO: 62924 - DNA, 4352 bp, Homo sapiens
gcagttgggtggggaagccggggagtagggctggactgtgaccactgccctggagagaagacatgaaacaggacagaggatcccggctgcagccagcgtgaggaaagctctgctccctgccagaccggccagctgtggaaacccagcggggcttgcagcagagcggaggggcccaccccgttcttcctcatttcccacccctggtgtgggatttggggggctcctgggcagagtgcgaagctccggagccgaggccactggatccccagtgactgctcgggggggtcccgctgcgtggagatgccggcagcacgtcggttccctggcctggagctctccttccctctcctggccagactgcggcgacgcctgtacacaaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgtgcccccgagagcctgaagacacgcaccttctcccatgccagcgacacctggatgttcggggtgacactgtgggaaatgttcacctacggccaggagccctggatcggcctcaacggcagtcagatcctgcataagatcgacaaggagggggagcggctgccccggcccgaggactgtccccaggacatctacaacgtcatggtccagtgctgggctcacaagccagaggacagacccacgtttgtggccctgcgggacttcctgctggaggcccagcccacagacatgcgggcccttcaggactttgaggaaccggacaagctgcacatccagatgaatgatgtcatcaccgtcatcgagggaagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgaactgtatctgggaaaccccatggacccccccgacctcctgagcgtggaactgagcacctcccggcccccccagcatctaggaggggtgaaaaaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgcccgcctatgacgacgtggcccaggatgaggatgactttgagatctgctccatcaacagcaccctcgtgggcgcgggggtccctgccgggcccagccagggccagaccaactacgcctttgtgcctgagcaggcgcggccgccccctcccctggaggacaacctgttcctcccgccccagggtgggggcaagccgcccagctccgcacagaccgcagagatcttccaggcgctacagcaggagtgcatgaggcaactgcaggctccggccggctccccggccccctctcccagcccggggggtgacgacaagccccaggtgcctcctcgggtacccatcccccctcggcccacgcgcccacacgtccagctgtctccagcccccccgggcgaggaggagaccagccagtggcctggacctgcttcccctccccgggtgcctccgcgggagcccctgtcccctcaaggctcgaggacacccagccccctggtaccacctggcagctccccgctgccaccccggctctcaagctcacctgggaagaccatgcccaccacccagagctttgcctcagaccccaagtacgccaccccccaggtgatccaggcccctggcccgcgggctggtccctgcatcctgcccatcgtccgggatggcaagaaggtcagcagcacccactattacttgctgcccgagcgaccatcctacctggagcgctaccagcgcttcctgcgtgaggcccagagccccgaggagcctaccgcccctgcctgtgcctctgctgctgcccccacccagcaccccagcccccgccgcccccacggccaccgtgcggccgatgccccaggctgccttggaccccaaggccaacttctccaccaacaacagcaacccaggggcccggccaccacccccgagggccactgctcggctgccacagaggggctgccctggcgatgggccagaggcgggccggccagcagacaagatccagatggccatggtgcatggggtgaccacagaggagtgccaggcggccctgcagtgccacggctggagcgtgcagagggctgcccagtatctgaaggtggagcagctcttcgggctgggtctgcggcccagaggggagtgccacaaagtgctggagatgttcgactggaacctggagcaggccggctgccaccttctgggctcctggggccctgcccaccacaagcgctgagatgcgtctggagagccagagggcctgcctgaaggaatcacctgagcctgtccgtccaccaggagtggggagatgcccccatccagtcctggaggacccgctgctcctgctgctcccggggatggagcaaggccaaggctgcgggaggctgggagccctgccctgcccatccctcccgcaccagcgctgtccctgcacactttggttcagtcccggtgcccctgccaagatgtggaaggggccgggtgaagacaggcttgagggctgccccagcaggctctgggtatgacctgcctctggccctggtcctgggcggggcctgtgggtggagtagtacccccaggccctgccctgggtgacagactgggaggaaaccaggctggacctgggcaggcgggatgtgttggccacagggagaggcggaccggcacccggtgggacctcctaggactgggccttcttccagggggcccctggcagcagctggggtgtcgggcagaatgtgacttgtggccttaccatggacttgaatgggacttggctggcctcaggatcttgtgcctggaaatagcctgaggtggctcaggaagcggagaaagggtgccagaccattctctggcggggaccagggcccaaggccccagggctggaaggagaccaaggggcagccgccctggagggacatcagtgcttcctcttccacccaattcccccacgcggttccatgttttcccaccagcctgttggcgaagttgctgctccggcattcagtacctgcttcttccagagaaataaagttagtttctattttatgttaaaaaacaaaaaaagtcgacga

SEQ ID NO: 62925 - DNA, 4525 bp, Homo sapiens
gcagttgggtggggaagccggggagtagggctggactgtgaccactgccctggagagaagacatgaaacaggacagaggatcccggctgcagccagcgtgaggaaagctctgctccctgccagaccggccagctgtggaaacccagcggggcttgcagcagagcggaggggcccaccccgttcttcctcatttcccacccctggtgtgggatttggggggctcctgggcagagtgcgaagctccggagccgaggccactggatccccagtgactgctcgggggggtcccgctgcgtggagatgccggcagcacgtcggttccctggcctggagctctccttccctctcctggccagactgcggcgacgcctgtacacaaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgtgcccccgagagcctgaagacacgcaccttctcccatgccagcgacacctggatgttcggggtgacactgtgggaaatgttcacctacggccaggagccctggatcggcctcaacggcagtcagatcctgcataagatcgacaaggagggggagcggctgccccggcccgaggactgtccccaggacatctacaacgtcatggtccagtgctgggctcacaagccagaggacagacccacgtttgtggccctgcgggacttcctgctggaggcccagcccacagacatgcgggcccttcaggactttgaggaaccggacaagctgcacatccagatgaatgatgtcatcaccgtcatcgagggaagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgagacaccccccagctgagacgtgcggtcaggttctgtggactgggaggcgggaggcctgtgcttcagacccaagactacacccggtttcctccaggacgaaggggctctgatgagattctgccacccctccacacgcttcccctgctctcttgacccagctctctcccccacagactgtatctgggaaaccccatggacccccccgacctcctgagcgtggaactgagcacctcccggcccccccagcatctaggaggggtgaaaaaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgcccgcctatgacgacgtggcccaggatgaggatgactttgagatctgctccatcaacagcaccctcgtgggcgcgggggtccctgccgggcccagccagggccagaccaactacgcctttgtgcctgagcaggcgcggccgccccctcccctggaggacaacctgttcctcccgccccagggtgggggcaagccgcccagctccgcacagaccgcagagatcttccaggcgctacagcaggagtgcatgaggcaactgcaggctccggccggctccccggccccctctcccagcccggggggtgacgacaagccccaggtgcctcctcgggtacccatcccccctcggcccacgcgcccacacgtccagctgtctccagcccccccgggcgaggaggagaccagccagtggcctggacctgcttcccctccccgggtgcctccgcgggagcccctgtcccctcaaggctcgaggacacccagccccctggtaccacctggcagctccccgctgccaccccggctctcaagctcacctgggaagaccatgcccaccacccagagctttgcctcagaccccaagtacgccaccccccaggtgatccaggcccctggcccgcgggctggtccctgcatcctgcccatcgtccgggatggcaagaaggtcagcagcacccactattacttgctgcccgagcgaccatcctacctggagcgctaccagcgcttcctgcgtgaggcccagagccccgaggagcctaccgcccctgcctgtgcctctgctgctgcccccacccagcaccccagcccccgccgcccccacggccaccgtgcggccgatgccccaggctgccttggaccccaaggccaacttctccaccaacaacagcaacccaggggcccggccaccacccccgagggccactgctcggctgccacagaggggctgccctggcgatgggccagaggcgggccggccagcagacaagatccagatggccatggtgcatggggtgaccacagaggagtgccaggcggccctgcagtgccacggctggagcgtgcagagggctgcccagtatctgaaggtggagcagctcttcgggctgggtctgcggcccagaggggagtgccacaaagtgctggagatgttcgactggaacctggagcaggccggctgccaccttctgggctcctggggccctgcccaccacaagcgctgagatgcgtctggagagccagagggcctgcctgaaggaatcacctgagcctgtccgtccaccaggagtggggagatgcccccatccagtcctggaggacccgctgctcctgctgctcccggggatggagcaaggccaaggctgcgggaggctgggagccctgccctgcccatccctcccgcaccagcgctgtccctgcacactttggttcagtcccggtgcccctgccaagatgtggaaggggccgggtgaagacaggcttgagggctgccccagcaggctctgggtatgacctgcctctggccctggtcctgggcggggcctgtgggtggagtagtacccccaggccctgccctgggtgacagactgggaggaaaccaggctggacctgggcaggcgggatgtgttggccacagggagaggcggaccggcacccggtgggacctcctaggactgggccttcttccagggggcccctggcagcagctggggtgtcgggcagaatgtgacttgtggccttaccatggacttgaatgggacttggctggcctcaggatcttgtgcctggaaatagcctgaggtggctcaggaagcggagaaagggtgccagaccattctctggcggggaccagggcccaaggccccagggctggaaggagaccaaggggcagccgccctggagggacatcagtgcttcctcttccacccaattcccccacgcggttccatgttttcccaccagcctgttggcgaagttgctgctccggcattcagtacctgcttcttccagagaaataaagttagtttctattttatgttaaaaaacaaaaaaagtcgacga

SEQ ID NO: 62926 - DNA, 4264 bp, Homo sapiens
gcagttgggtggggaagccggggagtagggctggactgtgaccactgccctggagagaagacatgaaacaggacagaggatcccggctgcagccagcgtgaggaaagctctgctccctgccagaccggccagctgtggaaacccagcggggcttgcagcagagcggaggggcccaccccgttcttcctcatttcccacccctggtgtgggatttggggggctcctgggcagagtgcgaagctccggagccgaggccactggatccccagtgactgctcgggggggtcccgctgcgtggagatgccggcagcacgtcggttccctggcctggagctctccttccctctcctggccagactgcggcgacgcctgtacacaaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgtgcccccgagagcctgaagacacgcaccttctcccatgccagcgacacctggatgttcggggtgacactgtgggaaatgttcacctacggccaggagccctggatcggcctcaacggcagtcagatcctgcataagatcgacaaggagggggagcggctgccccggcccgaggactgtccccaggacatctacaacgtcatggtccagtgctgggctcacaagccagaggacagacccacgtttgtggccctgcgggacttcctgctggaggcccagcccacagacatgcgggcccttcaggactttgaggaaccggacaagctgcacatccagatgaatgatgtcatcaccgtcatcgagggaagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgaactgtatctgggaaaccccatggacccccccgacctcctgagcgtggaactgagcacctcccggcccccccagcatctaggaggggtgaaaaaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgcccgcctatgacgacgtggcccaggatgaggatgactttgagatctgctccatcaacagcaccctcgtgggcgcgggggtccctgccgggcccagccagggccagaccaactacgcctttgtgcctgagcaggcgcggccgccccctcccctggaggacaacctgttcctcccgccccagggtgggggcaagccgcccagctccgcacagaccgcagagatcttccaggcgctacagcaggagtgcatgaggcaactgcaggctccggccggctccccggccccctctcccagcccggggggtgacgacaagccccaggtgcctcctcgggtacccatcccccctcggcccacgcgcccacacgtccagctgtctccagcccccccgggcgaggaggagaccagccagtggcctggacctgcttcccctccccgggtgcctccgcgggagcccctgtcccctcaaggctcgaggacacccagccccctggtaccacctggcagctccccgctgccaccccggctctcaagctcactggtccctgcatcctgcccatcgtccgggatggcaagaaggtcagcagcacccactattacttgctgcccgagcgaccatcctacctggagcgctaccagcgcttcctgcgtgaggcccagagccccgaggagcctaccgcccctgcctgtgcctctgctgctgcccccacccagcaccccagcccccgccgcccccacggccaccgtgcggccgatgccccaggctgccttggaccccaaggccaacttctccaccaacaacagcaacccaggggcccggccaccacccccgagggccactgctcggctgccacagaggggctgccctggcgatgggccagaggcgggccggccagcagacaagatccagatggccatggtgcatggggtgaccacagaggagtgccaggcggccctgcagtgccacggctggagcgtgcagagggctgcccagtatctgaaggtggagcagctcttcgggctgggtctgcggcccagaggggagtgccacaaagtgctggagatgttcgactggaacctggagcaggccggctgccaccttctgggctcctggggccctgcccaccacaagcgctgagatgcgtctggagagccagagggcctgcctgaaggaatcacctgagcctgtccgtccaccaggagtggggagatgcccccatccagtcctggaggacccgctgctcctgctgctcccggggatggagcaaggccaaggctgcgggaggctgggagccctgccctgcccatccctcccgcaccagcgctgtccctgcacactttggttcagtcccggtgcccctgccaagatgtggaaggggccgggtgaagacaggcttgagggctgccccagcaggctctgggtatgacctgcctctggccctggtcctgggcggggcctgtgggtggagtagtacccccaggccctgccctgggtgacagactgggaggaaaccaggctggacctgggcaggcgggatgtgttggccacagggagaggcggaccggcacccggtgggacctcctaggactgggccttcttccagggggcccctggcagcagctggggtgtcgggcagaatgtgacttgtggccttaccatggacttgaatgggacttggctggcctcaggatcttgtgcctggaaatagcctgaggtggctcaggaagcggagaaagggtgccagaccattctctggcggggaccagggcccaaggccccagggctggaaggagaccaaggggcagccgccctggagggacatcagtgcttcctcttccacccaattcccccacgcggttccatgttttcccaccagcctgttggcgaagttgctgctccggcattcagtacctgcttcttccagagaaataaagttagtttctattttatgttaaaaaacaaaaaaagtcgacga

SEQ ID NO: 62927 - DNA, 4045 bp, Homo sapiens
gcagttgggtggggaagccggggagtagggctggactgtgaccactgccctggagagaagacatgaaacaggacagaggatcccggctgcagccagcgtgaggaaagctctgctccctgccagaccggccagctgtggaaacccagcggggcttgcagcagagcggaggggcccaccccgttcttcctcatttcccacccctggtgtgggatttggggggctcctgggcagagtgcgaagctccggagccgaggccactggatccccagtgactgctcgggggggtcccgctgcgtggagatgccggcagcacgtcggttccctggcctggagctctccttccctctcctggccagactgcggcgacgcctgtacacaaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgtgcccccgagagcctgaagacacgcaccttctcccatgccagcgacacctggatgttcggggtgacactgtgggaaatgttcacctacggccaggagccctggatcggcctcaacggcagtcagatcctgcataagatcgacaaggagggggagcggctgccccggcccgaggactgtccccaggacatctacaacgtcatggtccagtgctgggctcacaagccagaggacagacccacgtttgtggccctgcgggacttcctgctggaggcccagcccacagacatgcgggcccttcaggactttgaggaaccggacaagctgcacatccagatgaatgatgtcatcaccgtcatcgagggaagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgaactgtatctgggaaaccccatggacccccccgacctcctgagcgtggaactgagcacctcccggcccccccagcatctaggaggggtgaaaaaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgcccgcctatgacgacgtggcccaggatgaggatgactttgagatctgctccatcaacagcaccctcgtgggcgcgggggtccctgccgggcccagccagggccagaccaactacgcctttgtgcctgagcaggcgcggccgccccctcccctggaggacaacctgttcctcccgccccagggtgggggcaagccgcccagctccgcacagaccgcagagatcttccaggcgctacagcaggagtgcatgaggcaactgcaggctccggccggctccccggccccctccaggtgatccaggcccctggcccgcgggctggtccctgcatcctgcccatcgtccgggatggcaagaaggtcagcagcacccactattacttgctgcccgagcgaccatcctacctggagcgctaccagcgcttcctgcgtgaggcccagagccccgaggagcctaccgcccctgcctgtgcctctgctgctgcccccacccagcaccccagcccccgccgcccccacggccaccgtgcggccgatgccccaggctgccttggaccccaaggccaacttctccaccaacaacagcaacccaggggcccggccaccacccccgagggccactgctcggctgccacagaggggctgccctggcgatgggccagaggcgggccggccagcagacaagatccagatggccatggtgcatggggtgaccacagaggagtgccaggcggccctgcagtgccacggctggagcgtgcagagggctgcccagtatctgaaggtggagcagctcttcgggctgggtctgcggcccagaggggagtgccacaaagtgctggagatgttcgactggaacctggagcaggccggctgccaccttctgggctcctggggccctgcccaccacaagcgctgagatgcgtctggagagccagagggcctgcctgaaggaatcacctgagcctgtccgtccaccaggagtggggagatgcccccatccagtcctggaggacccgctgctcctgctgctcccggggatggagcaaggccaaggctgcgggaggctgggagccctgccctgcccatccctcccgcaccagcgctgtccctgcacactttggttcagtcccggtgcccctgccaagatgtggaaggggccgggtgaagacaggcttgagggctgccccagcaggctctgggtatgacctgcctctggccctggtcctgggcggggcctgtgggtggagtagtacccccaggccctgccctgggtgacagactgggaggaaaccaggctggacctgggcaggcgggatgtgttggccacagggagaggcggaccggcacccggtgggacctcctaggactgggccttcttccagggggcccctggcagcagctggggtgtcgggcagaatgtgacttgtggccttaccatggacttgaatgggacttggctggcctcaggatcttgtgcctggaaatagcctgaggtggctcaggaagcggagaaagggtgccagaccattctctggcggggaccagggcccaaggccccagggctggaaggagaccaaggggcagccgccctggagggacatcagtgcttcctcttccacccaattcccccacgcggttccatgttttcccaccagcctgttggcgaagttgctgctccggcattcagtacctgcttcttccagagaaataaagttagtttctattttatgttaaaaaacaaaaaaagtcgacga

SEQ ID NO: 62928 - DNA, 3306 bp, Homo sapiens
gcggtggagggagggactgagttgcccgagtgctcctagactctcccgcgtctgcattcgggaggcaggttgtagctggaggcctggcccccagcctagtgcaaggccctaggtgtcccccggcacccccgcacctctcagaactcctggaacccagccgaggagtgaaatcaagtggccagaagaggactggggccccggccttgccagggaactgaggggtgaggaggaggtgtgggcggggcgctggccccacagacctgaaagctggcgttgggtcccaggtctgctgggatctttctggtaaccgtggacaggtcatgttgcctgctgcagcagcttccagcgtgcctccttatttgcaaaccatagggaaagctgcctgacccacctagagagttgtgggtaaggccgtgtgcaaacaggcctgtacggggcatggtgggtcacgggggctgttggggaggagggccggtggcacacagcctggtcctgaggcctgagctccatcccccttctgccacagtggccagggtgtgaggagggtcccagtgccggggctgccccgccacgcctggcgttcaccgtgccatctctgtcgcgcagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgaactgtatctgggaaaccccatggacccccccgacctcctgagcgtggaactgagcacctcccggcccccccagcatctaggaggggtgaaaaaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgcccgcctatgacgacgtggcccaggatgaggatgactttgagatctgctccatcaacagcaccctcgtgggcgcgggggtccctgccgggcccagccagggccagaccaactacgcctttgtgcctgagcaggcgcggccgccccctcccctggaggacaacctgttcctcccgccccagggtgggggcaagccgcccagctccgcacagaccgcagagatcttccaggcgctacagcaggagtgcatgaggcaactgcaggctccggccggctccccggccccctctcccagcccggggggtgacgacaagccccaggtgcctcctcgggtacccatcccccctcggcccacgcgcccacacgtccagctgtctccagcccccccgggcgaggaggagaccagccagtggcctggacctgcttcccctccccgggtgcctccgcgggagcccctgtcccctcaaggctcgaggacacccagccccctggtaccacctggcagctccccgctgccaccccggctctcaagctcacctgggaagaccatgcccaccacccagagctttgcctcagaccccaagtacgccaccccccaggtgatccaggcccctggcccgcgggctggtccctgcatcctgcccatcgtccgggatggcaagaaggtcagcagcacccactattacttgctgcccgagcgaccatcctacctggagcgctaccagcgcttcctgcgtgaggcccagagccccgaggagcctaccgcccctgcctgtgcctctgctgctgcccccacccagcaccccagcccccgccgcccccacggccaccgtgcggccgatgccccaggctgccttggaccccaaggccaacttctccaccaacaacagcaacccaggggcccggccaccacccccgagggccactgctcggctgccacagaggggctgccctggcgatgggccagaggcgggccggccagcagacaagatccagatggccatggtgcatggggtgaccacagaggagtgccaggcggccctgcagtgccacggctggagcgtgcagagggctgcccagtatctgaaggtggagcagctcttcgggctgggtctgcggcccagaggggagtgccacaaagtgctggagatgttcgactggaacctggagcaggccggctgccaccttctgggctcctggggccctgcccaccacaagcgctgagatgcgtctggagagccagagggcctgcctgaaggaatcacctgagcctgtccgtccaccaggagtggggagatgcccccatccagtcctggaggacccgctgctcctgctgctcccggggatggagcaaggccaaggctgcgggaggctgggagccctgccctgcccatccctcccgcaccagcgctgtccctgcacactttggttcagtcccggtgcccctgccaagatgtggaaggggccgggtgaagacaggcttgagggctgccccagcaggctctgggtatgacctgcctctggccctggtcctgggcggggcctgtgggtggagtagtacccccaggccctgccctgggtgacagactgggaggaaaccaggctggacctgggcaggcgggatgtgttggccacagggagaggcggaccggcacccggtgggacctcctaggactgggccttcttccagggggcccctggcagcagctggggtgtcgggcagaatgtgacttgtggccttaccatggacttgaatgggacttggctggcctcaggatcttgtgcctggaaatagcctgaggtggctcaggaagcggagaaagggtgccagaccattctctggcggggaccagggcccaaggccccagggctggaaggagaccaaggggcagccgccctggagggacatcagtgcttcctcttccacccaattcccccacgcggttccatgttttcccaccagcctgttggcgaagttgctgctccggcattcagtacctgcttcttccagagaaataaagttagtttctattttatgttaaaaaacaaaaaaagtcgacga

SEQ ID NO: 62929 - DNA, 4329 bp, Homo sapiens
gcagttgggtggggaagccggggagtagggctggactgtgaccactgccctggagagaagacatgaaacaggacagaggatcccggctgcagccagcgtgaggaaagctctgctccctgccagaccggccagctgtggaaacccagcggggcttgcagcagagcggaggggcccaccccgttcttcctcatttcccacccctggtgtgggatttggggggctcctgggcagagtgcgaagctccggagccgaggccactggatccccagtgactgctcgggggggtcccgctgcgtggagatgccggcagcacgtcggttccctggcctggagctctccttccctctcctggccagactgcggcgacgcctgtacacaaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgtgcccccgagagcctgaagacacgcaccttctcccatgccagcgacacctggatgttcggggtgacactgtgggaaatgttcacctacggccaggagccctggatcggcctcaacggcagtcagatcctgcataagatcgacaaggagggggagcggctgccccggcccgaggactgtccccaggacatctacaacgtcatggtccagtgctgggctcacaagccagaggacagacccacgtttgtggccctgcgggacttcctgctggaggcccagcccacagacatgcgggcccttcaggactttgaggaaccggacaagctgcacatccagatgaatgatgtcatcaccgtcatcgagggaagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgaactgtatctgggaaaccccatggacccccccgacctcctgagcgtggaactgagcacctcccggcccccccagcatctaggaggggtgaaaaaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgcccgcctatgacgacgtggcccaggatgaggatgactttgagatctgctccatcaacagcaccctcgtgggcgcgggggtccctgccgggcccagccagggccagaccaactacgcctttgtgcctgagcaggcgcggccgccccctcccctggaggacaacctgttcctcccgccccagggtgggggcaagccgcccagctccgcacagaccgcagagatcttccaggcgctacagcaggagtgcatgaggcaactgcaggctccggccggctccccggccccctctcccagcccggggggtgacgacaagccccaggtgcctcctcgggtacccatcccccctcggcccacgcgcccacacgtccagctgtctccagcccccccgggcgaggaggagaccagccagtggcctggacctgcttcccctccccgggtgcctccgcgggagcccctgtcccctcaaggctcgaggacacccagccccctggtaccacctggcagctccccgctgccaccccggctctcaagctcacctgggaagaccatgcccaccacccagagctttgcctcagaccccaagtacgccaccccccaggtgatccaggcccctggcccgcgggctggtccctgcatcctgcccatcgtccgggatggcaagaaggtcagcagcacccactattacttgctgcccgagcgaccatcctacctggagcgctaccagcgcttcctgcgtgaggcccagagccccgaggagcctaccgcccctgcctgtgcctctgctgctgcccccacccagcaccccagcccccgccgcccccacggccaccgtgcggccgatgccccaggctgccttggaccccaaggccaacttctccaccaacaacagcaacccaggggcccggccaccacccccgagggccactgctcggctgccacagaggggctgccctggcgatgggccagaggcgggccggccagcagacaagatccagatggccatggtgcatggggtgaccacagaggagtgccaggcggccctgcagtgccacggctggagcgtgcagagggctgcccagtatctgaaggtggagcagctcttcgggctgggtctgcggcccagaggggagtgccacaaagtgctggagatgttcgactggaacctggagcaggccggctgccaccttctgggctcctggggccctgcccaccacaagcgctgagatgcgtctggagagccagagggcctgcctgaaggaatcacctgagcctgtccgtccaccaggagtggggagatgcccccatccagtcctggaggacccgctgctcctgctgctcccggggatggagcaaggccaaggctgcgggaggctgggagccctgccctgcccatccctcccgcaccagcgctgtccctgcacactttggttcagtcccggtgcccctgccaagatgtggaaggggccgggtgaagacaggcttgagggctgccccagcaggctctgggtatgacctgcctctggccctggtcctgggcggggcctgtgggtggagtagtacccccaggccctgccctgggtgacagactgggaggaaaccaggctggacctgggcaggcgggatgtgttggccacagggagaggcggaccggcacccggtgggacctcctaggactgggccttcttccagggggcccctggcagcagctggggtgtcgggcagaatgtgacttgtggccttaccatggacttgaatgggacttggctggcctcaggatcttgtgcctggaaatagcctgaggtggctcaggaagcggagaaagggtgccagaccattctctggcggggaccagggcccaaggccccagggctggaaggagaccaaggggcagccgccctggagggacatcagtgcttcctcttccacccaattcccccacgcggttccatgttttcccaccagcctgttggcgaagttgctgctccggcattcagtacctgcttcttccagagaggagtagagcaaccggtgaccgacc

SEQ ID NO: 62930 - DNA, 3479 bp, Homo sapiens
gcggtggagggagggactgagttgcccgagtgctcctagactctcccgcgtctgcattcgggaggcaggttgtagctggaggcctggcccccagcctagtgcaaggccctaggtgtcccccggcacccccgcacctctcagaactcctggaacccagccgaggagtgaaatcaagtggccagaagaggactggggccccggccttgccagggaactgaggggtgaggaggaggtgtgggcggggcgctggccccacagacctgaaagctggcgttgggtcccaggtctgctgggatctttctggtaaccgtggacaggtcatgttgcctgctgcagcagcttccagcgtgcctccttatttgcaaaccatagggaaagctgcctgacccacctagagagttgtgggtaaggccgtgtgcaaacaggcctgtacggggcatggtgggtcacgggggctgttggggaggagggccggtggcacacagcctggtcctgaggcctgagctccatcccccttctgccacagtggccagggtgtgaggagggtcccagtgccggggctgccccgccacgcctggcgttcaccgtgccatctctgtcgcgcagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgagacaccccccagctgagacgtgcggtcaggttctgtggactgggaggcgggaggcctgtgcttcagacccaagactacacccggtttcctccaggacgaaggggctctgatgagattctgccacccctccacacgcttcccctgctctcttgacccagctctctcccccacagactgtatctgggaaaccccatggacccccccgacctcctgagcgtggaactgagcacctcccggcccccccagcatctaggaggggtgaaaaaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgcccgcctatgacgacgtggcccaggatgaggatgactttgagatctgctccatcaacagcaccctcgtgggcgcgggggtccctgccgggcccagccagggccagaccaactacgcctttgtgcctgagcaggcgcggccgccccctcccctggaggacaacctgttcctcccgccccagggtgggggcaagccgcccagctccgcacagaccgcagagatcttccaggcgctacagcaggagtgcatgaggcaactgcaggctccggccggctccccggccccctctcccagcccggggggtgacgacaagccccaggtgcctcctcgggtacccatcccccctcggcccacgcgcccacacgtccagctgtctccagcccccccgggcgaggaggagaccagccagtggcctggacctgcttcccctccccgggtgcctccgcgggagcccctgtcccctcaaggctcgaggacacccagccccctggtaccacctggcagctccccgctgccaccccggctctcaagctcacctgggaagaccatgcccaccacccagagctttgcctcagaccccaagtacgccaccccccaggtgatccaggcccctggcccgcgggctggtccctgcatcctgcccatcgtccgggatggcaagaaggtcagcagcacccactattacttgctgcccgagcgaccatcctacctggagcgctaccagcgcttcctgcgtgaggcccagagccccgaggagcctaccgcccctgcctgtgcctctgctgctgcccccacccagcaccccagcccccgccgcccccacggccaccgtgcggccgatgccccaggctgccttggaccccaaggccaacttctccaccaacaacagcaacccaggggcccggccaccacccccgagggccactgctcggctgccacagaggggctgccctggcgatgggccagaggcgggccggccagcagacaagatccagatggccatggtgcatggggtgaccacagaggagtgccaggcggccctgcagtgccacggctggagcgtgcagagggctgcccagtatctgaaggtggagcagctcttcgggctgggtctgcggcccagaggggagtgccacaaagtgctggagatgttcgactggaacctggagcaggccggctgccaccttctgggctcctggggccctgcccaccacaagcgctgagatgcgtctggagagccagagggcctgcctgaaggaatcacctgagcctgtccgtccaccaggagtggggagatgcccccatccagtcctggaggacccgctgctcctgctgctcccggggatggagcaaggccaaggctgcgggaggctgggagccctgccctgcccatccctcccgcaccagcgctgtccctgcacactttggttcagtcccggtgcccctgccaagatgtggaaggggccgggtgaagacaggcttgagggctgccccagcaggctctgggtatgacctgcctctggccctggtcctgggcggggcctgtgggtggagtagtacccccaggccctgccctgggtgacagactgggaggaaaccaggctggacctgggcaggcgggatgtgttggccacagggagaggcggaccggcacccggtgggacctcctaggactgggccttcttccagggggcccctggcagcagctggggtgtcgggcagaatgtgacttgtggccttaccatggacttgaatgggacttggctggcctcaggatcttgtgcctggaaatagcctgaggtggctcaggaagcggagaaagggtgccagaccattctctggcggggaccagggcccaaggccccagggctggaaggagaccaaggggcagccgccctggagggacatcagtgcttcctcttccacccaattcccccacgcggttccatgttttcccaccagcctgttggcgaagttgctgctccggcattcagtacctgcttcttccagagaaataaagttagtttctattttatgttaaaaaacaaaaaaagtcgacga

SEQ ID NO: 62931 - DNA, 2828 bp, Homo sapiens
gcagttgggtggggaagccggggagtagggctggactgtgaccactgccctggagagaagacatgaaacaggacagaggatcccggctgcagccagcgtgaggaaagctctgctccctgccagaccggccagctgtggaaacccagcggggcttgcagcagagcggaggggcccaccccgttcttcctcatttcccacccctggtgtgggatttggggggctcctgggcagagtgcgaagctccggagccgaggccactggatccccagtgactgctcgggggggtcccgctgcgtggagatgccggcagcacgtcggttccctggcctggagctctccttccctctcctggccagactgcggcgacgcctgtacacaaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgtgcccccgagagcctgaagacacgcaccttctcccatgccagcgacacctggatgttcggggtgacactgtgggaaatgttcacctacggccaggagccctggatcggcctcaacggcagtcagatcctgcataagatcgacaaggagggggagcggctgccccggcccgaggactgtccccaggacatctacaacgtcatggtccagtgctgggctcacaagccagaggacagacccacgtttgtggccctgcgggacttcctgctggaggcccagcccacagacatgcgggcccttcaggactttgaggaaccggacaagctgcacatccagatgaatgatgtcatcaccgtcatcgagggaagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgaactgtatctgggaaaccccatggacccccccgacctcctgagcgtggaactgagcacctcccggcccccccagcatctaggaggggtgaaaaaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgcccgcctatgacgacgtggcccaggatgaggatgactttgagatctgctccatcaacagcaccctcgtgggcgcgggggtccctgccgggcccagccagggccagaccaactacgcctttgtgcctgagcaggcgcggccgccccctcccctggaggacaacctgttcctcccgccccagggtgggggcaagccgcccagctccgcacagaccgcagagatcttccaggcgctacagcaggagtgcatgaggcaactgcaggctccggccggctccccggccccctctcccagcccggggggtgacgacaagccccagccaggtgatccaggcccctggcccgcgggctggtccctgcatcctgcccatcgtccgggatggcaagaaggtcagcagcacccactattacttgctgcccgagcgaccatcctacctggagcgctaccagcgcttcctgcgtgaggcccagagccccgaggagcctaccgccctgcctgtgcctctgctgctgccggggcggtggtccccgacgccac

SEQ ID NO: 62932 - DNA, 1476 bp, Homo sapiens
gcagttgggtggggaagccggggagtagggctggactgtgaccactgccctggagagaagacatgaaacaggacagaggatcccggctgcagccagcgtgaggaaagctctgctccctgccagaccggccagctgtggaaacccagcggggcttgcagcagagcggaggggcccaccccgttcttcctcatttcccacccctggtgtgggatttggggggctcctgggcagagtgcgaagctccggagccgaggccactggatccccagtgactgctcgggggggtcccgctgcgtggagatgccggcagcacgtcggttccctggcctggagctctccttccctctcctggccagactgcggcgacgcctgtacacaaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgaggggcaggtgctgccagagccgccctggagggacatcagtgcttcctcttccacccaattcccccacgcggttccatgttttcccaccagcctgttggcgaagttgctgctccggcattcagtacctgcttcttccagagaaataaagttagtttctattttatgttaaaaaacaaaaaaagtcgacga

SEQ ID NO: 62933 - DNA, 1502 bp, Homo sapiens
gaattccgggagcccgcggaggctgctgcagcagcccgaaccggcgtccgagtccggggaaggcccccgcgagcgcagggaggggccggaaagttccggcgaactgggggagcggcagtgggagagcgtcgggcgggaggcggtggtcctgggagcggccccggcgcccgaagccgccccgagctggtggggagggtcccggccggtggggccgggctggcgggggaggggcgcctgggggtgcaagaggcgaattggctgcccggggtgcaggagggacaggtggtgcgggctgtcaggaaacctacctgaacgggaaggagccccaggagggagagggacccggcgagggctcaggacccggaggcgccggcggaggaggaggtggtgactggcaggcccgggccccacggtacctccggggctgaaggggacgcaggatgtaggggcatggggagtcgggcgcagaagagtgcggggaacgctgagctctgggagccactgcctgagggcaggccgcggccggcgggaacctcttctgccgtctcagcctgggcgtcgctgaagctgtgtctgcggggaggcagcggaaggcggcagaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccacggactcctggtctgaggcccaaataaacgactgttaattcctcaaaaaaaaagaacacgaaaacgacaaagagagagaagaaaaggacaaaaagc

SEQ ID NO: 62934 - DNA, 380 bp, Homo sapiens
ctgagcgtggaactgagcacctcccggcccccccagcatctaggaggggtgaaaagtaagagcccctctgctccctggtgtccctaactcatcggctactcaggaaggggcactgtcttcacaggccaccctaaggctgctgttctgtttttggggacagtggggtcagggcagcaggcgggacagctgtgtccctggctccggctgggcgtggggtggaagacaggcagctgtatccgccgaggtgggcctcctcgggctgggtctgcagcaggcccgtccgccccggcgtccctcctccctccttccacggccgagctcagatcctggctttcctcacttccccctaatcctgctctcctgtcccaagccaaaaccac

SEQ ID NO: 62935 - DNA, 1801 bp, Homo sapiens
  misc_feature (922)..(922): n is a, c, g, or t
  misc_feature (1489)..(1489): n is a, c, g, or t
tgtcttcagtgaaatgataccggtccccactgcccagctcacctcccggggctgcaggaggcaccggagataatggctgtagagggtcttgtaacctgaacattgcttgcaaacataaggaattctagttactgggaggaagcacagggcagaggccagaagaggccctcagatttgaggcaccctagcccagacggataaggatccaccagctctgggggcgtgagacccaagctggcaagaatctgcaatctggagccaaggctgtgggtgcctcagtggaggccgagtcagaccgacgtggccagctttgaccctcatggcctcctttcttctgtcccttgaccttcggctcctccctgtccaccctggcctccgagtctcctccacttttccttccgtctcagccctcagctctaggcgcccctccagagacccagctgtcttcccaggccccttcccagcaaggactagcttcatctgaaccacacacacactcacggttcaacctcagactaaaattatcctctcccctgggcaggatgaagggcagccgactccctggtgagggtggagacagacagcaccaaatggtcaggccagagaaggggccagggctaaaaatggacaaggaggtgtctgtggagggcccctgcggctccatcgatgcgggttagggctggagtctgcggggtggcgggtgcaggaagggagggtggggcaggactgggaggagactccgaccttggctgggcggtgccctccctctccacacagctgggtgtggggccgctcagccacaggctgcatgcctgtcggtctctttctggcaccctccttgaggccagcatcaggctttgggttcatgtttgggggtgtgccctggacggagtgtgggcctccagccaggctgccccactgncagtttggcaaaaccaggacctatctggaagccgaagccggggatcaccaggtggacccagcggggtgggactgagtgactgaccctggggtgttggattccatctggcccccggctgccttcaaacaggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagctctctgtgtcctgccagcgcagcagaggcatgggacccggggctggtagtggctcttctgcccccaaccagggtgtggatgggactggggatgcgtcacagtgtggctcatcccagagtccgtgctcaggatttttggggttttatttatttatttatttttgagatggagtctcgctctgtcgcccaggctggagtgcagtaggcacgntctcggcttcctgcaacctccactttccgggttcaagcaatcctcctgcctcagcctcctgagtagctgggattacaggcatgcaccaccacactcagttaatttttgtatttttagtagagacggggtttcaccatgttggccaggctggtctcgaactcctgacctcagatgatctgcccactttagcctcccaaagtgcttggattacaggtgtgagccaccacgtccagcccatgctcaggtttaactaagcacatttattatttcaactataaaaataatttattataaaagtttggaaagtatttg

SEQ ID NO: 62936 - DNA, 4435 bp, Homo sapiens
gcagttgggtggggaagccggggagtagggctggactgtgaccactgccctggagagaagacatgaaacaggacagaggatcccggctgcagccagcgtgaggaaagctctgctccctgccagaccggccagctgtggaaacccagcggggcttgcagcagagcggaggggcccaccccgttcttcctcatttcccacccctggtgtgggatttggggggctcctgggcagagtgcgaagctccggagccgaggccactggatccccagtgactgctcgggggggtcccgctgcgtggagatgccggcagcacgtcggttccctggcctggagctctccttccctctcctggccagactgcggcgacgcctgtacacaaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggcatcagtttcccaaattgcctcgagggagaggcctgagaaactgcaggactcctagaggtccccagacagcaggccaggaaggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgtgcccccgagagcctgaagacacgcaccttctcccatgccagcgacacctggatgttcggggtgacactgtgggaaatgttcacctacggccaggagccctggatcggcctcaacggcagtcagatcctgcataagatcgacaaggagggggagcggctgccccggcccgaggactgtccccaggacatctacaacgtcatggtccagtgctgggctcacaagccagaggacagacccacgtttgtggccctgcgggacttcctgctggaggcccagcccacagacatgcgggcccttcaggactttgaggaaccggacaagctgcacatccagatgaatgatgtcatcaccgtcatcgagggaagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgaactgtatctgggaaaccccatggacccccccgacctcctgagcgtggaactgagcacctcccggcccccccagcatctaggaggggtgaaaaaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgcccgcctatgacgacgtggcccaggatgaggatgactttgagatctgctccatcaacagcaccctcgtgggcgcgggggtccctgccgggcccagccagggccagaccaactacgcctttgtgcctgagcaggcgcggccgccccctcccctggaggacaacctgttcctcccgccccagggtgggggcaagccgcccagctccgcacagaccgcagagatcttccaggcgctacagcaggagtgcatgaggcaactgcaggctccggccggctccccggccccctctcccagcccggggggtgacgacaagccccaggtgcctcctcgggtacccatcccccctcggcccacgcgcccacacgtccagctgtctccagcccccccgggcgaggaggagaccagccagtggcctggacctgcttcccctccccgggtgcctccgcgggagcccctgtcccctcaaggctcgaggacacccagccccctggtaccacctggcagctccccgctgccaccccggctctcaagctcacctgggaagaccatgcccaccacccagagctttgcctcagaccccaagtacgccaccccccaggtgatccaggcccctggcccgcgggctggtccctgcatcctgcccatcgtccgggatggcaagaaggtcagcagcacccactattacttgctgcccgagcgaccatcctacctggagcgctaccagcgcttcctgcgtgaggcccagagccccgaggagcctaccgcccctgcctgtgcctctgctgctgcccccacccagcaccccagcccccgccgcccccacggccaccgtgcggccgatgccccaggctgccttggaccccaaggccaacttctccaccaacaacagcaacccaggggcccggccaccacccccgagggccactgctcggctgccacagaggggctgccctggcgatgggccagaggcgggccggccagcagacaagatccagatggccatggtgcatggggtgaccacagaggagtgccaggcggccctgcagtgccacggctggagcgtgcagagggctgcccagtatctgaaggtggagcagctcttcgggctgggtctgcggcccagaggggagtgccacaaagtgctggagatgttcgactggaacctggagcaggccggctgccaccttctgggctcctggggccctgcccaccacaagcgctgagatgcgtctggagagccagagggcctgcctgaaggaatcacctgagcctgtccgtccaccaggagtggggagatgcccccatccagtcctggaggacccgctgctcctgctgctcccggggatggagcaaggccaaggctgcgggaggctgggagccctgccctgcccatccctcccgcaccagcgctgtccctgcacactttggttcagtcccggtgcccctgccaagatgtggaaggggccgggtgaagacaggcttgagggctgccccagcaggctctgggtatgacctgcctctggccctggtcctgggcggggcctgtgggtggagtagtacccccaggccctgccctgggtgacagactgggaggaaaccaggctggacctgggcaggcgggatgtgttggccacagggagaggcggaccggcacccggtgggacctcctaggactgggccttcttccagggggcccctggcagcagctggggtgtcgggcagaatgtgacttgtggccttaccatggacttgaatgggacttggctggcctcaggatcttgtgcctggaaatagcctgaggtggctcaggaagcggagaaagggtgccagaccattctctggcggggaccagggcccaaggccccagggctggaaggagaccaaggggcagccgccctggagggacatcagtgcttcctcttccacccaattcccccacgcggttccatgttttcccaccagcctgttggcgaagttgctgctccggcattcagtacctgcttcttccagagaaataaagttagtttctattttatgttaaaaaacaaaaaaagtcgacga

SEQ ID NO: 62937 - DNA, 4024 bp, Homo sapiens
cttttgagcaggagtccgggccctcgtgtcaccgctctgaagtcaaggagaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgtgcccccgagagcctgaagacacgcaccttctcccatgccagcgacacctggatgttcggggtgacactgtgggaaatgttcacctacggccaggagccctggatcggcctcaacggcagtcagatcctgcataagatcgacaaggagggggagcggctgccccggcccgaggactgtccccaggacatctacaacgtcatggtccagtgctgggctcacaagccagaggacagacccacgtttgtggccctgcgggacttcctgctggaggcccagcccacagacatgcgggcccttcaggactttgaggaaccggacaagctgcacatccagatgaatgatgtcatcaccgtcatcgagggaagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgaactgtatctgggaaaccccatggacccccccgacctcctgagcgtggaactgagcacctcccggcccccccagcatctaggaggggtgaaaaaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgcccgcctatgacgacgtggcccaggatgaggatgactttgagatctgctccatcaacagcaccctcgtgggcgcgggggtccctgccgggcccagccagggccagaccaactacgcctttgtgcctgagcaggcgcggccgccccctcccctggaggacaacctgttcctcccgccccagggtgggggcaagccgcccagctccgcacagaccgcagagatcttccaggcgctacagcaggagtgcatgaggcaactgcaggctccggccggctccccggccccctctcccagcccggggggtgacgacaagccccaggtgcctcctcgggtacccatcccccctcggcccacgcgcccacacgtccagctgtctccagcccccccgggcgaggaggagaccagccagtggcctggacctgcttcccctccccgggtgcctccgcgggagcccctgtcccctcaaggctcgaggacacccagccccctggtaccacctggcagctccccgctgccaccccggctctcaagctcacctgggaagaccatgcccaccacccagagctttgcctcagaccccaagtacgccaccccccaggtgatccaggcccctggcccgcgggctggtccctgcatcctgcccatcgtccgggatggcaagaaggtcagcagcacccactattacttgctgcccgagcgaccatcctacctggagcgctaccagcgcttcctgcgtgaggcccagagccccgaggagcctaccgcccctgcctgtgcctctgctgctgcccccacccagcaccccagcccccgccgcccccacggccaccgtgcggccgatgccccaggctgccttggaccccaaggccaacttctccaccaacaacagcaacccaggggcccggccaccacccccgagggccactgctcggctgccacagaggggctgccctggcgatgggccagaggcgggccggccagcagacaagatccagatggccatggtgcatggggtgaccacagaggagtgccaggcggccctgcagtgccacggctggagcgtgcagagggctgcccagtatctgaaggtggagcagctcttcgggctgggtctgcggcccagaggggagtgccacaaagtgctggagatgttcgactggaacctggagcaggccggctgccaccttctgggctcctggggccctgcccaccacaagcgctgagatgcgtctggagagccagagggcctgcctgaaggaatcacctgagcctgtccgtccaccaggagtggggagatgcccccatccagtcctggaggacccgctgctcctgctgctcccggggatggagcaaggccaaggctgcgggaggctgggagccctgccctgcccatccctcccgcaccagcgctgtccctgcacactttggttcagtcccggtgcccctgccaagatgtggaaggggccgggtgaagacaggcttgagggctgccccagcaggctctgggtatgacctgcctctggccctggtcctgggcggggcctgtgggtggagtagtacccccaggccctgccctgggtgacagactgggaggaaaccaggctggacctgggcaggcgggatgtgttggccacagggagaggcggaccggcacccggtgggacctcctaggactgggccttcttccagggggcccctggcagcagctggggtgtcgggcagaatgtgacttgtggccttaccatggacttgaatgggacttggctggcctcaggatcttgtgcctggaaatagcctgaggtggctcaggaagcggagaaagggtgccagaccattctctggcggggaccagggcccaaggccccagggctggaaggagaccaaggggcagccgccctggagggacatcagtgcttcctcttccacccaattcccccacgcggttccatgttttcccaccagcctgttggcgaagttgctgctccggcattcagtacctgcttcttccagagaaataaagttagtttctattttatgttaaaaaacaaaaaaagtcgacga

SEQ ID NO: 62938 - DNA, 4216 bp, Homo sapiens
gcagttgggtggggaagccggggagtagggctggactgtgaccactgccctggagagaagacatgaaacaggacagaggatcccggctgcagccagcgtgaggaaagctctgctccctgccagaccggccagctgtggaaacccagcggggcttgcagcagagcggaggggcccaccccgttcttcctcatttcccacccctggtgtgggatttggggggctcctgggcagagtgcgaagctccggagccgaggccactggatccccagtgactgctcgggggggtcccgctgcgtggagatgccggcagcacgtcggttccctggcctggagctctccttccctctcctggccagactgcggcgacgcctgtacacaaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggcatcagtttcccaaattgcctcgagggagaggcctgagaaactgcaggactcctagaggtccccagacagcaggccaggaaggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgtgcccccgagagcctgaagacacgcaccttctcccatgccagcgacacctggatgttcggggtgacactgtgggaaatgttcacctacggccaggagccctggatcggcctcaacggcagtcagatcctgcataagatcgacaaggagggggagcggctgccccggcccgaggactgtccccaggacatctacaacgtcatggtccagtgctgggctcacaagccagaggacagacccacgtttgtggccctgcgggacttcctgctggaggcccagcccacagacatgcgggcccttcaggactttgaggaaccggacaagctgcacatccagatgaatgatgtcatcaccgtcatcgagggaagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgaactgtatctgggaaaccccatggacccccccgacctcctgagcgtggaactgagcacctcccggcccccccagcatctaggaggggtgaaaaaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgcccgcctatgacgacgtggcccaggatgaggatgactttgagatctgctccatcaacagcaccctcgtgggcgcgggggtccctgccgggcccagccagggccagaccaactacgcctttgtgcctgagcaggcgcggccgccccctcccctggaggacaacctgttcctcccgccccagggtgggggcaagccgcccagctccgcacagaccgcagagatcttccaggcgctacagcaggagtgcatgaggcaactgcaggctccggccggctccccggccccctctcccagcccggggggtgacgacaagccccaggtgcctcctcgggtacccatcccccctcggcccacgcgcccacacgtccagctgtctccagcccccccgggcgaggaggagaccagccagtggcctggacctgcttcccctccccgggtgcctccgcgggagcccctgtcccctcaaggctcgaggacacccagccccctggtaccacctggcagctccccgctgccaccccggctctcaagctcacctgggaagaccatgcccaccacccagagctttgcctcagaccccaagtacgccaccccccaggtgatccaggcccctggcccgcgggctggtccctgcatcctgcccatcgtccgggatggcaagaaggtcagcagcacccactattacttgctgcccgagcgaccatcctacctggagcgctaccagcgcttcctgcgtgaggcccagagccccgaggagcctaccgcccctgcctgtgcctctgctgctgcccccacccagcaccccagcccccgccgcccccacggccaccgtgcggccgatgccccaggctgccttggaccccaaggccaacttctccaccaacaacagcaacccaggggcccggccaccacccccgagggccactgctcggctgccacagaggggctgccctggcgatgggccagaggcgggccggccagcagacaagatccagatggccatggtgcatggggtgaccacagaggagtgccaggcggccctgcagtgccacggctggagcgtgcagagggctgcccagtatctgaaggtggagcagctcttcgggctgggtctgcggcccagaggggagtgccacaaagtgctggagatgttcgactggaacctggagcaggccggctgccaccttctgggctcctggggccctgcccaccacaagcgctgagatgcgtctggagagccagagggcctgcctgaaggaatcacctgagcctgtccgtccaccaggagtggggagatgcccccatccagtcctggaggacccgctgctcctgctgctcccggggatggagcaaggccaaggctgcgggaggctgggagccctgccctgcccatccctcccgcaccagcgctgtccctgcacactttggttcagtcccggtgcccctgccaagatgtggaaggggccgggtgaagacaggcttgagggctgccccagcaggctctgggtatgacctgcctctggccctggtcctgggcggggcctgtgggtggagtagtacccccaggccctgccctgggtgacagactgggaggaaaccaggctggacctgggcaggcgggatgtgttggccacagggagaggcggaccggcacccggtgggacctcctaggactgggccttcttccagggggcccctggcagcagctggggtgtcgggcagaatgtgacttgtggccttaccatggacttgaatgggacttggctggcctcaggatcttgtgcctggaaatagcctgaggtggctcaggaagcggagaaagggtgccagaccattctctggcggggaccagggcccaaggccccagggctggaaggagaccaaggggcagccgccctggagggacatcagtgcttcctcttccacccaattcccccacgcggttccatgttttcccaccagcctgttggcgaagttgctgctccggcattcagtacctgcttcttccagagaaataaagttagtttctattttatgttaaaaaacaaaaaaagtcgacga

SEQ ID NO: 62939 - DNA, 3299 bp, Homo sapiens
  misc_feature (873)..(873): n is a, c, g, or t
gcagttgggtggggaagccggggagtagggctggactgtgaccactgccctggagagaagacatgaaacaggacagaggatcccggctgcagccagcgtgaggaaagctctgctccctgccagaccggccagctgtggaaacccagcggggcttgcagcagagcggaggggcccaccccgttcttcctcatttcccacccctggtgtgggatttggggggctcctgggcagagtgcgaagctccggagccgaggccactggatccccagtgactgctcgggggggtcccgctgcgtggagatgccggcagcacgtcggttccctggcctggagctctccttccctctcctggccagactgcggcgacgcctgtacacaaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagcccacctcagcctgcnttcttcactcagaaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgcccgcctatgacgacgtggcccaggatgaggatgactttgagatctgctccatcaacagcaccctcgtgggcgcgggggtccctgccgggcccagccagggccagaccaactacgcctttgtgcctgagcaggcgcggccgccccctcccctggaggacaacctgttcctcccgccccagggtgggggcaagccgcccagctccgcacagaccgcagagatcttccaggcgctacagcaggagtgcatgaggcaactgcaggctccggccggctccccggccccctctcccagcccggggggtgacgacaagccccaggtgcctcctcgggtacccatcccccctcggcccacgcgcccacacgtccagctgtctccagcccccccgggcgaggaggagaccagccagtggcctggacctgcttcccctccccgggtgcctccgcgggagcccctgtcccctcaaggctcgaggacacccagccccctggtaccacctggcagctccccgctgccaccccggctctcaagctcacctgggaagaccatgcccaccacccagagctttgcctcagaccccaagtacgccaccccccaggtgatccaggcccctggcccgcgggctggtccctgcatcctgcccatcgtccgggatggcaagaaggtcagcagcacccactattacttgctgcccgagcgaccatcctacctggagcgctaccagcgcttcctgcgtgaggcccagagccccgaggagcctaccgcccctgcctgtgcctctgctgctgcccccacccagcaccccagcccccgccgcccccacggccaccgtgcggccgatgccccaggctgccttggaccccaaggccaacttctccaccaacaacagcaacccaggggcccggccaccacccccgagggccactgctcggctgccacagaggggctgccctggcgatgggccagaggcgggccggccagcagacaagatccagatggccatggtgcatggggtgaccacagaggagtgccaggcggccctgcagtgccacggctggagcgtgcagagggctgcccagtatctgaaggtggagcagctcttcgggctgggtctgcggcccagaggggagtgccacaaagtgctggagatgttcgactggaacctggagcaggccggctgccaccttctgggctcctggggccctgcccaccacaagcgctgagatgcgtctggagagccagagggcctgcctgaaggaatcacctgagcctgtccgtccaccaggagtggggagatgcccccatccagtcctggaggacccgctgctcctgctgctcccggggatggagcaaggccaaggctgcgggaggctgggagccctgccctgcccatccctcccgcaccagcgctgtccctgcacactttggttcagtcccggtgcccctgccaagatgtggaaggggccgggtgaagacaggcttgagggctgccccagcaggctctgggtatgacctgcctctggccctggtcctgggcggggcctgtgggtggagtagtacccccaggccctgccctgggtgacagactgggaggaaaccaggctggacctgggcaggcgggatgtgttggccacagggagaggcggaccggcacccggtgggacctcctaggactgggccttcttccagggggcccctggcagcagctggggtgtcgggcagaatgtgacttgtggccttaccatggacttgaatgggacttggctggcctcaggatcttgtgcctggaaatagcctgaggtggctcaggaagcggagaaagggtgccagaccattctctggcggggaccagggcccaaggccccagggctggaaggagaccaaggggcagccgccctggagggacatcagtgcttcctcttccacccaattcccccacgcggttccatgttttcccaccagcctgttggcgaagttgctgctccggcattcagtacctgcttcttccagagaaataaagttagtttctattttatgttaaaaaacaaaaaaagtcgacga

SEQ ID NO: 62940 - DNA, 4117 bp, Homo sapiens
gcagttgggtggggaagccggggagtagggctggactgtgaccactgccctggagagaagacatgaaacaggacagaggatcccggctgcagccagcgtgaggaaagctctgctccctgccagaccggccagctgtggaaacccagcggggcttgcagcagagcggaggggcccaccccgttcttcctcatttcccacccctggtgtgggatttggggggctcctgggcagagtgcgaagctccggagccgaggccactggatccccagtgactgctcgggggggtcccgctgcgtggagatgccggcagcacgtcggttccctggcctggagctctccttccctctcctggccagactgcggcgacgcctgtacacaaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgtgcccccgagagcctgaagacacgcaccttctcccatgccagcgacacctggatgttcggggtgacactgtgggaaatgttcacctacggccaggagccctggatcggcctcaacggcagtcagatcctgcataagatcgacaaggagggggagcggctgccccggcccgaggactgtccccaggacatctacaacgtcatggtccagtgctgggctcacaagccagaggacagacccacgtttgtggccctgcgggacttcctgctggaggcccagcccacagacatgcgggcccttcaggactttgaggaaccggacaagctgcacatccagatgaatgatgtcatcaccgtcatcgagggaagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgaactgtatctgggaaaccccatggacccccccgacctcctgagcgtggaactgagcacctcccggcccccccagcatctaggaggggtgaaaaaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcgcaccctcgtgggcgcgggggtccctgccgggcccagccagggccagaccaactacgcctttgtgcctgagcaggcgcggccgccccctcccctggaggacaacctgttcctcccgccccagggtgggggcaagccgcccagctccgcacagaccgcagagatcttccaggcgctacagcaggagtgcatgaggcaactgcaggctccggccggctccccggccccctctcccagcccggggggtgacgacaagccccaggtgcctcctcgggtacccatcccccctcggcccacgcgcccacacgtccagctgtctccagcccccccgggcgaggaggagaccagccagtggcctggacctgcttcccctccccgggtgcctccgcgggagcccctgtcccctcaaggctcgaggacacccagccccctggtaccacctggcagctccccgctgccaccccggctctcaagctcacctgggaagaccatgcccaccacccagagctttgcctcagaccccaagtacgccaccccccaggtgatccaggcccctggcccgcgggctggtccctgcatcctgcccatcgtccgggatggcaagaaggtcagcagcacccactattacttgctgcccgagcgaccatcctacctggagcgctaccagcgcttcctgcgtgaggcccagagccccgaggagcctaccgcccctgcctgtgcctctgctgctgcccccacccagcaccccagcccccgccgcccccacggccaccgtgcggccgatgccccaggctgccttggaccccaaggccaacttctccaccaacaacagcaacccaggggcccggccaccacccccgagggccactgctcggctgccacagaggggctgccctggcgatgggccagaggcgggccggccagcagacaagatccagatggccatggtgcatggggtgaccacagaggagtgccaggcggccctgcagtgccacggctggagcgtgcagagggctgcccagtatctgaaggtggagcagctcttcgggctgggtctgcggcccagaggggagtgccacaaagtgctggagatgttcgactggaacctggagcaggccggctgccaccttctgggctcctggggccctgcccaccacaagcgctgagatgcgtctggagagccagagggcctgcctgaaggaatcacctgagcctgtccgtccaccaggagtggggagatgcccccatccagtcctggaggacccgctgctcctgctgctcccggggatggagcaaggccaaggctgcgggaggctgggagccctgccctgcccatccctcccgcaccagcgctgtccctgcacactttggttcagtcccggtgcccctgccaagatgtggaaggggccgggtgaagacaggcttgagggctgccccagcaggctctgggtatgacctgcctctggccctggtcctgggcggggcctgtgggtggagtagtacccccaggccctgccctgggtgacagactgggaggaaaccaggctggacctgggcaggcgggatgtgttggccacagggagaggcggaccggcacccggtgggacctcctaggactgggccttcttccagggggcccctggcagcagctggggtgtcgggcagaatgtgacttgtggccttaccatggacttgaatgggacttggctggcctcaggatcttgtgcctggaaatagcctgaggtggctcaggaagcggagaaagggtgccagaccattctctggcggggaccagggcccaaggccccagggctggaaggagaccaaggggcagccgccctggagggacatcagtgcttcctcttccacccaattcccccacgcggttccatgttttcccaccagcctgttggcgaagttgctgctccggcattcagtacctgcttcttccagagaaataaagttagtttctattttatgttaaaaaacaaaaaaagtcgacga

SEQ ID NO: 62941 - DNA, 4295 bp, Homo sapiens
gcagttgggtggggaagccggggagtagggctggactgtgaccactgccctggagagaagacatgaaacaggacagaggatcccggctgcagccagcgtgaggaaagctctgctccctgccagaccggccagctgtggaaacccagcggggcttgcagcagagcggaggggcccaccccgttcttcctcatttcccacccctggtgtgggatttggggggctcctgggcagagtgcgaagctccggagccgaggccactggatccccagtgactgctcgggggggtcccgctgcgtggagatgccggcagcacgtcggttccctggcctggagctctccttccctctcctggccagactgcggcgacgcctgtacacaaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgtgcccccgagagcctgaagacacgcaccttctcccatgccagcgacacctggatgttcggggtgacactgtgggaaatgttcacctacggccaggagccctggatcggcctcaacggcagtcagatcctgcataagatcgacaaggagggggagcggctgccccggcccgaggactgtccccaggacatctacaacgtcatggtccagtgctgggctcacaagccagaggacagacccacgtttgtggccctgcgggacttcctgctggaggcccagcccacagacatgcgggcccttcaggactttgaggaaccggacaagctgcacatccagatgaatgatgtcatcaccgtcatcgagggaagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgaactgtatctgggaaaccccatggacccccccgacctcctgagcgtggaactgagcacctcccggcccccccagcatctaggaggggtgaaaaaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgcccgcctatgacgacgtggcccaggatgaggatgactttgagatctgctccatcaacagcaccctcgtgggcgcgggggtccctgccgggcccagccagggccagaccaactacgcctttgtgcctgagcaggcgcggccgccccctcccctggaggacaacctgttcctcccgccccagggtgggggcaagccgcccagctccgcacagaccgcagagatcttccaggcgctacagcaggagtgcatgaggcaactgcaggctccggccggctccccggccccctctcccagcccggggggtgacgacaagccccaggtgcctcctcgggtacccatcccccctcggcccacgcgcccacacgtccagctgtctccagcccccccgggcgaggaggagaccagccagtggcctggacctgcttcccctccccgggtgcctccgcgggagcccctgtcccctcaaggctcgaggacacccagccccctggtaccacctggcagctccccgctgccaccccggctctcaagctcacctgggaagaccatgcccaccacccagagctttgcctcagaccccaagtacgccaccccccaggtgatccaggcccctggcccgcgggctggtccctgcatcctgcccatcgtccgggatggcaagaaggtcagcagcacccactattacttgctgcccgagcgaccatcctacctggagcgctaccagcgcttcctgcgtgaggcccagagccccgaggagcctaccgcccctgcctgtgcctctgctgctgcccccacccagcaccccagcccccgccgcccccacggccaccgtgcggccgatgccccaggctgccttggaccccaaggccaacttctccaccaacaacagcaacccaggggcccggccaccacccccgagggccactgctcggctgccacagaggggctgccctggcgatgggccagaggcgggccggccagcagacaagatccagatggccatggtgcatggggtgaccacagaggagtgccaggcggccctgcagtgccacggctggagcgtgcagagggctgcccagtatctgaaggtggagcagctcttcgggctgggtctgcggcccagaggggagtgccacaaagtgctggagatgttcgactggaacctggagcaggccggctgccaccttctgggctcctggggccctgcccaccacaagcgctgagatgcgtctggagagccagagggcctgcctgaaggaatcacctgagcctgtccgtccaccaggagtggggagatgcccccatccagtcctggaggacccgctgctcctgctgctcccggggatggagcaaggccaaggctgcgggaggctgggagccctgccctgcccatccctcccgcaccagcgctgtccctgcacactttggttcagtcccggtgcccctgccaagatgtggaaggggccgggtgaagacaggcttgagggctgccccagcaggctctgggtatgacctgcctctggccctggtcctgggcggggcctgtgggtggagtagtacccccaggccctgccctgggtgacagactgggaggaaaccaggctggacctgggcaggcgggatgtgttggccacagggagaggcggaccggcacccggtgggacctcctaggactgggccttcttccagggggcccctggcagcagctggggtgtcgggcagaatgtgacttgtggccttaccatggacttgaatgggacttggctggcctcaggatcttgtgcctggaaatagcctgaggtggccccagggctggaaggagaccaaggggcagccgccctggagggacatcagtgcttcctcttccacccaattcccccacgcggttccatgttttcccaccagcctgttggcgaagttgctgctccggcattcagtacctgcttcttccagagaaataaagttagtttctattttatgttaaaaaacaaaaaaagtcgacga

SEQ ID NO: 62942 - DNA, 1512 bp, Homo sapiens
gcagttgggtggggaagccggggagtagggctggactgtgaccactgccctggagagaagacatgaaacaggacagaggatcccggctgcagccagcgtgaggaaagctctgctccctgccagaccggccagctgtggaaacccagcggggcttgcagcagagcggaggggcccaccccgttcttcctcatttcccacccctggtgtgggatttggggggctcctgggcagagtgcgaagctccggagccgaggccactggatccccagtgactgctcgggggggtcccgctgcgtggagatgccggcagcacgtcggttccctggcctggagctctccttccctctcctggccagactgcggcgacgcctgtacacaaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtgttcagtggaaagcgactggaggctgagttcccacctcatcactctcagagcaccttccggaagacctcgcccgcccctgggggcccagcaggggaggggcccctgcagagcctcacctgcctcattggggagaaggacctgcgcctcctggagaagctgggtgatggttcctttggcgtggtgcgcaggggcgagtgggacgcgccctcagggaagacggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgaggggcaggtgctgccagctcacagagtccctgcagacccaggcctcaaagcttctgggggcccacgtgccagggtctgggtgctggaaatcacagggatacatgctgtgggactctccaaggggctttgctgggtggggtgatacggggatagatgctgtgtcctctccaaggggcattgttgggggtcgtgtttcagggatagatcctgtgtcctctccaaggg

SEQ ID NO: 62943 - DNA, 1293 bp, Homo sapiens
gcagttgggtggggaagccggggagtagggctggactgtgaccactgccctggagagaagacatgaaacaggacagaggatcccggctgcagccagcgtgaggaaagctctgctccctgccagaccggccagctgtggaaacccagcggggcttgcagcagagcggaggggcccaccccgttcttcctcatttcccacccctggtgtgggatttggggggctcctgggcagagtgcgaagctccggagccgaggccactggatccccagtgactgctcgggggggtcccgctgcgtggagatgccggcagcacgtcggttccctggcctggagctctccttccctctcctggccagactgcggcgacgcctgtacacaaggctgggaggcggcagaatgcagccagaggagggcacaggctggctgctggagctgctgtccgaggtgcagctgcaacagtacttcctgcggctccgagatgacctcaacgtcacccgcctgtcccactttgagtacgtcaagaatgaggacctggagaagatcggcatgggtcggcctggccagcggcggctgtgggaggctgtgaagaggaggaaggccttgtgcaaacgcaagtcgtggatgagtaaggtggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggtgacagagctggcacctctgggatcgttgttggaccggctacgtaagcaccagggccacttcctcctggggactctgagccgctacgctgtgcaggtggctgagggcatgggctacctggagtccaagcgctttattcaccgtgacctggctgcccgcaatctgctgttggctacccgcgacctggtcaagatcggggactttgggctgatgcgagcactacctcagaatgacgaccattacgtcatgcaggaacatcgcaaggtgcccttcgcctggtgaggggcaggtgctgccagctcacagagtccctgcagacccaggcctcaaagcttctgggggcccacgtgccagggtctgggtgctggaaatcacagggatacatgctgtgggactctccaaggggctttgctgggtggggtgatacggggatagatgctgtgtcctctccaaggggcattgttgggggtcgtgtttcagggatagatcctgtgtcctctccaaggg

SEQ ID NO: 62944 - DNA, 5077 bp, Homo sapiens
ctcatgcatatgcaggtgcgcgggtgacgaatgggcgagcgagctgtcagtctcgttccgaacttgttggctgcggtgccgggagcgcgggcgcgcagagcccgaggccgggacccgctgccttcaccgccgccgccgtcgccgccgggtgggagccgggccgggcagccggagcgcggccgccagcgagccggagctgccgccgcccctgcacgcccgccgcccaggcccgcgcgccggacgctgcgctcgaccccgcccgcgccgccgccgccgccgcctctgccgctgccgctgcctctgcgggcgctcggagggcgggcgggcgctgggaggccggcgcggcggctgggagccgggcgcgggcggcggcggcggggccgggcgggcgggtcgcgggggcaatgcgggcgcagggccgggggcgccttccccggcggctgctgctgctgctggcgctctgggtgcaggcggcgcggcccatgggctatttcgagctgcagctgagcgcgctgcggaacgtgaacggggagctgctgagcggcgcctgctgtgacggcgacggccggacaacgcgcgcggggggctgcggccacgacgagtgcgacacgtacgtgcgcgtgtgccttaaggagtaccaggccaaggtgacgcccacggggccctgcagctacggccacggcgccacgcccgtgctgggcggcaactccttctacctgccgccggcgggcgctgcgggggaccgagcgcgggcgcgggcccgggccggcggcgaccaggacccgggcctcgtcgtcatccccttccagttcgcctggccgcgctcctttaccctcatcgtggaggcctgggactgggacaacgataccaccccgaatgaggagctgctgatcgagcgagtgtcgcatgccggcatgatcaacccggaggaccgctggaagagcctgcacttcagcggccacgtggcgcacctggagctgcagatccgcgtgcgctgcgacgagaactactacagcgccacttgcaacaagttctgccggccccgcaacgactttttcggccactacacctgcgaccagtacggcaacaaggcctgcatggacggctggatgggcaaggagtgcaaggaagctgtgtgtaaacaagggtgtaatttgctccacgggggatgcaccgtgcctggggagtgcaggtgcagctacggctggcaagggaggttctgcgatgagtgtgtcccctaccccggctgcgtgcatggcagttgtgtggagccctggcagtgcaactgtgagaccaactggggcggcctgctctgtgacaaagacctgaactactgtggcagccaccacccctgcaccaacggaggcacgtgcatcaacgccgagcctgaccagtaccgctgcacctgccctgacggctactcgggcaggaactgtgagaaggctgagcacgcctgcacctccaacccgtgtgccaacgggggctcttgccatgaggtgccgtccggcttcgaatgccactgcccatcgggctggagcgggcccacctgtgcccttgacatcgatgagtgtgcttcgaacccgtgtgcggccggtggcacctgtgtggaccaggtggacggctttgagtgcatctgccccgagcagtgggtgggggccacctgccagctggacgccaatgagtgtgaagggaagccatgccttaacgctttttcttgcaaaaacctgattggcggctattactgtgattgcatcccgggctggaagggcatcaactgccatatcaacgtcaacgactgtcgcgggcagtgtcagcatgggggcacctgcaaggacctggtgaacgggtaccagtgtgtgtgcccacggggcttcggaggccggcattgcgagctggaacgagacaagtgtgccagcagcccctgccacagcggcggcctctgcgaggacctggccgacggcttccactgccactgcccccagggcttctccgggcctctctgtgaggtggatgtcgacctttgtgagccaagcccctgccggaacggcgctcgctgctataacctggagggtgactattactgcgcctgccctgatgactttggtggcaagaactgctccgtgccccgcgagccgtgccctggcggggcctgcagagtgatcgatggctgcgggtcagacgcggggcctgggatgcctggcacagcagcctccggcgtgtgtggcccccatggacgctgcgtcagccagccagggggcaacttttcctgcatctgtgacagtggctttactggcacctactgccatgagaacattgacgactgcctgggccagccctgccgcaatgggggcacatgcatcgatgaggtggacgccttccgctgcttctgccccagcggctgggagggcgagctctgcgacaccaatcccaacgactgccttcccgatccctgccacagccgcggccgctgctacgacctggtcaatgacttctactgtgcgtgcgacgacggctggaagggcaagacctgccactcacgcgagttccagtgcgatgcctacacctgcagcaacggtggcacctgctacgacagcggcgacaccttccgctgcgcctgcccccccggctggaagggcagcacctgcgccgtcgccaagaacagcagctgcctgcccaacccctgtgtgaatggtggcacctgcgtgggcagcggggcctccttctcctgcatctgccgggacggctgggagggtcgtacttgcactcacaataccaacgactgcaaccctctgccttgctacaatggtggcatctgtgttgacggcgtcaactggttccgctgcgagtgtgcacctggcttcgcggggcctgactgccgcatcaacatcgacgagtgccagtcctcgccctgtgcctacggggccacgtgtgtggatgagatcaacgggtatcgctgtagctgcccacccggccgagccggcccccggtgccaggaagtgatcgggttcgggagatcctgctggtcccggggcactccgttcccacacggaagctcctgggtggaagactgcaacagctgccgctgcctggatggccgccgtgactgcagcaaggtgtggtgcggatggaagccttgtctgctggccggccagcccgaggccctgagcgcccagtgcccactggggcaaaggtgcctggagaaggccccaggccagtgtctgcgaccaccctgtgaggcctggggggagtgcggcgcagaagagccaccgagcaccccctgcctgccacgctccggccacctggacaataactgtgcccgcctcaccttgcatttcaaccgtgaccacgtgccccagggcaccacggtgggcgccatttgctccgggatccgctccctgccagccacaagggctgtggcacgggaccgcctgctggtgttgctttgcgaccgggcgtcctcgggggccagtgccgtggaggtggccgtgtccttcagccctgccagggacctgcctgacagcagcctgatccagggcgcggcccacgccatcgtggccgccatcacccagcgggggaacagctcactgctcctggctgtcaccgaggtcaaggtggagacggttgttacgggcggctcttccacaggtctgctggtgcctgtgctgtgtggtgccttcagcgtgctgtggctggcgtgcgtggtcctgtgcgtgtggtggacacgcaagcgcaggaaagagcgggagaggagccggctgccgcgggaggagagcgccaacaaccagtgggccccgctcaaccccatccgcaaccccatcgagcggccggggggccacaaggacgtgctctaccagtgcaagaacttcacgccgccgccgcgcagggcggacgaggcgctgcccgggccggccggccacgcggccgtcagggaggatgaggaggacgaggatctgggccgcggtgaggaggactccctggaggcggagaagttcctctcacacaaattcaccaaagatcctggccgctcgccggggaggccggcccactgggcctcaggccccaaagtggacaaccgcgcggtcaggagcatcaatgaggcccgctacgccggcaaggagtaggggcggctgccagctgggccgggacccagggccctcggtgggagccatgccgtctgccggacccggaggccgaggccatgtgcatagtttctttattttgtgtaaaaaaaccaccaaaaacaaaaaccaaatgtttattttctacgtttctttaaccttgtataaattattcagtaactgtcaggctgaaaacaatggagtattctcggatagttgctatttttgtaaagtttccgtgcgtggcactcgctgtatgaaaggagagagcaaagggtgtctgcgtcgtcaccaaatcgtagcgtttgttaccagaggttgtgcactgtttacagaatcttccttttattcctcactcgggtttctctgtggctccaggccaaagtgccggtgagacccatggctgtgttggtgtggcccatggctgttggtgggacccgtggctgatggtgtggcctgtggctgtcggtgggactcgtggctgtcaatgggacctgtggctgtcggtgggacctacggtggtcggtgggaccctggttattgatgtggccctggctgccggcacggcccgtggctgttgacgcacctgtggttgttagtggggcctgaggtcatcggcgtggcccaaggccggcaggtcaacctcgcgcttgctggccagtccaccctgcctgccgtctgtgcttcctcctgcccagaacgcccgctccagcgatctctccactgtgctttcagaagtgcccttcctgctgcgcagttctcccatcctgggacggcggcagtattgaagctcgtgacaagtgccttcacacagacccctcgcaactgtccacgcgtgccgtggcaccaggcgctgcccacctgccggccccggccgcccctcctcgtgaaagtgcatttttgtaaatgtgtacatattaaaggaagcactctgtatatttgattgaataatgccacca

SEQ ID NO: 62945 - DNA, 1166 bp, Homo sapiens
gacagcagagacagcccgttccccctgccgcctgagggcaccagggagagggctgtatgtcctcacgccacactgtgtgtgcagtcagcagtgtggccacagatgggggccactctctcaacctcaggtgtcctcagggcccagaccgctgctgggcacagccaggctggctgccagctggttccctgccccgtggctgggggacagagcagcacgtatcagctgggctagggtcagggggccactggtgcgcagcctggcacagcctggcaggcttgaggcccagtgtgctgggggtggtcacacagccgtcagccacctccagctcttcccgggaccccatctagaatgccctgtttctttaaccttgtataaattattcagtaactgtcaggctgaaaacaatggagtattctcggatagttgctatttttgtaaagtttccgtgcgtggcactcgctgtatgaaaggagagagcaaagggtgtctgcgtcgtcaccaaatcgtagcgtttgttaccagaggttgtgcactgtttacagaatcttccttttattcctcactcgggtttctctgtggctccaggccaaagtgccggtgagacccatggctgtgttggtgtggcccatggctgttggtgggacccgtggctgatggtgtggcctgtggctgtcggtgggactcgtggctgtcaatgggacctgtggctgtcggtgggacctacggtggtcggtgggaccctggttattgatgtggccctggctgccggcacggcccgtggctgttgacgcacctgtggttgttagtggggcctgaggtcatcggcgtggcccaaggccggcaggtcaacctcgcgcttgctggccagtccaccctgcctgccgtctgtgcttcctcctgcccagaacgcccgctccagcgatctctccactgtgctttcagaagtgcccttcctgctgcgcagttctcccatcctgggacggcggcagtattgaagctcgtgacaagtgccttcacacagacccctcgcaactgtccacgcgtgccgtggcaccaggcgctgcccacctgccggccccggccgcccctcctcgtgaaagtgcatttttgtaaatgtgtacatattaaaggaagcactctgtatatttgattgaataatgccacca

SEQ ID NO: 62946 - DNA, 929 bp, Homo sapiens
ctgaggtgatctagaggatcccagaatcaatttctatcattgttttacagatctgggctgaggccatttgctcctgcttggttaaaaaaaataaaaaaataaaaaaaggtttcttcctgtttctttaaccttgtataaattattcagtaactgtcaggctgaaaacaatggagtattctcggatagttgctatttttgtaaagtttccgtgcgtggcactcgctgtatgaaaggagagagcaaagggtgtctgcgtcgtcaccaaatcgtagcgtttgttaccagaggttgtgcactgtttacagaatcttccttttattcctcactcgggtttctctgtggctccaggccaaagtgccggtgagacccatggctgtgttggtgtggcccatggctgttggtgggacccgtggctgatggtgtggcctgtggctgtcggtgggactcgtggctgtcaatgggacctgtggctgtcggtgggacctacggtggtcggtgggaccctggttattgatgtggccctggctgccggcacggcccgtggctgttgacgcacctgtggttgttagtggggcctgaggtcatcggcgtggcccaaggccggcaggtcaacctcgcgcttgctggccagtccaccctgcctgccgtctgtgcttcctcctgcccagaacgcccgctccagcgatctctccactgtgctttcagaagtgcccttcctgctgcgcagttctcccatcctgggacggcggcagtattgaagctcgtgacaagtgccttcacacagacccctcgcaactgtccacgcgtgccgtggcaccaggcgctgcccacctgccggccccggccgcccctcctcgtgaaagtgcatttttgtaaatgtgtacatattaaaggaagcactctgtatatttgattgaataatgccacca

SEQ ID NO: 62947 - DNA, 5157 bp, Homo sapiens
ctcatgcatatgcaggtgcgcgggtgacgaatgggcgagcgagctgtcagtctcgttccgaacttgttggctgcggtgccgggagcgcgggcgcgcagagcccgaggccgggacccgctgccttcaccgccgccgccgtcgccgccgggtgggagccgggccgggcagccggagcgcggccgccagcgagccggagctgccgccgcccctgcacgcccgccgcccaggcccgcgcgccggacgctgcgctcgaccccgcccgcgccgccgccgccgccgcctctgccgctgccgctgcctctgcgggcgctcggagggcgggcgggcgctgggaggccggcgcggcggctgggagccgggcgcgggcggcggcggcggggccgggcgggcgggtcgcgggggcaatgcgggcgcagggccgggggcgccttccccggcggctgctgctgctgctggcgctctgggtgcaggcggcgcggcccatgggctatttcgagctgcagctgagcgcgctgcggaacgtgaacggggagctgctgagcggcgcctgctgtgacggcgacggccggacaacgcgcgcggggggctgcggccacgacgagtgcgacacgtacgtgcgcgtgtgccttaaggagtaccaggccaaggtgacgcccacggggccctgcagctacggccacggcgccacgcccgtgctgggcggcaactccttctacctgccgccggcgggcgctgcgggggaccgagcgcgggcgcgggcccgggccggcggcgaccaggacccgggcctcgtcgtcatccccttccagttcgcctggccgcgctcctttaccctcatcgtggaggcctgggactgggacaacgataccaccccgaatgaggagctgctgatcgagcgagtgtcgcatgccggcatgatcaacccggaggaccgctggaagagcctgcacttcagcggccacgtggcgcacctggagctgcagatccgcgtgcgctgcgacgagaactactacagcgccacttgcaacaagttctgccggccccgcaacgactttttcggccactacacctgcgaccagtacggcaacaaggcctgcatggacggctggatgggcaaggagtgcaaggaagctgtgtgtaaacaagggtgtaatttgctccacgggggatgcaccgtgcctggggagtgcaggtgcagctacggctggcaagggaggttctgcgatgagtgtgtcccctaccccggctgcgtgcatggcagttgtgtggagccctggcagtgcaactgtgagaccaactggggcggcctgctctgtgacaaagacctgaactactgtggcagccaccacccctgcaccaacggaggcacgtgcatcaacgccgagcctgaccagtaccgctgcacctgccctgacggctactcgggcaggaactgtgagaaggctgagcacgcctgcacctccaacccgtgtgccaacgggggctcttgccatgaggtgccgtccggcttcgaatgccactgcccatcgggctggagcgggcccacctgtgcccttgacatcgatgagtgtgcttcgaacccgtgtgcggccggtggcacctgtgtggaccaggtggacggctttgagtgcatctgccccgagcagtgggtgggggccacctgccagctggacgccaatgagtgtgaagggaagccatgccttaacgctttttcttgcaaaaacctgattggcggctattactgtgattgcatcccgggctggaagggcatcaactgccatatcaacgtcaacgactgtcgcgggcagtgtcagcatgggggcacctgcaaggacctggtgaacgggtaccagtgtgtgtgcccacggggcttcggaggccggcattgcgagctggaacgagacaagtgtgccagcagcccctgccacagcggcggcctctgcgaggacctggccgacggcttccactgccactgcccccagggcttctccgggcctctctgtgaggtggatgtcgacctttgtgagccaagcccctgccggaacggcgctcgctgctataacctggagggtgactattactgcgcctgccctgatgactttggtggcaagaactgctccgtgccccgcgagccgtgccctggcggggcctgcagaggtgctgggtgcggcatggggtggtgggggaggtggtggggcaggggcgggcctgactcctgactgtactgcctgccatagtgatcgatggctgcgggtcagacgcggggcctgggatgcctggcacagcagcctccggcgtgtgtggcccccatggacgctgcgtcagccagccagggggcaacttttcctgcatctgtgacagtggctttactggcacctactgccatgagaacattgacgactgcctgggccagccctgccgcaatgggggcacatgcatcgatgaggtggacgccttccgctgcttctgccccagcggctgggagggcgagctctgcgacaccaatcccaacgactgccttcccgatccctgccacagccgcggccgctgctacgacctggtcaatgacttctactgtgcgtgcgacgacggctggaagggcaagacctgccactcacgcgagttccagtgcgatgcctacacctgcagcaacggtggcacctgctacgacagcggcgacaccttccgctgcgcctgcccccccggctggaagggcagcacctgcgccgtcgccaagaacagcagctgcctgcccaacccctgtgtgaatggtggcacctgcgtgggcagcggggcctccttctcctgcatctgccgggacggctgggagggtcgtacttgcactcacaataccaacgactgcaaccctctgccttgctacaatggtggcatctgtgttgacggcgtcaactggttccgctgcgagtgtgcacctggcttcgcggggcctgactgccgcatcaacatcgacgagtgccagtcctcgccctgtgcctacggggccacgtgtgtggatgagatcaacgggtatcgctgtagctgcccacccggccgagccggcccccggtgccaggaagtgatcgggttcgggagatcctgctggtcccggggcactccgttcccacacggaagctcctgggtggaagactgcaacagctgccgctgcctggatggccgccgtgactgcagcaaggtgtggtgcggatggaagccttgtctgctggccggccagcccgaggccctgagcgcccagtgcccactggggcaaaggtgcctggagaaggccccaggccagtgtctgcgaccaccctgtgaggcctggggggagtgcggcgcagaagagccaccgagcaccccctgcctgccacgctccggccacctggacaataactgtgcccgcctcaccttgcatttcaaccgtgaccacgtgccccagggcaccacggtgggcgccatttgctccgggatccgctccctgccagccacaagggctgtggcacgggaccgcctgctggtgttgctttgcgaccgggcgtcctcgggggccagtgccgtggaggtggccgtgtccttcagccctgccagggacctgcctgacagcagcctgatccagggcgcggcccacgccatcgtggccgccatcacccagcgggggaacagctcactgctcctggctgtcaccgaggtcaaggtggagacggttgttacgggcggctcttccacaggtctgctggtgcctgtgctgtgtggtgccttcagcgtgctgtggctggcgtgcgtggtcctgtgcgtgtggtggacacgcaagcgcaggaaagagcgggagaggagccggctgccgcgggaggagagcgccaacaaccagtgggccccgctcaaccccatccgcaaccccatcgagcggccggggggccacaaggacgtgctctaccagtgcaagaacttcacgccgccgccgcgcagggcggacgaggcgctgcccgggccggccggccacgcggccgtcagggaggatgaggaggacgaggatctgggccgcggtgaggaggactccctggaggcggagaagttcctctcacacaaattcaccaaagatcctggccgctcgccggggaggccggcccactgggcctcaggccccaaagtggacaaccgcgcggtcaggagcatcaatgaggcccgctacgccggcaaggagtaggggcggctgccagctgggccgggacccagggccctcggtgggagccatgccgtctgccggacccggaggccgaggccatgtgcatagtttctttattttgtgtaaaaaaaccaccaaaaacaaaaaccaaatgtttattttctacgtttctttaaccttgtataaattattcagtaactgtcaggctgaaaacaatggagtattctcggatagttgctatttttgtaaagtttccgtgcgtggcactcgctgtatgaaaggagagagcaaagggtgtctgcgtcgtcaccaaatcgtagcgtttgttaccagaggttgtgcactgtttacagaatcttccttttattcctcactcgggtttctctgtggctccaggccaaagtgccggtgagacccatggctgtgttggtgtggcccatggctgttggtgggacccgtggctgatggtgtggcctgtggctgtcggtgggactcgtggctgtcaatgggacctgtggctgtcggtgggacctacggtggtcggtgggaccctggttattgatgtggccctggctgccggcacggcccgtggctgttgacgcacctgtggttgttagtggggcctgaggtcatcggcgtggcccaaggccggcaggtcaacctcgcgcttgctggccagtccaccctgcctgccgtctgtgcttcctcctgcccagaacgcccgctccagcgatctctccactgtgctttcagaagtgcccttcctgctgcgcagttctcccatcctgggacggcggcagtattgaagctcgtgacaagtgccttcacacagacccctcgcaactgtccacgcgtgccgtggcaccaggcgctgcccacctgccggccccggccgcccctcctcgtgaaagtgcatttttgtaaatgtgtacatattaaaggaagcactctgtatatttgattgaataatgccacca

SEQ ID NO: 62948 - DNA, 1832 bp, Homo sapiens
ccttatgctaggtagaggctggggtttaattcggccgaggcacgctccggccacctggacaataactgtgcccgcctcaccttgcatttcaaccgtgaccacgtgccccagggcaccacggtgggcgccatttgctccgggatccgctccctgccagccacaagggctgtggcacgggaccgcctgctggtgttgctttgcgaccgggcgtcctcgggggccagtgccgtggaggtggccgtgtccttcagccctgccagggacctgcctgacagcagcctgatccagggcgcggcccacgccatcgtggccgccatcacccagcgggggaacagctcactgctcctggctgtcaccgaggtcaaggtggagacggttgttacgggcggctcttccacaggtctgctggtgcctgtgctgtgtggtgccttcagcgtgctgtggctggcgtgcgtggtcctgtgcgtgtggtggacacgcaagcgcaggaaagagcgggagaggagccggctgccgcgggaggagagcgccaacaaccagtgggccccgctcaaccccatccgcaaccccatcgagcggccggggggccacaaggacgtgctctaccagtgcaagaacttcacgccgccgccgcgcagggcggacgaggcgctgcccgggccggccggccacgcggccgtcagggaggatgaggaggacgaggatctgggccgcggtgaggaggactccctggaggcggagaagttcctctcacacaaattcaccaaagatcctggccgctcgccggggaggccggcccactgggcctcaggccccaaagtggacaaccgcgcggtcaggagcatcaatgaggcccgctacgccggcaaggagtaggggcggctgccagctgggccgggacccagggccctcggtgggagccatgccgtctgccggacccggaggccgaggccatgtgcatagtttctttattttgtgtaaaaaaaccaccaaaaacaaaaaccaaatgtttattttctacgtttctttaaccttgtataaattattcagtaactgtcaggctgaaaacaatggagtattctcggatagttgctatttttgtaaagtttccgtgcgtggcactcgctgtatgaaaggagagagcaaagggtgtctgcgtcgtcaccaaatcgtagcgtttgttaccagaggttgtgcactgtttacagaatcttccttttattcctcactcgggtttctctgtggctccaggccaaagtgccggtgagacccatggctgtgttggtgtggcccatggctgttggtgggacccgtggctgatggtgtggcctgtggctgtcggtgggactcgtggctgtcaatgggacctgtggctgtcggtgggacctacggtggtcggtgggaccctggttattgatgtggccctggctgccggcacggcccgtggctgttgacgcacctgtggttgttagtggggcctgaggtcatcggcgtggcccaaggccggcaggtcaacctcgcgcttgctggccagtccaccctgcctgccgtctgtgcttcctcctgcccagaacgcccgctccagcgatctctccactgtgctttcagaagtgcccttcctgctgcgcagttctcccatcctgggacggcggcagtattgaagctcgtgacaagtgccttcacacagacccctcgcaactgtccacgcgtgccgtggcaccaggcgctgcccacctgccggccccggccgcccctcctcgtgaaagtgcatttttgtaaatgtgtacatattaaaggaagcactctgtatatttgattgaataatgccacca

SEQ ID NO: 62949 - DNA, 2249 bp, Homo sapiens
gctgatacggtccggaattttgggatctggcttcgcggggcctgactgccgcataacatcgacgagtgccagtcctcgccctgtgcctacggggccacgtgtgtggatgagatcaacgggtatcgctgtagctgcccacccggccgagccggcccccggtgccaggaagtgatcgggttcgggagatcctgctggtcccggggcactccgttcccacacggaagctcctgggtggaagactgcaacagctgccgctgcctggatggccgccgtgactgcagcaaggtgtggtgcggatggaagccttgtctgctggccggccagcccgaggccctgagcgcccagtgcccactggggcaaaggtgcctggagaaggccccaggccagtgtctgcgaccaccctgtgaggcctggggggagtgcggcgcagaagagccaccgagcaccccctgcctgccacgctccggccacctggacaataactgtgcccgcctcaccttgcatttcaaccgtgaccacgtgccccagggcaccacggtgggcgccatttgctccgggatccgctccctgccagccacaagggctgtggcacgggaccgcctgctggtgttgctttgcgaccgggcgtcctcgggggccagtgccgtggaggtggccgtgtccttcagccctgccagggacctgcctgacagcagcctgatccagggcgcggcccacgccatcgtggccgccatcacccagcgggggaacagctcactgctcctggctgtcaccgaggtcaaggtggagacggttgttacgggcggctcttccacaggtctgctggtgcctgtgctgtgtggtgccttcagcgtgctgtggctggcgtgcgtggtcctgtgcgtgtggtggacacgcaagcgcaggaaagagcgggagaggagccggctgccgcgggaggagagcgccaacaaccagtgggccccgctcaaccccatccgcaaccccatcgagcggccggggggccacaaggacgtgctctaccagtgcaagaacttcacgccgccgccgcgcagggcggacgaggcgctgcccgggccggccggccacgcggccgtcagggaggatgaggaggacgaggatctgggccgcggtgaggaggactccctggaggcggagaagttcctctcacacaaattcaccaaagatcctggccgctcgccggggaggccggcccactgggcctcaggccccaaagtggacaaccgcgcggtcaggagcatcaatgaggcccgctacgccggcaaggagtaggggcggctgccagctgggccgggacccagggccctcggtgggagccatgccgtctgccggacccggaggccgaggccatgtgcatagtttctttattttgtgtaaaaaaaccaccaaaaacaaaaaccaaatgtttattttctacgtttctttaaccttgtataaattattcagtaactgtcaggctgaaaacaatggagtattctcggatagttgctatttttgtaaagtttccgtgcgtggcactcgctgtatgaaaggagagagcaaagggtgtctgcgtcgtcaccaaatcgtagcgtttgttaccagaggttgtgcactgtttacagaatcttccttttattcctcactcgggtttctctgtggctccaggccaaagtgccggtgagacccatggctgtgttggtgtggcccatggctgttggtgggacccgtggctgatggtgtggcctgtggctgtcggtgggactcgtggctgtcaatgggacctgtggctgtcggtgggacctacggtggtcggtgggaccctggttattgatgtggccctggctgccggcacggcccgtggctgttgacgcacctgtggttgttagtggggcctgaggtcatcggcgtggcccaaggccggcaggtcaacctcgcgcttgctggccagtccaccctgcctgccgtctgtgcttcctcctgcccagaacgcccgctccagcgatctctccactgtgctttcagaagtgcccttcctgctgcgcagttctcccatcctgggacggcggcagtattgaagctcgtgacaagtgccttcacacagacccctcgcaactgtccacgcgtgccgtggcaccaggcgctgcccacctgccggccccggccgcccctcctcgtgaaagtgcatttttgtaaatgtgtacatattaaaggaagcactctgtatatttgattgaataatgccacca

SEQ ID NO: 62950 - DNA, 4963 bp, Homo sapiens
ctcatgcatatgcaggtgcgcgggtgacgaatgggcgagcgagctgtcagtctcgttccgaacttgttggctgcggtgccgggagcgcgggcgcgcagagcccgaggccgggacccgctgccttcaccgccgccgccgtcgccgccgggtgggagccgggccgggcagccggagcgcggccgccagcgagccggagctgccgccgcccctgcacgcccgccgcccaggcccgcgcgccggacgctgcgctcgaccccgcccgcgccgccgccgccgccgcctctgccgctgccgctgcctctgcgggcgctcggagggcgggcgggcgctgggaggccggcgcggcggctgggagccgggcgcgggcggcggcggcggggccgggcgggcgggtcgcgggggcaatgcgggcgcagggccgggggcgccttccccggcggctgctgctgctgctggcgctctgggtgcaggcggcgcggcccatgggctatttcgagctgcagctgagcgcgctgcggaacgtgaacggggagctgctgagcggcgcctgctgtgacggcgacggccggacaacgcgcgcggggggctgcggccacgacgagtgcgacacgtacgtgcgcgtgtgccttaaggagtaccaggccaaggtgacgcccacggggccctgcagctacggccacggcgccacgcccgtgctgggcggcaactccttctacctgccgccggcgggcgctgcgggggaccgagcgcgggcgcgggcccgggccggcggcgaccaggacccgggcctcgtcgtcatccccttccagttcgcctggccgcgctcctttaccctcatcgtggaggcctgggactgggacaacgataccaccccgaatgaggagctgctgatcgagcgagtgtcgcatgccggcatgatcaacccggaggaccgctggaagagcctgcacttcagcggccacgtggcgcacctggagctgcagatccgcgtgcgctgcgacgagaactactacagcgccacttgcaacaagttctgccggccccgcaacgactttttcggccactacacctgcgaccagtacggcaacaaggcctgcatggacggctggatgggcaaggagtgcaaggaagctgtgtgtaaacaagggtgtaatttgctccacgggggatgcaccgtgcctggggagtgcaggtgcagctacggctggcaagggaggttctgcgatgagtgtgtcccctaccccggctgcgtgcatggcagttgtgtggagccctggcagtgcaactgtgagaccaactggggcggcctgctctgtgacaaagacctgaactactgtggcagccaccacccctgcaccaacggaggcacgtgcatcaacgccgagcctgaccagtaccgctgcacctgccctgacggctactcgggcaggaactgtgagaaggctgagcacgcctgcacctccaacccgtgtgccaacgggggctcttgccatgaggtgccgtccggcttcgaatgccactgcccatcgggctggagcgggcccacctgtgcccttgacatcgatgagtgtgcttcgaacccgtgtgcggccggtggcacctgtgtggaccaggtggacggctttgagtgcatctgccccgagcagtgggtgggggccacctgccagctggacgtcaacgactgtcgcgggcagtgtcagcatgggggcacctgcaaggacctggtgaacgggtaccagtgtgtgtgcccacggggcttcggaggccggcattgcgagctggaacgagacaagtgtgccagcagcccctgccacagcggcggcctctgcgaggacctggccgacggcttccactgccactgcccccagggcttctccgggcctctctgtgaggtggatgtcgacctttgtgagccaagcccctgccggaacggcgctcgctgctataacctggagggtgactattactgcgcctgccctgatgactttggtggcaagaactgctccgtgccccgcgagccgtgccctggcggggcctgcagagtgatcgatggctgcgggtcagacgcggggcctgggatgcctggcacagcagcctccggcgtgtgtggcccccatggacgctgcgtcagccagccagggggcaacttttcctgcatctgtgacagtggctttactggcacctactgccatgagaacattgacgactgcctgggccagccctgccgcaatgggggcacatgcatcgatgaggtggacgccttccgctgcttctgccccagcggctgggagggcgagctctgcgacaccaatcccaacgactgccttcccgatccctgccacagccgcggccgctgctacgacctggtcaatgacttctactgtgcgtgcgacgacggctggaagggcaagacctgccactcacgcgagttccagtgcgatgcctacacctgcagcaacggtggcacctgctacgacagcggcgacaccttccgctgcgcctgcccccccggctggaagggcagcacctgcgccgtcgccaagaacagcagctgcctgcccaacccctgtgtgaatggtggcacctgcgtgggcagcggggcctccttctcctgcatctgccgggacggctgggagggtcgtacttgcactcacaataccaacgactgcaaccctctgccttgctacaatggtggcatctgtgttgacggcgtcaactggttccgctgcgagtgtgcacctggcttcgcggggcctgactgccgcatcaacatcgacgagtgccagtcctcgccctgtgcctacggggccacgtgtgtggatgagatcaacgggtatcgctgtagctgcccacccggccgagccggcccccggtgccaggaagtgatcgggttcgggagatcctgctggtcccggggcactccgttcccacacggaagctcctgggtggaagactgcaacagctgccgctgcctggatggccgccgtgactgcagcaaggtgtggtgcggatggaagccttgtctgctggccggccagcccgaggccctgagcgcccagtgcccactggggcaaaggtgcctggagaaggccccaggccagtgtctgcgaccaccctgtgaggcctggggggagtgcggcgcagaagagccaccgagcaccccctgcctgccacgctccggccacctggacaataactgtgcccgcctcaccttgcatttcaaccgtgaccacgtgccccagggcaccacggtgggcgccatttgctccgggatccgctccctgccagccacaagggctgtggcacgggaccgcctgctggtgttgctttgcgaccgggcgtcctcgggggccagtgccgtggaggtggccgtgtccttcagccctgccagggacctgcctgacagcagcctgatccagggcgcggcccacgccatcgtggccgccatcacccagcgggggaacagctcactgctcctggctgtcaccgaggtcaaggtggagacggttgttacgggcggctcttccacaggtctgctggtgcctgtgctgtgtggtgccttcagcgtgctgtggctggcgtgcgtggtcctgtgcgtgtggtggacacgcaagcgcaggaaagagcgggagaggagccggctgccgcgggaggagagcgccaacaaccagtgggccccgctcaaccccatccgcaaccccatcgagcggccggggggccacaaggacgtgctctaccagtgcaagaacttcacgccgccgccgcgcagggcggacgaggcgctgcccgggccggccggccacgcggccgtcagggaggatgaggaggacgaggatctgggccgcggtgaggaggactccctggaggcggagaagttcctctcacacaaattcaccaaagatcctggccgctcgccggggaggccggcccactgggcctcaggccccaaagtggacaaccgcgcggtcaggagcatcaatgaggcccgctacgccggcaaggagtaggggcggctgccagctgggccgggacccagggccctcggtgggagccatgccgtctgccggacccggaggccgaggccatgtgcatagtttctttattttgtgtaaaaaaaccaccaaaaacaaaaaccaaatgtttattttctacgtttctttaaccttgtataaattattcagtaactgtcaggctgaaaacaatggagtattctcggatagttgctatttttgtaaagtttccgtgcgtggcactcgctgtatgaaaggagagagcaaagggtgtctgcgtcgtcaccaaatcgtagcgtttgttaccagaggttgtgcactgtttacagaatcttccttttattcctcactcgggtttctctgtggctccaggccaaagtgccggtgagacccatggctgtgttggtgtggcccatggctgttggtgggacccgtggctgatggtgtggcctgtggctgtcggtgggactcgtggctgtcaatgggacctgtggctgtcggtgggacctacggtggtcggtgggaccctggttattgatgtggccctggctgccggcacggcccgtggctgttgacgcacctgtggttgttagtggggcctgaggtcatcggcgtggcccaaggccggcaggtcaacctcgcgcttgctggccagtccaccctgcctgccgtctgtgcttcctcctgcccagaacgcccgctccagcgatctctccactgtgctttcagaagtgcccttcctgctgcgcagttctcccatcctgggacggcggcagtattgaagctcgtgacaagtgccttcacacagacccctcgcaactgtccacgcgtgccgtggcaccaggcgctgcccacctgccggccccggccgcccctcctcgtgaaagtgcatttttgtaaatgtgtacatattaaaggaagcactctgtatatttgattgaataatgccacca

SEQ ID NO: 62951 - DNA, 5095 bp, Homo sapiens
ctcatgcatatgcaggtgcgcgggtgacgaatgggcgagcgagctgtcagtctcgttccgaacttgttggctgcggtgccgggagcgcgggcgcgcagagcccgaggccgggacccgctgccttcaccgccgccgccgtcgccgccgggtgggagccgggccgggcagccggagcgcggccgccagcgagccggagctgccgccgcccctgcacgcccgccgcccaggcccgcgcgccggacgctgcgctcgaccccgcccgcgccgccgccgccgccgcctctgccgctgccgctgcctctgcgggcgctcggagggcgggcgggcgctgggaggccggcgcggcggctgggagccgggcgcgggcggcggcggcggggccgggcgggcgggtcgcgggggcaatgcgggcgcagggccgggggcgccttccccggcggctgctgctgctgctggcgctctgggtgcaggcggcgcggcccatgggctatttcgagctgcagctgagcgcgctgcggaacgtgaacggggagctgctgagcggcgcctgctgtgacggcgacggccggacaacgcgcgcggggggctgcggccacgacgagtgcgacacgtacgtgcgcgtgtgccttaaggagtaccaggccaaggtgacgcccacggggccctgcagctacggccacggcgccacgcccgtgctgggcggcaactccttctacctgccgccggcgggcgctgcgggggaccgagcgcgggcgcgggcccgggccggcggcgaccaggacccgggcctcgtcgtcatccccttccagttcgcctggccgcgctcctttaccctcatcgtggaggcctgggactgggacaacgataccaccccgaatgaggagctgctgatcgagcgagtgtcgcatgccggcatgatcaacccggaggaccgctggaagagcctgcacttcagcggccacgtggcgcacctggagctgcagatccgcgtgcgctgcgacgagaactactacagcgccacttgcaacaagttctgccggccccgcaacgactttttcggccactacacctgcgaccagtacggcaacaaggcctgcatggacggctggatgggcaaggagtgcaaggaagctgtgtgtaaacaagggtgtaatttgctccacgggggatgcaccgtgcctggggagtgcaggtgcagctacggctggcaagggaggttctgcgatgagtgtgtcccctaccccggctgcgtgcatggcagttgtgtggagccctggcagtgcaactgtgagaccaactggggcggcctgctctgtgacaaagacctgaactactgtggcagccaccacccctgcaccaacggaggcacgtgcatcaacgccgagcctgaccagtaccgctgcacctgccctgacggctactcgggcaggaactgtgagaaggctgagcacgcctgcacctccaacccgtgtgccaacgggggctcttgccatgaggtgccgtccggcttcgaatgccactgcccatcgggctggagcgggcccacctgtgcccttgacatcgatgagtgtgcttcgaacccgtgtgcggccggtggcacctgtgtggaccaggtggacggctttgagtgcatctgccccgagcagtgggtgggggccacctgccagctggacgccaatgagtgtgaagggaagccatgccttaacgctttttcttgcaaaaacctgattggcggctattactgtgattgcatcccgggctggaagggcatcaactgccatatcaacgtcaacgactgtcgcgggcagtgtcagcatgggggcacctgcaaggacctggtgaacgggtaccagtgtgtgtgcccacggggcttcggaggccggcattgcgagctggaacgagacaagtgtgccagcagcccctgccacagcggcggcctctgcgaggacctggccgacggcttccactgccactgcccccagggcttctccgggcctctctgtgaggcaccccccaccctgcaggtggatgtcgacctttgtgagccaagcccctgccggaacggcgctcgctgctataacctggagggtgactattactgcgcctgccctgatgactttggtggcaagaactgctccgtgccccgcgagccgtgccctggcggggcctgcagagtgatcgatggctgcgggtcagacgcggggcctgggatgcctggcacagcagcctccggcgtgtgtggcccccatggacgctgcgtcagccagccagggggcaacttttcctgcatctgtgacagtggctttactggcacctactgccatgagaacattgacgactgcctgggccagccctgccgcaatgggggcacatgcatcgatgaggtggacgccttccgctgcttctgccccagcggctgggagggcgagctctgcgacaccaatcccaacgactgccttcccgatccctgccacagccgcggccgctgctacgacctggtcaatgacttctactgtgcgtgcgacgacggctggaagggcaagacctgccactcacgcgagttccagtgcgatgcctacacctgcagcaacggtggcacctgctacgacagcggcgacaccttccgctgcgcctgcccccccggctggaagggcagcacctgcgccgtcgccaagaacagcagctgcctgcccaacccctgtgtgaatggtggcacctgcgtgggcagcggggcctccttctcctgcatctgccgggacggctgggagggtcgtacttgcactcacaataccaacgactgcaaccctctgccttgctacaatggtggcatctgtgttgacggcgtcaactggttccgctgcgagtgtgcacctggcttcgcggggcctgactgccgcatcaacatcgacgagtgccagtcctcgccctgtgcctacggggccacgtgtgtggatgagatcaacgggtatcgctgtagctgcccacccggccgagccggcccccggtgccaggaagtgatcgggttcgggagatcctgctggtcccggggcactccgttcccacacggaagctcctgggtggaagactgcaacagctgccgctgcctggatggccgccgtgactgcagcaaggtgtggtgcggatggaagccttgtctgctggccggccagcccgaggccctgagcgcccagtgcccactggggcaaaggtgcctggagaaggccccaggccagtgtctgcgaccaccctgtgaggcctggggggagtgcggcgcagaagagccaccgagcaccccctgcctgccacgctccggccacctggacaataactgtgcccgcctcaccttgcatttcaaccgtgaccacgtgccccagggcaccacggtgggcgccatttgctccgggatccgctccctgccagccacaagggctgtggcacgggaccgcctgctggtgttgctttgcgaccgggcgtcctcgggggccagtgccgtggaggtggccgtgtccttcagccctgccagggacctgcctgacagcagcctgatccagggcgcggcccacgccatcgtggccgccatcacccagcgggggaacagctcactgctcctggctgtcaccgaggtcaaggtggagacggttgttacgggcggctcttccacaggtctgctggtgcctgtgctgtgtggtgccttcagcgtgctgtggctggcgtgcgtggtcctgtgcgtgtggtggacacgcaagcgcaggaaagagcgggagaggagccggctgccgcgggaggagagcgccaacaaccagtgggccccgctcaaccccatccgcaaccccatcgagcggccggggggccacaaggacgtgctctaccagtgcaagaacttcacgccgccgccgcgcagggcggacgaggcgctgcccgggccggccggccacgcggccgtcagggaggatgaggaggacgaggatctgggccgcggtgaggaggactccctggaggcggagaagttcctctcacacaaattcaccaaagatcctggccgctcgccggggaggccggcccactgggcctcaggccccaaagtggacaaccgcgcggtcaggagcatcaatgaggcccgctacgccggcaaggagtaggggcggctgccagctgggccgggacccagggccctcggtgggagccatgccgtctgccggacccggaggccgaggccatgtgcatagtttctttattttgtgtaaaaaaaccaccaaaaacaaaaaccaaatgtttattttctacgtttctttaaccttgtataaattattcagtaactgtcaggctgaaaacaatggagtattctcggatagttgctatttttgtaaagtttccgtgcgtggcactcgctgtatgaaaggagagagcaaagggtgtctgcgtcgtcaccaaatcgtagcgtttgttaccagaggttgtgcactgtttacagaatcttccttttattcctcactcgggtttctctgtggctccaggccaaagtgccggtgagacccatggctgtgttggtgtggcccatggctgttggtgggacccgtggctgatggtgtggcctgtggctgtcggtgggactcgtggctgtcaatgggacctgtggctgtcggtgggacctacggtggtcggtgggaccctggttattgatgtggccctggctgccggcacggcccgtggctgttgacgcacctgtggttgttagtggggcctgaggtcatcggcgtggcccaaggccggcaggtcaacctcgcgcttgctggccagtccaccctgcctgccgtctgtgcttcctcctgcccagaacgcccgctccagcgatctctccactgtgctttcagaagtgcccttcctgctgcgcagttctcccatcctgggacggcggcagtattgaagctcgtgacaagtgccttcacacagacccctcgcaactgtccacgcgtgccgtggcaccaggcgctgcccacctgccggccccggccgcccctcctcgtgaaagtgcatttttgtaaatgtgtacatattaaaggaagcactctgtatatttgattgaataatgccacca

SEQ ID NO: 62952 - DNA, 3321 bp, Homo sapiens
ctcatgcatatgcaggtgcgcgggtgacgaatgggcgagcgagctgtcagtctcgttccgaacttgttggctgcggtgccgggagcgcgggcgcgcagagcccgaggccgggacccgctgccttcaccgccgccgccgtcgccgccgggtgggagccgggccgggcagccggagcgcggccgccagcgagccggagctgccgccgcccctgcacgcccgccgcccaggcccgcgcgccggacgctgcgctcgaccccgcccgcgccgccgccgccgccgcctctgccgctgccgctgcctctgcgggcgctcggagggcgggcgggcgctgggaggccggcgcggcggctgggagccgggcgcgggcggcggcggcggggccgggcgggcgggtcgcgggggcaatgcgggcgcagggccgggggcgccttccccggcggctgctgctgctgctggcgctctgggtgcaggcggcgcggcccatgggctatttcgagctgcagctgagcgcgctgcggaacgtgaacggggagctgctgagcggcgcctgctgtgacggcgacggccggacaacgcgcgcggggggctgcggccacgacgagtgcgacacgtacgtgcgcgtgtgccttaaggagtaccaggccaaggtgacgcccacggggccctgcagctacggccacggcgccacgcccgtgctgggcggcaactccttctacctgccgccggcgggcgctgcgggggaccgagcgcgggcgcgggcccgggccggcggcgaccaggacccgggcctcgtcgtcatccccttccagttcgcctggccgcgctcctttaccctcatcgtggaggcctgggactgggacaacgataccaccccgaatgaggagctgctgatcgagcgagtgtcgcatgccggcatgatcaacccggaggaccgctggaagagcctgcacttcagcggccacgtggcgcacctggagctgcagatccgcgtgcgctgcgacgagaactactacagcgccacttgcaacaagttctgccggccccgcaacgactttttcggccactacacctgcgaccagtacggcaacaaggcctgcatggacggctggatgggcaaggagtgcaaggaagctgtgtgtaaacaagggtgtaatttgctccacgggggatgcaccgtgcctggggagtgcaggtgcagctacggctggcaagggaggttctgcgatgagtgtgtcccctaccccggctgcgtgcatggcagttgtgtggagccctggcagtgcaactgtgagaccaactggggcggcctgctctgtgacaaagacctgaactactgtggcagccaccacccctgcaccaacggaggcacgtgcatcaacgccgagcctgaccagtaccgctgcacctgccctgacggctactcgggcaggaactgtgagaaggctgagcacgcctgcacctccaacccgtgtgccaacgggggctcttgccatgaggtgccgtccggcttcgaatgccactgcccatcgggctggagcgggcccacctgtgcccttgacatcgatgagtgtgcttcgaacccgtgtgcggccggtggcacctgtgtggaccaggtggacggctttgagtgcatctgccccgagcagtgggtgggggccacctgccagctggacgccaatgagtgtgaagggaagccatgccttaacgctttttcttgcaaaaacctgattggcggctattactgtgattgcatcccgggctggaagggcatcaactgccatatcaacgtcaacgactgtcgcgggcagtgtcagcatgggggcacctgcaaggacctggtgaacgggtaccagtgtgtgtgcccacggggcttcggaggccggcattgcgagctggaacgagacaagtgtgccagcagcccctgccacagcggcggcctctgcgaggacctggccgacggcttccactgccactgcccccagggcttctccgggcctctctgtgaggtggatgtcgacctttgtgagccaagcccctgccggaacggcgctcgctgctataacctggagggtgactattactgcgcctgccctgatgactttggtggcaagaactgctccgtgccccgcgagccgtgccctggcggggcctgcagagtgatcgatggctgcgggtcagacgcggggcctgggatgcctggcacagcagcctccggcgtgtgtggcccccatggacgctgcgtcagccagccagggggcaacttttcctgcatctgtgacagtggctttactggcacctactgccatgagaacattgacgactgcctgggccagccctgccgcaatgggggcacatgcatcgatgaggtggacgccttccgctgcttctgccccagcggctgggagggcgagctctgcgacaccaatcccaacgactgccttcccgatccctgccacagccgcggccgctgctacgacctggtcaatgacttctactgtgcgtgcgacgacggctggaagggcaagacctgccactcacgcgagttccagtgcgatgcctacacctgcagcaacggtggcacctgctacgacagcggcgacaccttccgctgcgcctgcccccccggctggaagggcagcacctgcgccgtcgccaagaacagcagctgcctgcccaacccctgtgtgaatggtggcacctgcgtgggcagcggggcctccttctcctgcatctgccgggacggctgggagggtcgtacttgcactcacaataccaacgactgcaaccctctgccttggtgagtggcaccctgggggccacagcaggggtgggtgggacttggcatacaacggggggccacctgatgcccaccctctgctctgcagctacaatggtggcatctgtgttgacggcgtcaactggttccgctgcgagtgtgcacctggcttcgcggggcctgactgccgcatcagtgagtggccagacagccccagccctgggagcccctcagcccagccgcggtgtcaggagtctggggacatcaacgtccacgtcccttgaagggcagtgtggccacaactacttcctgcctctcttctgagcctcagtttccccacatgtctgtgccctgtggggttcctgctgtataccctgccaagtgattaagtggggagccccagcctgggggaccagtccggggcccagggagctgtgggggttggagcgtgcagcctgacgtgggctcctctgtggccgcagggctgttgtccctgggtgttggcccagctgtctgtccagcaccccttggctggtccgacgcag

SEQ ID NO: 62953 - DNA, 1996 bp, Homo sapiens
tgcgcctgaccctcctgtgcgtgcctgcccaggtgtggtgcggatggaagccttgtctgctggccggccagcccgaggccctgagcgcccagtgcccactggggcaaaggtgcctggagaaggccccaggccagtgtctgcgaccaccctgtgaggcctggggggagtgcggcgcagaagagccaccgagcaccccctgcctgccacgctccggccacctggacaataactgtgcccgcctcaccttgcatttcaaccgtgaccacgtgccccagggcaccacggtgggcgccatttgctccgggatccgctccctgccagccacaagggctgtggcacgggaccgcctgctggtgttgctttgcgaccgggcgtcctcgggggccagtgccgtggaggtggccgtgtccttcagccctgccagggacctgcctgacagcagcctgatccagggcgcggcccacgccatcgtggccgccatcacccagcgggggaacagctcactgctcctggctgtcaccgaggtcaaggtggagacggttgttacgggcggctcttccacaggtctgctggtgcctgtgctgtgtggtgccttcagcgtgctgtggctggcgtgcgtggtcctgtgcgtgtggtggacacgcaagcgcaggaaagagcgggagaggagccggctgccgcgggaggagagcgccaacaaccagtgggccccgctcaaccccatccgcaaccccatcgagcggccggggggccacaaggacgtgctctaccagtgcaagaacttcacgccgccgccgcgcagggcggacgaggcgctgcccgggccggccggccacgcggccgtcagggaggatgaggaggacgaggatctgggccgcggtgaggaggactccctggaggcggagaagttcctctcacacaaattcaccaaagatcctggccgctcgccggggaggccggcccactgggcctcaggccccaaagtggacaaccgcgcggtcaggagcatcaatgaggcccgctacgccggcaaggagtaggggcggctgccagctgggccgggacccagggccctcggtgggagccatgccgtctgccggacccggaggccgaggccatgtgcatagtttctttattttgtgtaaaaaaaccaccaaaaacaaaaaccaaatgtttattttctacgtttctttaaccttgtataaattattcagtaactgtcaggctgaaaacaatggagtattctcggatagttgctatttttgtaaagtttccgtgcgtggcactcgctgtatgaaaggagagagcaaagggtgtctgcgtcgtcaccaaatcgtagcgtttgttaccagaggttgtgcactgtttacagaatcttccttttattcctcactcgggtttctctgtggctccaggccaaagtgccggtgagacccatggctgtgttggtgtggcccatggctgttggtgggacccgtggctgatggtgtggcctgtggctgtcggtgggactcgtggctgtcaatgggacctgtggctgtcggtgggacctacggtggtcggtgggaccctggttattgatgtggccctggctgccggcacggcccgtggctgttgacgcacctgtggttgttagtggggcctgaggtcatcggcgtggcccaaggccggcaggtcaacctcgcgcttgctggccagtccaccctgcctgccgtctgtgcttcctcctgcccagaacgcccgctccagcgatctctccactgtgctttcagaagtgcccttcctgctgcgcagttctcccatcctgggacggcggcagtattgaagctcgtgacaagtgccttcacacagacccctcgcaactgtccacgcgtgccgtggcaccaggcgctgcccacctgccggccccggccgcccctcctcgtgaaagtgcatttttgtaaatgtgtacatattaaaggaagcactctgtatatttgattgaataatgccacca

SEQ ID NO: 62954 - DNA, 296 bp, Homo sapiens
gtctataaatagtcatttcttaatgatcacattttaggaagatgatgctgttctttcttcttaagtatttatttttatcagtcaagtgataggaagttcaatttcaagtacaagacatttggatcaagaagtgactattatttatttatttgagatggagtcttgctctgttgcccaagctggagtgcagtggtgtgatctcagctcactgcaacttcctcctcctgggttcaagcaattccgctgcctcagcctcccgagtagctggaattacaggcacccaccggcccagtgaa

SEQ ID NO: 62955 - DNA, 362 bp, Homo sapiens
catatcacaactcaaatttctattttgtgcttttgcctcatgtcttctgaatgagacttttgcagaaggtgcaacttcaggaatctgtgattttcaaaattgcttcatgttattctgttgcagtgaggcagtttgggaaccagtgccctagactatcttatccagtaaggtagggacgctgctaattcgtagagtacttttttgcaaatttggaaaaacatgccttttctggaaagatgcagtcttattgatgtatggcctggcagctagaatgaagactgaatttcagctttctttatattccctcatgtgggagctgtagttcattgtttcatgtacattacataaagcaaaacattaaa

SEQ ID NO: 62956 - DNA, 458 bp, Homo sapiens
taaaatacaagagctttatataataaaaagtaaatgtcacatgtaaatagtttcactgatagagtcacaagcaaaagaagacagaactgttaaacattacaatgtactttcataaccaagaagtgagcacacttgatctaatagatacgattccataaacattgccttaatcaactatggatttcagtgtttgtcttgcctgtggtcaagacattgaaaatatgcttatcattttgacttcgaatattcataaaaattcgatgcccaatcattttttgatgttttaatttagataaaattatgatactataacaatatctgaagaacaactccaaattgggttaaaagtgtgaataaagaggattataatgtcaatgttactctaaatccataattacacatttcattgaattcgccatttcttatatatttctgtgtcttctctctccacaagattt

SEQ ID NO: 62957 - DNA, 407 bp, Homo sapiens
actctggaagcagttctgggctggttgggagggaattttgcagtcccacatacctggaaggtggtctacaacagggaacgtgtgagatctgtccccttggtcttacccatggaggaaggagaagacaagaagtatggtacagaatccttatgattgggcataaaccagctctgatcctctaaggtgtggtctttgccttaaagatcccaaatagctgctggagttccagcctcacatgcactaacagaatggagaaagcaaagaatggcatgatcccacctttaaagaacacttcccagaattttctaaaaatctttctttatattatcattgactagaacatagtcatatgtcgacacctaactatgtctaaaaaatgtagtctttcaatcacacccatggcaaaa

SEQ ID NO: 62958 - DNA, 235 bp, Homo sapiens
atgaaatagagctgtttttagcactgaaccttagaaagggaacaaacaaggtgcaaccccatgtgctttggaacggttgcctgacggtggtacggagagtggagctcaagcagagcaaagaagttcagttgagctgaggatgcacaaattggagttctgggctgctgaagtggttggaacttgctaggcagggtatcagagaaggaggagccaaagtgtacgtgtatgttctccc

SEQ ID NO: 62959 - DNA, 358 bp, Homo sapiens
tgaactgaagagaatcatatatctgtagcttgacttcaacaagagcactgctccggttctaagagattctctttaaagagtaaggagaaacccagtgagttggtgccatggaaggaggatgtacacatcatcacttggagacagtccagggagagacagagctgggctgatcctagttatctgtaaaacagaaatgattatcatggcctcttcctagggcagcaggaatgaggaaatgagggataaatgaaaaggacttaagtgggccaggtgcatagttagtgctcagaagcatcaggtattaaaaataataactactggatggtaggccacaacattattatgttttcagggtgca

SEQ ID NO: 62960 - DNA, 199 bp, Homo sapiens
  misc_feature (3)..(3): n is a, c, g, or t
ttntaatggtcttattttaagctctttggaaaattacagagatcatctctgtaattttccaaagagctaaaaataagaccatcagaaaattatttccctttactggctgatttctagctctctgtttcatataacttgtgtgtgaaaagcacttttgtaactctgaccagttttcattacatcattgtctctcagattg

SEQ ID NO: 62961 - DNA, 309 bp, Homo sapiens
ttcaaatatttatgtatgtttgaacattttcataataaaatgttgaaaaactaatgagaatggcataaacaacatttaagcaatatattttgaaatttaattcaaatggtcaaattcctggaaaacacaaactcccttcactaacagaattgatagaaaatctgagtagttcaccattgttaaagaaatggaatgtgccatttaaaaccctccaattgaaaatactacatatagttacaatagggaattttcccaagcacttaaacaataaacaatgccctcttatacaaacctttcccagtaatagaa

SEQ ID NO: 62962 - DNA, 776 bp, Homo sapiens
cataatatcctcatcttggaaaactttttccagtagtgctgcttttagattttcccactactgcagttgatggttcttaaatatgtttggaactcttatattatttaggtcagtttccaaattacacaaattgtaaccattgtagtcagacctcacttgaatgaaaacaatattttacaaactctgagggtagattcgagttaggatttggattaaaacattatcttaaaacctctgagggtagattcgagttaggagtttcaaaacttctttgaacaatatcataattaggatgtagatttacagagctactagctaaagggaaggacaccagtcattgggatgtataagtttggatctgttgcaaaattaaaatgctgccttttgagcatgcctaataatgcacatacaatagaagagccagaatttttagaaaaatgactgacttgatatacaaccttttgtatatcatagaaggaaaatattagttgagtattttgtttatttacctgtttgtatatataaaacctggggcccaatatacaatagattctttttcactatgcttttcacccacagtgtctcaccaggtactctgtttctagccatctataatttcatagatgtttttctttaaaagggatgtattctaggctgggcgaggtgggtcttgcctgtaatcctagcactttgggaggccaagatgggaggattgcttgaggccagtagttggagatcagcctggtcaacatcatgagatcccatctctgttaaaa

SEQ ID NO: 62963 - DNA, 332 bp, Homo sapiens
aaaaaaaaaaaaaagagatccttagagttcttttcagacaatcgtctcttgaatagatgattacaggagtaagcagcttgcagaaggcgagctagcagtctccttggtgagcactgctttgcgagagtcaagaggttcaggcgctcagttctaggtctgcctccctccccaaggccctgccactatttaagatgtctgtttcctcacatctacataggacaggtacacttgagactccacagataagaaatctgggcactttcaggcaacacccacaatgactgagagtgctatcagtcattgttacaaaagatgttccagtattggccatg

SEQ ID NO: 62964 - DNA, 778 bp, Homo sapiens
tagtagccacattaaacaagataaaaacagctgaaatttttaacaatacagtacatttagcctagcaggtgcaaaatattaacatttcaacatgtaatcagtaaaaaacattgctgagatattttactcgcttttttggtacagagtgttccaaatccggcgtctgttaccttcgcagcacatctgggttcagccgcatgtggcgaattggagagcagggctttagggggttctctttgaggcctctcctaaagtggggtccagccctgttttttttttaggtggggaaattgagaagggacggtgagctcaggttgctccagcagagccaaggcttaaagccagaaccactacaaagtttagagtttgctggagcaaacctctttttccccagtgtgaccccagctgcaccattgagcccttaatggggcgtccatcctttgtcactggagtgaagccttatagcaagcagagagtgaggccacagactcttgagatattctaggccattgcttcgaggtcgtatgtgagatatgaacgtaagaccatttgaacccccaaagtctgggattttaaccctcaagggcaatttgatactgagaggttaagggcacagacttctgaatcatttcctggctgtgttgccttgagtacattcaggagtccctctaagcctcagcttcctcacctggagaacctggagaggttgggaggatcccaggagatgatgccagtaaaaggcagatcacagaccctggcaggttctcagaaaaaaaaa

SEQ ID NO: 62965 - DNA, 219 bp, Homo sapiens
tgagccaccgcgcccggcctaggaagtgtttaaagagtcagtcctagaggcaggaaatgtgccttctgcccaaattgtatgcgccagaactcagccacatgcctattggtagatgaatcattaaacagtatatctgttcctttatgttttaaaaaatatttagtaaaggaaacaataggccattaagtggagaagaaaacatgatacaaagctaaacac

SEQ ID NO: 62966 - DNA, 312 bp, Homo sapiens
gctggagtgcagtggcacaatctcagctcattgcaacctccgcctcctgggttcaagtgattctcctgcctcagcctccggagtcactgagactacaggcgtgcaccaccaatgctcagctaatttttaaatctttagtggagacggggtttcaccatgttggccagggtggtctcaatctcttgacctcatgatccacccaccttggcctcccaaagttctgggattacaggcatgagccactgcacccagctataaattttaactttcaaaggacattcacctcaagtaatttaatagactagacttatt

SEQ ID NO: 62967 - DNA, 745 bp, Homo sapiens
attggtactgaggtatgtgcgtgttttccaaagaagtaaatgtcaaggccacactgttggggtcagatttagccaaaagcttacctaggtaaggttgatgtaatgggaaaggtaatggattgggttcagtaatactgatttttgttcctgactctgagaagcaagccgttttgtctttctgaagcttcagtttcctcactgtatctctaaagtcaccgtagtttcttcctagttctaggtcttgcctattccccatcgctccagactgattgtcttcctttctccttagcacctgtgagaatatgaacttctcttggaggaatgaatgcaaccagtgtaaggcccctaaaccagatggcccaggagggggaccaggtggctctcacatggggggtaactacggggatgatcgtcgtggtggcagaggaggctatgatcgaggcggctaccggggccgcggcggggaccgtggaggcttccgagggggccggggtggtggggacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagttaaa

SEQ ID NO: 62968 - DNA, 349 bp, Homo sapiens
acagcaactattttcaagtgtacagttctgtagcattaagtacattcacagtgttgctcagccaccaccaccatctgtcccccgaactctttttcagctcgcaagacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagttaaa

SEQ ID NO: 62969 - DNA, 705 bp, Homo sapiens
ggtgactctcaggatcttggtcgctcggaccaaggatcacgtcatgactccgaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagctaaagcagctattgactggtttgatggtaaagaattctccggaaatcctatcaaggtctcatttgctactcgtccgagcggaccggtccgctcggaccatgcagaacctcaacgaccgcctggcctcctacctggacaaggtgcgtgctctggaggaggccaacgccgacctggaagtgaagatccgtgactggtaccagaggcagcggcctgctgagatcaaagactacagtccctacttcaagaccattgaggacctgaggaacaagattctcacagccacagtggacaatgccaacgtccttctgcagattgacaatgcccgtctggccgcggatgacttccgcaccaagtatgagacagagttgaacctgcgcatgagtgtggaggccgacatcaatggcctgcgcagggtgctggacgaactggacctggtccgagcgga

SEQ ID NO: 62970 - DNA, 815 bp, Homo sapiens
gctagtacgaggctgggtgtgaatcggccgtggtggctatgaacccagaggtcgtggaggtggccgtggaggcagaggtggcatgggcggaagtgaccgtggtggcttcaataaatttggtggccctcgggaccaaggatcacgtcatgactccgaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagctaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccagatggcccaggagggggaccaggtggctctcacatgggggggtactacgcggatgatcgccgtggtgcagaggaagtatgacgaggcgggaacggggccggggggacggggagcccaaggccggtggggcccagtg

SEQ ID NO: 62971 - DNA, 1148 bp, Homo sapiens
  misc_feature (795)..(795): n is a, c, g, or t
aaacatagctaggtagaggccggggtaatcggactatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatgggcggaagtgaccgtggtggcttcaataaatttggtgncccgcagaccccaccgacacctacggccacaagcggtaccgcacaaaagggcaggagggccactcgccacatcaaggccccacaaagctcagcctgccacagtggagcacgaggtggtgcgggacctgccgccaagccagcaggagagggctacgcggtgccagtgatccagcggcacgagcacagcacagcagagcaacaccaacaacaacacagcaacacttccacacgtcctagcgccactgccaagcacacctcgatcccaagcacagacatggaccgcgacatcaagggacagggagcagagcagctgccggctgtgtgcccatggggaggccagcccaaacccccaa

SEQ ID NO: 62972 - DNA, 295 bp, Homo sapiens
tgtttatcgatgccaccagcatggtggctcaggccatgggtgtatggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccagatggcccaggagggggaccaggtggctctcacatggggggtaactacggggatgatcgtcgtgcatcgataacaccgtacgacattcgta

SEQ ID NO: 62973 - DNA, 1856 bp, Homo sapiens
accgccggtaccggttcggaattcccgggcgtgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatgggcggaagtgaccgtggtggcttcaataaatttggtggccctcgggaccaaggatcacgtcatgactccgaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagctaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccagatggcccaggagggggaccaggtggctctcacatggggggtaactacggggatgatcgtcgtggtggcagaggaggctatgatcgaggcggctaccggggccgcggcggggaccgtggaggcttccgagggggccggggtggtggggacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagttaaa

SEQ ID NO: 62974 - DNA, 2139 bp, Homo sapiens
accgccggtaccggttcggaattcccgggcgtgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatgggcggaagtgaccgtggtggcttcaataaatttggtggccctcgggaccaaggatcacgtcatgactccgaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagctaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccagatggcccaggagggggaccaggtggctctcacatggggggtaactacggggatgatcgtcgtggtggcagaggaggctatgatcgaggcggctaccggggccgcggcggggaccgtggaggcttccgagggggccggggtggtggggacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagttaaaaaaaaaaaggggaccgacaaaaatcctcaggggcagcaaaagacccaagatactgaacaaagagaccacaaagagaccgccaaacagcaagcgcagacgccgacaaacacgcgacagggcacacaacagggacatgtaaaagcaacacgacgcaggaaagaagcacaacaagaagacgcaaaaaaagaaacacacagagtatgcaagacagaaaaacacgaaccaaacacagcacagagacggactagagaacggacaacacccccaggaagatgcacgacca

SEQ ID NO: 62975 - DNA, 2512 bp, Homo sapiens
accgccggtaccggttcggaattcccgggcgtgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatgggcggaagtgaccgtggtggcttcaataaatttggtggccctcgggaccaaggatcacgtcatgactccgaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagctaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccagatggcccaggagggggaccaggtggctctcacatggggggtaactacggggatgatcgtcgtggtggcagaggaggctatgatcgaggcggctaccggggccgcggcggggaccgtggaggcttccgagggggccggggtggtggggacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagttaaaattttgttcctcttcccccttttcactttcctggaagatcgatgtcccgatcaggaaggtagagagttttcctgttcagattaccctgcccagcaggaactggaatacagtgttcggggagaaggccaaatgatatccttgagagcagagattaaacttttctgtcatggggaaagttggtgtataaatgagaaatgaagaacatgggatgtcatgagtgttggcctaaatttgcccagctatggggaatttttcctttaccacatttatttgcatactggtcttagtttatttgcagcagtttatccctttttaagaactctttgatcttttggcccttttaatggtgaggctcaaacaaactacatttaaatggggcagtattcagatttgaccatggtggagagcgcttagccactctgggtctttcacaggaaggagagtaactgagtgctgcaggagtttgtggagtggagtcaggatctaggaggtgagtgactcccttcctagctgccctggtgaacagcgcttgggtagatacctgctataaggagactggtctggctgggttactttcacatcctgcctgtactcagagggcttgaggtcattgacattatgagattttaggcttgatccctttttgattggagggt

SEQ ID NO: 62976 - DNA, 4966 bp, Homo sapiens
accgccggtaccggttcggaattcccgggcgtgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatggggtaggtgtctcatgagccagggagtatctttggtggggagtgtggaggattgcatgaatctccctgaagccagtccctagtgcatggtttagtattcttgttgtctagggatctgtgagggctttgatttgggggcagtgactttctttttacatccccattttatttttgtgagaacttgggagcctgaactcccatccataccactgaatagagattttgagtaatgatacttgtttccaaaaaaaaagaaaccatacatagatacgtatggattggagtcattaatatcctaggcaagaaacatggaagtgaagacttctttctctgcaagggaaaccgatgatcccactcctgggaaatagtagggaaacttggtatgtgtattcccatgtgtcctctagggagttggtaatggttaacctgacttcagcttccaggaattggctactcttcccgttttctatagtcatttgaatccacgagcttgatttgcactaatttgaccgacattgattttgtgtgtgacttggtttatggggccagctgactgaagtaagcagaccttttgggcaaaaatatgctttgacagtggtctcccacctatttgttccactgtctgccttcccctggttacttaaaattcatcagcttgtccaactggaccttctttccttcctgctgaagttgatttgaagtaaaaccttagatttgatgttaaaacagttgtcaaatctgttggtaaataagatttgaaggaccctactctgtctcccttgaaaaaggggaggaatgtcagtgttactgtttttggaaaaagtagatttttaaaccgagtttggaaatggtaagtatgcagaggtgggtgggggcaatctcaaaaacgtgcaaaaatgaggaaaacaaaaatgaggaaatgtgtgcgtgtgtttaatgcaaaactttaaaaagaaaaacaactgttatgtgactgttaacttgctctgcattttatgtgccacaggtatgaaaggtgacattgcaaaatactccgctcttctcgcagtgtagaaggggtgaccccgggggttgggggagatcaaaaacagctcagtagttaggacagagcttagctaagtttgtcttgctttaaggggaagttgcctttggttttgactttttatggaatggggttgggtctgcttgctgctttcaaagcaaaaaccacaaaaatgtgttcaaggctaccccagcctggtgtgaaatgtcttctgggtaaattggggtagggtttttaaaccaactacttggttgtcaaccacttgcgacaagaggaaaaaaaaacatctgctccatcggaagaacgaccaaggaaaatgggttattttttttccagaggaaatagataacgtaaccttttaaagcaaaatctttataaactgtgtctgagaaattgcacacgtgtgtgtgacatgctcaaaggtcagacaaggggtggtcaggaagggatgtattttagtagccacttgtatctttttccaaaaacacctacccatgtttggggaatgttaaacaaaatcaaaaaacaaccttttgtagccgttggaagcttcatgtcctttcttctaacttgtcttctccagcggaagtgaccgtggtggcttcaataaatttggtggtaagtgaacagagtttccaaaattcccaactcccagcaatgctttgtctgattgttcatttgcagatgtcttagcgtgttaatttaaatgtcaaaggttttgaggtgtccagaaccacctccagaaaggggtagggtagaatgccacctgttgcctggtgtgtgctaacctggagcaggtaggggtaagactcaatagtcatcttttaccaaatgggtttgccccaggttaataagaggggtctagtaggccttggactgggccgttgccacacctggcacttagtgaccatcatcatgagaaactggagagtgcgtgctggaacacgtggtgccatcttggctttaggatccttttgatcgttgtgtccaaggcttgtgtgtgtgtgagtgtgtgggagacaactccgaatgtttaattctggaagagggatgtaacattgccctgaggatggtgaagttggtatacatttataaagtacggaatggtgtcaatgaatgcaattctatgtatatggacttaactgagatgggcaaatagaaactagctctgggaaggaacatgtgcactacttcaagaaagattggaagcatgtgtggctcatgggaaataaccaggtcttaaacagcacaaactgaattcgtggaccaggaaggtcttaaacagcacaaactgaattcatggaaaaatgacaaatttgagaagtctcccagtaagctggaacttttctggtttggttaacaaaaggtttcttgatttgtttcaagatttaaagccaaaggtgtgggttcatgacttaggtgtcattgcgtgtgggtacaatatttatatatggcgaattcagataaacattggtcaaagatggtctctggaaaaacaaaatagaggctgcattacggaaataagatttctggtctgttccctgggacatgcttaaaaaatacaatagctattatgtatggtttttattttcatgtggtttcggggaaacaacacggttttaaggatggtttctaaagatgaaattaaaaattgttccacaagggttaagtgtctggtggtaaagttgggagaaactggatggatgcacatcgcatggctggtggcgagcccatctctcttctctcgggtgagagaaccgggccaagctgagttggtttgttcactttaatgggtctccgtttcccctgccacctgtgctgaggacatttcccagcctgagctgggggaggcagcattttctgaagtgtggagttgtctctgtggagactcaagttacagatcttaaggggcctgcctagaattttctcctctgggcaggcgacccaggaaagggtttggagtgaggctgtgagcacttacttgatattttacaagtttggatttggtgttaatttttttccttgtccgttttttcctgttgactaacggctcatcttttccttgtttttgttttttttttgttctttttttccatgtcactaaaggccctcgggaccaaggatcacgtcatgactccgaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagctaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccagatggcccaggagggggaccaggtggctctcacatggggggtaactacggggatgatcgtcgtggtggcagaggaggctatgatcgaggcggctaccggggccgcggcggggaccgtggaggcttccgagggggccggggtggtggggacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagttaaa

SEQ ID NO: 62977 - DNA, 5731 bp, Homo sapiens
accgccggtaccggttcggaattcccgggcgtgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatggggtaggtgtctcatgagccagggagtatctttggtggggagtgtggaggattgcatgaatctccctgaagccagtccctagtgcatggtttagtattcttgttgtctagggatctgtgagggctttgatttgggggcagtgactttctttttacatccccattttatttttgtgagaacttgggagcctgaactcccatccataccactgaatagagattttgagtaatgatacttgtttccaaaaaaaaagaaaccatacatagatacgtatggattggagtcattaatatcctaggcaagaaacatggaagtgaagacttctttctctgcaagggaaaccgatgatcccactcctgggaaatagtagggaaacttggtatgtgtattcccatgtgtcctctagggagttggtaatggttaacctgacttcagcttccaggaattggctactcttcccgttttctatagtcatttgaatccacgagcttgatttgcactaatttgaccgacattgattttgtgtgtgacttggtttatggggccagctgactgaagtaagcagaccttttgggcaaaaatatgctttgacagtggtctcccacctatttgttccactgtctgccttcccctggttacttaaaattcatcagcttgtccaactggaccttctttccttcctgctgaagttgatttgaagtaaaaccttagatttgatgttaaaacagttgtcaaatctgttggtaaataagatttgaaggaccctactctgtctcccttgaaaaaggggaggaatgtcagtgttactgtttttggaaaaagtagatttttaaaccgagtttggaaatggtaagtatgcagaggtgggtgggggcaatctcaaaaacgtgcaaaaatgaggaaaacaaaaatgaggaaatgtgtgcgtgtgtttaatgcaaaactttaaaaagaaaaacaactgttatgtgactgttaacttgctctgcattttatgtgccacaggtatgaaaggtgacattgcaaaatactccgctcttctcgcagtgtagaaggggtgaccccgggggttgggggagatcaaaaacagctcagtagttaggacagagcttagctaagtttgtcttgctttaaggggaagttgcctttggttttgactttttatggaatggggttgggtctgcttgctgctttcaaagcaaaaaccacaaaaatgtgttcaaggctaccccagcctggtgtgaaatgtcttctgggtaaattggggtagggtttttaaaccaactacttggttgtcaaccacttgcgacaagaggaaaaaaaaacatctgctccatcggaagaacgaccaaggaaaatgggttattttttttccagaggaaatagataacgtaaccttttaaagcaaaatctttataaactgtgtctgagaaattgcacacgtgtgtgtgacatgctcaaaggtcagacaaggggtggtcaggaagggatgtattttagtagccacttgtatctttttccaaaaacacctacccatgtttggggaatgttaaacaaaatcaaaaaacaaccttttgtagccgttggaagcttcatgtcctttcttctaacttgtcttctccagcggaagtgaccgtggtggcttcaataaatttggtggtaagtgaacagagtttccaaaattcccaactcccagcaatgctttgtctgattgttcatttgcagatgtcttagcgtgttaatttaaatgtcaaaggttttgaggtgtccagaaccacctccagaaaggggtagggtagaatgccacctgttgcctggtgtgtgctaacctggagcaggtaggggtaagactcaatagtcatcttttaccaaatgggtttgccccaggttaataagaggggtctagtaggccttggactgggccgttgccacacctggcacttagtgaccatcatcatgagaaactggagagtgcgtgctggaacacgtggtgccatcttggctttaggatccttttgatcgttgtgtccaaggcttgtgtgtgtgtgagtgtgtgggagacaactccgaatgtttaattctggaagagggatgtaacattgccctgaggatggtgaagttggtatacatttataaagtacggaatggtgtcaatgaatgcaattctatgtatatggacttaactgagatgggcaaatagaaactagctctgggaaggaacatgtgcactacttcaagaaagattggaagcatgtgtggctcatgggaaataaccaggtcttaaacagcacaaactgaattcgtggaccaggaaggtcttaaacagcacaaactgaattcatggaaaaatgacaaatttgagaagtctcccagtaagctggaacttttctggtttggttaacaaaaggtttcttgatttgtttcaagatttaaagccaaaggtgtgggttcatgacttaggtgtcattgcgtgtgggtacaatatttatatatggcgaattcagataaacattggtcaaagatggtctctggaaaaacaaaatagaggctgcattacggaaataagatttctggtctgttccctgggacatgcttaaaaaatacaatagctattatgtatggtttttattttcatgtggtttcggggaaacaacacggttttaaggatggtttctaaagatgaaattaaaaattgttccacaagggttaagtgtctggtggtaaagttgggagaaactggatggatgcacatcgcatggctggtggcgagcccatctctcttctctcgggtgagagaaccgggccaagctgagttggtttgttcactttaatgggtctccgtttcccctgccacctgtgctgaggacatttcccagcctgagctgggggaggcagcattttctgaagtgtggagttgtctctgtggagactcaagttacagatcttaaggggcctgcctagaattttctcctctgggcaggcgacccaggaaagggtttggagtgaggctgtgagcacttacttgatattttacaagtttggatttggtgttaatttttttccttgtccgttttttcctgttgactaacggctcatcttttccttgtttttgttttttttttgttctttttttccatgtcactaaaggccctcgggaccaaggatcacgtcatgactccggtgagttcacacgtggtggcatgaaaagagtggctaaagtggtatcaagactgcctggatgttctttgaaactattataaaaaggaaactgaaaaaaatggggatagagaaggaagggagttaggtgtgtccttagttagcagtgagaagtatttgttacgaagtatttctcagaaatacctggcttgtgggttccacccccagtgatttaggtctgagaggaccctgaaaatctacctttctaacaagtccccagtgatgctgatgcgtctggaccacactcagatggtttacagcagtggttctttcaaaatgtggatcatgtccaagttggtgaacaaaactagtgaaagacctgaccacatgaagtaaagcattgaactcctgtttaggttgtattgatgtttgtgtactagatttgaatgtaaaatgggtttcttatttaattcggggaccttcaactgaaagttgataaatactgatggacttttctgtgtggtcttgttgggcatttcactcctgagccctggtttccatactgtatactgggtgttaacatgtttcaaaggataattgtcaaactgaatctgaaatttatcagcatggctggcatatagggactcaaaagggatgtggatttctttttagttgtcttccataaaccaaatgataccagttgcttgatggatactaggtgctttaggttttttcctgtgttttttattttaccttttcacatttgcattttctctgttcaacaagcagaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagctaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccagatggcccaggagggggaccaggtggctctcacatggggggtaactacggggatgatcgtcgtggtggcagaggaggctatgatcgaggcggctaccggggccgcggcggggaccgtggaggcttccgagggggccggggtggtggggacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagttaaa

SEQ ID NO: 62978 - DNA, 3177 bp, Homo sapiens
  misc_feature (1878)..(1878): n is a, c, g, or t
  misc_feature (2177)..(2177): n is a, c, g, or t
  misc_feature (2321)..(2321): n is a, c, g, or t
accgccggtaccggttcggaattcccgggcgtgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatgggcggaagtgaccgtggtggcttcaataaatttggtggccctcgggaccaaggatcacgtcatgactccgaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagctaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccagatggcccaggagggggaccaggtggctctcacatggggggtaactacggggatgatcgtcgtggtggcagaggaggctatgatcgaggcggctaccggggccgcggcggggaccgtggaggcttccgagggggccggggtggtggggacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagttaaaaaaaaaaaaaaaaaaaaaaaanaaaaaaaaaaaaaaaaaaaaaaaaaaagaaaaaaaagaaaaaaaaaaaaaaagaaaacaaaagcacaatattatagtcgctcctcggtattcatcctgcatgggttgctcactgagtttgcactgcgttgcctgtaactgtgcgcgcgtgcgcggacatggctcaaacgattattacccaacaagcaaccaaagctatggggctacccacccagccgggcaggctattcccagcagagcagtcagccctacggacagcagagttacagtggttatagccagtccacggacacttcaggntatggccagagcagctattcttcttatggccagagccagaacacaggctatggaactcagtcaactccccagggatatggctcgactggcggctatggcagtagccagagctcccaatcgtcttacgggcagcagtcctcctancctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggatgaggccgcggtggtcgggtacaaccggcagcagtggtggctatgaaccccagaggtccgtggcaggtggaccgtggaggcagaagggggcctgggccggaatgaccgcgggggctccactaaacctgtggtgggccccgtgggccaggggcaccgctataagcacgcaacaggggcaaatcacagaacaccacaagccaacccctgggtggccagggcccagggtggccaacagtgtgtacacaagaagagagtcgcgggcggagagaccacccaaccagaacagtcggggggtcttactaggacaacaaccaacaaaaagggaaggggaccagcacaatattattcacccgacaacgagggaacgcgagcagccagccaacaagcgaagcacagagccactcatctgtagtaacccacaccacataaacactagcgggctgtgggtcgagaaaactgagaccacagctac

SEQ ID NO: 62979 - DNA, 2617 bp, Homo sapiens
  misc_feature (1878)..(1878): n is a, c, g, or t
accgccggtaccggttcggaattcccgggcgtgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatgggcggaagtgaccgtggtggcttcaataaatttggtggccctcgggaccaaggatcacgtcatgactccgaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagctaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccagatggcccaggagggggaccaggtggctctcacatggggggtaactacggggatgatcgtcgtggtggcagaggaggctatgatcgaggcggctaccggggccgcggcggggaccgtggaggcttccgagggggccggggtggtggggacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagttaaaaaaaaaaaaaaaaaaaaaaaanaaaaaaaaaaaaaaaaaaaaaaaaaaagaaaaaaaagaaaaaaaaaaaaaaagaaaaaaaaagaaggagggcgcgcagcggccgctacgaaaaaagattaaaaaacacacgatgggggggggacgcagccaccacgagagtagagagaaaggaccgaaagcggctatcggaaaaaacagacggggagacaaaagggcggggaggtaccacaacacaaaaacagcgcgagaggagaacacacatagtatagcagaaaacaaatagagtagagatatgtgagagaaaatataaggggatatatacaaaaagggtgttttttgttgttgtttttattaaaataacaccgcgcggggggagagtaagaaacaataaggtgagataaagaagagagagagaggaggacgggggagaggagggaagggcagagagggagagaggaggagagagaggaagaagaggagggggggagaggcagggagcgagacagaggcgagcggagggagggagggaagaggaagggggcgagcgggagggagagagaaggtagaagagaagtgaagtgcggaggcaggcgagcaacgaaggaggagacgagggaggggcggaggaggcgaaagtgggcgcagaagccagaaggaggaaggcgagaaggcaaggggatgaagaagggggagaggggggaggaagggagaggagaagacagagaggagagggagtgaagagagaagaaggaaggaaa

SEQ ID NO: 62980 - DNA, 2149 bp, Homo sapiens
  misc_feature (1878)..(1878): n is a, c, g, or t
accgccggtaccggttcggaattcccgggcgtgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatgggcggaagtgaccgtggtggcttcaataaatttggtggccctcgggaccaaggatcacgtcatgactccgaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagctaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccagatggcccaggagggggaccaggtggctctcacatggggggtaactacggggatgatcgtcgtggtggcagaggaggctatgatcgaggcggctaccggggccgcggcggggaccgtggaggcttccgagggggccggggtggtggggacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagttaaaaaaaaaaaaaaaaaaaaaaaanaaaaaaaaaaaaaaaaaaaaaaaaaaagaaaaaaaagaaaaaaaaaaaaaaagggggaggggggaccaaaaaacccggggggggggaccagaaacccaaatacccctttctcgggggggggccccccccccccttggcccttaaaagagatttattgacccccctcatatgggggttttttaaaaattcagcggggtgaaaaaactttgattttccccaaatttttcctctttggacaaataccctttttttctttcgttgtaaaaaaaaa

SEQ ID NO: 62981 - DNA, 3478 bp, Homo sapiens
accgccggtaccggttcggaattcccgggcgtgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatggggtaggtgtctcatgagccagggagtatctttggtggggagtgtggaggattgcatgaatctccctgaagccagtccctagtgcatggtttagtattcttgttgtctagggatctgtgagggctttgatttgggggcagtgactttctttttacatccccattttatttttgtgagaacttgggagcctgaactcccatccataccactgaatagagattttgagtaatgatacttgtttccaaaaaaaaagaaaccatacatagatacgtatggattggagtcattaatatcctaggcaagaaacatggaagtgaagacttctttctctgcaagggaaaccgatgatcccactcctgggaaatagtagggaaacttggtatgtgtattcccatgtgtcctctagggagttggtaatggttaacctgacttcagcttccaggaattggctactcttcccgttttctatagtcatttgaatccacgagcttgatttgcactaatttgaccgacattgattttgtgtgtgacttggtttatggggccagctgactgaagtaagcagaccttttgggcaaaaatatgctttgacagtggtctcccacctatttgttccactgtctgccttcccctggttacttaaaattcatcagcttgtccaactggaccttctttccttcctgctgaagttgatttgaagtaaaaccttagatttgatgttaaaacagttgtcaaatctgttggtaaataagatttgaaggaccctactctgtctcccttgaaaaaggggaggaatgtcagtgttactgtttttggaaaaagtagatttttaaaccgagtttggaaatggtaagtatgcagaggtgggtgggggcaatctcaaaaacgtgcaaaaatgaggaaaacaaaaatgaggaaatgtgtgcgtgtgtttaatgcaaaactttaaaaagaaaaacaactgttatgtgactgttaacttgctctgcattttatgtgccacaggtatgaaaggtgacattgcaaaatactccgctcttctcgcagtgtagaaggggtgaccccgggggttgggggagatcaaaaacagctcagtagttaggacagagcttagctaagtttgtcttgctttaaggggaagttgcctttggttttgactttttatggaatggggttgggtctgcttgctgctttcaaagcaaaaaccacaaaaatgtgttcaaggctaccccagcctggtgtgaaatgtcttctgggtaaattggggtagggtttttaaaccaactacttggttgtcaaccacttgcgacaagaggaaaaaaaaacatctgctccatcggaagaacgaccaaggaaaatgggttattttttttccagaggaaatagataacgtaaccttttaaagcaaaatctttataaactgtgtctgagaaattgcacacgtgtgtgtgacatgctcaaaggtcagacaaggggtggtcaggaagggatgtattttagtagccacttgtatctttttccaaaaacacctacccatgtttggggaatgttaaacaaaatcaaaaaacaaccttttgtagccgttggaagcttcatgtcctttcttctaacttgtcttctccagcggaagtgaccgtggtggcttcaataaatttggtggccctcgggaccaaggatcacgtcatgactccgaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagctaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccagatggcccaggagggggaccaggtggctctcacatggggggtaactacggggatgatcgtcgtggtggcagaggaggctatgatcgaggcggctaccggggccgcggcggggaccgtggaggcttccgagggggccggggtggtggggacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagttaaa

SEQ ID NO: 62982 - DNA, 6168 bp, Homo sapiens
accgccggtaccggttcggaattcccgggcgtgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatggggtaggtgtctcatgagccagggagtatctttggtggggagtgtggaggattgcatgaatctccctgaagccagtccctagtgcatggtttagtattcttgttgtctagggatctgtgagggctttgatttgggggcagtgactttctttttacatccccattttatttttgtgagaacttgggagcctgaactcccatccataccactgaatagagattttgagtaatgatacttgtttccaaaaaaaaagaaaccatacatagatacgtatggattggagtcattaatatcctaggcaagaaacatggaagtgaagacttctttctctgcaagggaaaccgatgatcccactcctgggaaatagtagggaaacttggtatgtgtattcccatgtgtcctctagggagttggtaatggttaacctgacttcagcttccaggaattggctactcttcccgttttctatagtcatttgaatccacgagcttgatttgcactaatttgaccgacattgattttgtgtgtgacttggtttatggggccagctgactgaagtaagcagaccttttgggcaaaaatatgctttgacagtggtctcccacctatttgttccactgtctgccttcccctggttacttaaaattcatcagcttgtccaactggaccttctttccttcctgctgaagttgatttgaagtaaaaccttagatttgatgttaaaacagttgtcaaatctgttggtaaataagatttgaaggaccctactctgtctcccttgaaaaaggggaggaatgtcagtgttactgtttttggaaaaagtagatttttaaaccgagtttggaaatggtaagtatgcagaggtgggtgggggcaatctcaaaaacgtgcaaaaatgaggaaaacaaaaatgaggaaatgtgtgcgtgtgtttaatgcaaaactttaaaaagaaaaacaactgttatgtgactgttaacttgctctgcattttatgtgccacaggtatgaaaggtgacattgcaaaatactccgctcttctcgcagtgtagaaggggtgaccccgggggttgggggagatcaaaaacagctcagtagttaggacagagcttagctaagtttgtcttgctttaaggggaagttgcctttggttttgactttttatggaatggggttgggtctgcttgctgctttcaaagcaaaaaccacaaaaatgtgttcaaggctaccccagcctggtgtgaaatgtcttctgggtaaattggggtagggtttttaaaccaactacttggttgtcaaccacttgcgacaagaggaaaaaaaaacatctgctccatcggaagaacgaccaaggaaaatgggttattttttttccagaggaaatagataacgtaaccttttaaagcaaaatctttataaactgtgtctgagaaattgcacacgtgtgtgtgacatgctcaaaggtcagacaaggggtggtcaggaagggatgtattttagtagccacttgtatctttttccaaaaacacctacccatgtttggggaatgttaaacaaaatcaaaaaacaaccttttgtagccgttggaagcttcatgtcctttcttctaacttgtcttctccagcggaagtgaccgtggtggcttcaataaatttggtggtaagtgaacagagtttccaaaattcccaactcccagcaatgctttgtctgattgttcatttgcagatgtcttagcgtgttaatttaaatgtcaaaggttttgaggtgtccagaaccacctccagaaaggggtagggtagaatgccacctgttgcctggtgtgtgctaacctggagcaggtaggggtaagactcaatagtcatcttttaccaaatgggtttgccccaggttaataagaggggtctagtaggccttggactgggccgttgccacacctggcacttagtgaccatcatcatgagaaactggagagtgcgtgctggaacacgtggtgccatcttggctttaggatccttttgatcgttgtgtccaaggcttgtgtgtgtgtgagtgtgtgggagacaactccgaatgtttaattctggaagagggatgtaacattgccctgaggatggtgaagttggtatacatttataaagtacggaatggtgtcaatgaatgcaattctatgtatatggacttaactgagatgggcaaatagaaactagctctgggaaggaacatgtgcactacttcaagaaagattggaagcatgtgtggctcatgggaaataaccaggtcttaaacagcacaaactgaattcgtggaccaggaaggtcttaaacagcacaaactgaattcatggaaaaatgacaaatttgagaagtctcccagtaagctggaacttttctggtttggttaacaaaaggtttcttgatttgtttcaagatttaaagccaaaggtgtgggttcatgacttaggtgtcattgcgtgtgggtacaatatttatatatggcgaattcagataaacattggtcaaagatggtctctggaaaaacaaaatagaggctgcattacggaaataagatttctggtctgttccctgggacatgcttaaaaaatacaatagctattatgtatggtttttattttcatgtggtttcggggaaacaacacggttttaaggatggtttctaaagatgaaattaaaaattgttccacaagggttaagtgtctggtggtaaagttgggagaaactggatggatgcacatcgcatggctggtggcgagcccatctctcttctctcgggtgagagaaccgggccaagctgagttggtttgttcactttaatgggtctccgtttcccctgccacctgtgctgaggacatttcccagcctgagctgggggaggcagcattttctgaagtgtggagttgtctctgtggagactcaagttacagatcttaaggggcctgcctagaattttctcctctgggcaggcgacccaggaaagggtttggagtgaggctgtgagcacttacttgatattttacaagtttggatttggtgttaatttttttccttgtccgttttttcctgttgactaacggctcatcttttccttgtttttgttttttttttgttctttttttccatgtcactaaaggccctcgggaccaaggatcacgtcatgactccggtgagttcacacgtggtggcatgaaaagagtggctaaagtggtatcaagactgcctggatgttctttgaaactattataaaaaggaaactgaaaaaaatggggatagagaaggaagggagttaggtgtgtccttagttagcagtgagaagtatttgttacgaagtatttctcagaaatacctggcttgtgggttccacccccagtgatttaggtctgagaggaccctgaaaatctacctttctaacaagtccccagtgatgctgatgcgtctggaccacactcagatggtttacagcagtggttctttcaaaatgtggatcatgtccaagttggtgaacaaaactagtgaaagacctgaccacatgaagtaaagcattgaactcctgtttaggttgtattgatgtttgtgtactagatttgaatgtaaaatgggtttcttatttaattcggggaccttcaactgaaagttgataaatactgatggacttttctgtgtggtcttgttgggcatttcactcctgagccctggtttccatactgtatactgggtgttaacatgtttcaaaggataattgtcaaactgaatctgaaatttatcagcatggctggcatatagggactcaaaagggatgtggatttctttttagttgtcttccataaaccaaatgataccagttgcttgatggatactaggtgctttaggttttttcctgtgttttttattttaccttttcacatttgcattttctctgttcaacaagcagaacaggataattcagacaacaacaccatctttgtgcaaggcctgggtgagaatgttacaattgagtctgtggctgattacttcaagcagattggtattattaaggtacttgtggagaggagtgggagctttctgtcagtgttgtaggcttgtggatttcacacattagtaaaagcaagtctttaatggttgccagcagtaaaaacaagtcttagtggttgttgccagcttaatttgttgaggaaagagccttagttactgttttctaaaagagaagttctatcttaacacaaaaagtataacttatcagagtaccctaaactcttgagatttgtactctatagtaacttttagttttatctttcaatattggagtgagagacagttttctttaatggaggtttacatgtgaggtaggaagaagtaactgggaagaggggagctgaagtttgggaattataaacctcatgttctagaggaagaagatggaaagggagtactgtagcctttaaaattgatgtctaattttgctttcttcagacacaaacaagaaaacgggacagcccatgattaatttgtacacagacagggaaactggcaagctgaagggagaggcaacggtctcttttgatgacccaccttcagctaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccagatggcccaggagggggaccaggtggctctcacatggggggtaactacggggatgatcgtcgtggtggcagaggaggctatgatcgaggcggctaccggggccgcggcggggaccgtggaggcttccgagggggccggggtggtggggacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagttaaa

SEQ ID NO: 62983 - DNA, 1839 bp, Homo sapiens
accgccggtaccggttcggaattcccgggcgtgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatgggcggaagtgaccgtggtggcttcaataaatttggtggccctcgggaccaaggatcacgtcatgactccgaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagctaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccacagatggcccaggagggggaccaggtggctctcacatggggggtaactacggggatgatcgtcgtggtggcagaggaggctatgatcgaggcggctaccggggccgcggcggggaccgtggaggcttccgagggggccggggtggtggggacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagttaaa

SEQ ID NO: 62984 - DNA, 1552 bp, Homo sapiens
accgccggtaccggttcggaattcccgggcgtgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatgggcggaagtgaccgtggtggcttcaataaatttggtggccctcgggaccaaggatcacgtcatgactccgaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagctaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccagatggcccaggagggggaccaggtggctctcacatggggggtaactacggggatgatcgtcctgttgctgtgtggagggtcccaggtt

SEQ ID NO: 62985 - DNA, 1584 bp, Homo sapiens
accgccggtaccggttcggaattcccgggcgtgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatgggcggaagtgaccgtggtggcttcaataaatttggtggccctcgggaccaaggatcacgtcatgactccgaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagctaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccagatggcccaggagggggaccaggtggctctcacatggggggtaactacggggatgatcgtcgtggtgggtcagaacataaggtgggtgagaacataagggtgggtcagacataatgagga

SEQ ID NO: 62986 - DNA, 5912 bp, Homo sapiens
accgccggtaccggttcggaattcccgggcgtgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatggggtaggtgtctcatgagccagggagtatctttggtggggagtgtggaggattgcatgaatctccctgaagccagtccctagtgcatggtttagtattcttgttgtctagggatctgtgagggctttgatttgggggcagtgactttctttttacatccccattttatttttgtgagaacttgggagcctgaactcccatccataccactgaatagagattttgagtaatgatacttgtttccaaaaaaaaagaaaccatacatagatacgtatggattggagtcattaatatcctaggcaagaaacatggaagtgaagacttctttctctgcaagggaaaccgatgatcccactcctgggaaatagtagggaaacttggtatgtgtattcccatgtgtcctctagggagttggtaatggttaacctgacttcagcttccaggaattggctactcttcccgttttctatagtcatttgaatccacgagcttgatttgcactaatttgaccgacattgattttgtgtgtgacttggtttatggggccagctgactgaagtaagcagaccttttgggcaaaaatatgctttgacagtggtctcccacctatttgttccactgtctgccttcccctggttacttaaaattcatcagcttgtccaactggaccttctttccttcctgctgaagttgatttgaagtaaaaccttagatttgatgttaaaacagttgtcaaatctgttggtaaataagatttgaaggaccctactctgtctcccttgaaaaaggggaggaatgtcagtgttactgtttttggaaaaagtagatttttaaaccgagtttggaaatggtaagtatgcagaggtgggtgggggcaatctcaaaaacgtgcaaaaatgaggaaaacaaaaatgaggaaatgtgtgcgtgtgtttaatgcaaaactttaaaaagaaaaacaactgttatgtgactgttaacttgctctgcattttatgtgccacaggtatgaaaggtgacattgcaaaatactccgctcttctcgcagtgtagaaggggtgaccccgggggttgggggagatcaaaaacagctcagtagttaggacagagcttagctaagtttgtcttgctttaaggggaagttgcctttggttttgactttttatggaatggggttgggtctgcttgctgctttcaaagcaaaaaccacaaaaatgtgttcaaggctaccccagcctggtgtgaaatgtcttctgggtaaattggggtagggtttttaaaccaactacttggttgtcaaccacttgcgacaagaggaaaaaaaaacatctgctccatcggaagaacgaccaaggaaaatgggttattttttttccagaggaaatagataacgtaaccttttaaagcaaaatctttataaactgtgtctgagaaattgcacacgtgtgtgtgacatgctcaaaggtcagacaaggggtggtcaggaagggatgtattttagtagccacttgtatctttttccaaaaacacctacccatgtttggggaatgttaaacaaaatcaaaaaacaaccttttgtagccgttggaagcttcatgtcctttcttctaacttgtcttctccagcggaagtgaccgtggtggcttcaataaatttggtggtaagtgaacagagtttccaaaattcccaactcccagcaatgctttgtctgattgttcatttgcagatgtcttagcgtgttaatttaaatgtcaaaggttttgaggtgtccagaaccacctccagaaaggggtagggtagaatgccacctgttgcctggtgtgtgctaacctggagcaggtaggggtaagactcaatagtcatcttttaccaaatgggtttgccccaggttaataagaggggtctagtaggccttggactgggccgttgccacacctggcacttagtgaccatcatcatgagaaactggagagtgcgtgctggaacacgtggtgccatcttggctttaggatccttttgatcgttgtgtccaaggcttgtgtgtgtgtgagtgtgtgggagacaactccgaatgtttaattctggaagagggatgtaacattgccctgaggatggtgaagttggtatacatttataaagtacggaatggtgtcaatgaatgcaattctatgtatatggacttaactgagatgggcaaatagaaactagctctgggaaggaacatgtgcactacttcaagaaagattggaagcatgtgtggctcatgggaaataaccaggtcttaaacagcacaaactgaattcgtggaccaggaaggtcttaaacagcacaaactgaattcatggaaaaatgacaaatttgagaagtctcccagtaagctggaacttttctggtttggttaacaaaaggtttcttgatttgtttcaagatttaaagccaaaggtgtgggttcatgacttaggtgtcattgcgtgtgggtacaatatttatatatggcgaattcagataaacattggtcaaagatggtctctggaaaaacaaaatagaggctgcattacggaaataagatttctggtctgttccctgggacatgcttaaaaaatacaatagctattatgtatggtttttattttcatgtggtttcggggaaacaacacggttttaaggatggtttctaaagatgaaattaaaaattgttccacaagggttaagtgtctggtggtaaagttgggagaaactggatggatgcacatcgcatggctggtggcgagcccatctctcttctctcgggtgagagaaccgggccaagctgagttggtttgttcactttaatgggtctccgtttcccctgccacctgtgctgaggacatttcccagcctgagctgggggaggcagcattttctgaagtgtggagttgtctctgtggagactcaagttacagatcttaaggggcctgcctagaattttctcctctgggcaggcgacccaggaaagggtttggagtgaggctgtgagcacttacttgatattttacaagtttggatttggtgttaatttttttccttgtccgttttttcctgttgactaacggctcatcttttccttgtttttgttttttttttgttctttttttccatgtcactaaaggccctcgggaccaaggatcacgtcatgactccggtgagttcacacgtggtggcatgaaaagagtggctaaagtggtatcaagactgcctggatgttctttgaaactattataaaaaggaaactgaaaaaaatggggatagagaaggaagggagttaggtgtgtccttagttagcagtgagaagtatttgttacgaagtatttctcagaaatacctggcttgtgggttccacccccagtgatttaggtctgagaggaccctgaaaatctacctttctaacaagtccccagtgatgctgatgcgtctggaccacactcagatggtttacagcagtggttctttcaaaatgtggatcatgtccaagttggtgaacaaaactagtgaaagacctgaccacatgaagtaaagcattgaactcctgtttaggttgtattgatgtttgtgtactagatttgaatgtaaaatgggtttcttatttaattcggggaccttcaactgaaagttgataaatactgatggacttttctgtgtggtcttgttgggcatttcactcctgagccctggtttccatactgtatactgggtgttaacatgtttcaaaggataattgtcaaactgaatctgaaatttatcagcatggctggcatatagggactcaaaagggatgtggatttctttttagttgtcttccataaaccaaatgataccagttgcttgatggatactaggtgctttaggttttttcctgtgttttttattttaccttttcacatttgcattttctctgttcaacaagcagaacaggataattcagacaacaacaccatctttgtgcaaggcctgggtgagaatgttacaattgagtctgtggctgattacttcaagcagattggtattattaaggtacttgtggagaggagtgggagctttctgtcagtgttgtaggcttgtggatttcacacattagtaaaagcaagtctttaatggttgccagcagtaaaaacaagtcttagtggttgttgccagcttaatttgttgaggaaagagccttagttactgttttctaaaagagaagttctatcttaacacaaaaagtataacttatcagagtaccctaaactcttgagatttgtactctatagtaacttttagttttatctttcaatattggagtgagagacagttttctttaatggaggtttacatgtgaggtaggaagaagtaactgggaagaggggagctgaagtttgggaattataaacctcatgttctagaggaagaagatggaaagggagtactgtagcctttaaaattgatgtctaattttgctttcttcagacacaaacaagaaaacgggacagcccatgattaatttgtacacagacagggaaactggcaagctgaagggagaggcaacggtctcttttgatgacccaccttcagctaaagcagctattgactggtttgatggtaaagaattctccggaaatcctatcaaggtctcatttgctactcgccgggcagactttaatcggggtggtggcaatggtcgtggaggccgagggcgaggagcagaggaggctatgatcgaggcggctaccggggccgcggcggggaccgtggaggcttccgagggggccggggtggtggggacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagttaaa

SEQ ID NO: 62987 - DNA, 4362 bp, Homo sapiens
accgccggtaccggttcggaattcccgggcgtgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatggggtaggtgtctcatgagccagggagtatctttggtggggagtgtggaggattgcatgaatctccctgaagccagtccctagtgcatggtttagtattcttgttgtctagggatctgtgagggctttgatttgggggcagtgactttctttttacatccccattttatttttgtgagaacttgggagcctgaactcccatccataccactgaatagagattttgagtaatgatacttgtttccaaaaaaaaagaaaccatacatagatacgtatggattggagtcattaatatcctaggcaagaaacatggaagtgaagacttctttctctgcaagggaaaccgatgatcccactcctgggaaatagtagggaaacttggtatgtgtattcccatgtgtcctctagggagttggtaatggttaacctgacttcagcttccaggaattggctactcttcccgttttctatagtcatttgaatccacgagcttgatttgcactaatttgaccgacattgattttgtgtgtgacttggtttatggggccagctgactgaagtaagcagaccttttgggcaaaaatatgctttgacagtggtctcccacctatttgttccactgtctgccttcccctggttacttaaaattcatcagcttgtccaactggaccttctttccttcctgctgaagttgatttgaagtaaaaccttagatttgatgttaaaacagttgtcaaatctgttggtaaataagatttgaaggaccctactctgtctcccttgaaaaaggggaggaatgtcagtgttactgtttttggaaaaagtagatttttaaaccgagtttggaaatggtaagtatgcagaggtgggtgggggcaatctcaaaaacgtgcaaaaatgaggaaaacaaaaatgaggaaatgtgtgcgtgtgtttaatgcaaaactttaaaaagaaaaacaactgttatgtgactgttaacttgctctgcattttatgtgccacaggtatgaaaggtgacattgcaaaatactccgctcttctcgcagtgtagaaggggtgaccccgggggttgggggagatcaaaaacagctcagtagttaggacagagcttagctaagtttgtcttgctttaaggggaagttgcctttggttttgactttttatggaatggggttgggtctgcttgctgctttcaaagcaaaaaccacaaaaatgtgttcaaggctaccccagcctggtgtgaaatgtcttctgggtaaattggggtagggtttttaaaccaactacttggttgtcaaccacttgcgacaagaggaaaaaaaaacatctgctccatcggaagaacgaccaaggaaaatgggttattttttttccagaggaaatagataacgtaaccttttaaagcaaaatctttataaactgtgtctgagaaattgcacacgtgtgtgtgacatgctcaaaggtcagacaaggggtggtcaggaagggatgtattttagtagccacttgtatctttttccaaaaacacctacccatgtttggggaatgttaaacaaaatcaaaaaacaaccttttgtagccgttggaagcttcatgtcctttcttctaacttgtcttctccagcggaagtgaccgtggtggcttcaataaatttggtggtaagtgaacagagtttccaaaattcccaactcccagcaatgctttgtctgattgttcatttgcagatgtcttagcgtgttaatttaaatgtcaaaggttttgaggtgtccagaaccacctccagaaaggggtagggtagaatgccacctgttgcctggtgtgtgctaacctggagcaggtaggggtaagactcaatagtcatcttttaccaaatgggtttgccccaggttaataagaggggtctagtaggccttggactgggccgttgccacacctggcacttagtgaccatcatcatgagaaactggagagtgcgtgctggaacacgtggtgccatcttggctttaggatccttttgatcgttgtgtccaaggcttgtgtgtgtgtgagtgtgtgggagacaactccgaatgtttaattctggaagagggatgtaacattgccctgaggatggtgaagttggtatacatttataaagtacggaatggtgtcaatgaatgcaattctatgtatatggacttaactgagatgggcaaatagaaactagctctgggaaggaacatgtgcactacttcaagaaagattggaagcatgtgtggctcatgggaaataaccaggtcttaaacagcacaaactgaattcgtggaccaggaaggtcttaaacagcacaaactgaattcatggaaaaatgacaaatttgagaagtctcccagtaagctggaacttttctggtttggttaacaaaaggtttcttgatttgtttcaagatttaaagccaaaggtgtgggttcatgacttaggtgtcattgcgtgtgggtacaatatttatatatggcgaattcagataaacattggtcaaagatggtctctggaaaaacaaaatagaggctgcattacggaaataagatttctggtctgttccctgggacatgcttaaaaaatacaatagctattatgtatggtttttattttcatgtggtttcggggaaacaacacggttttaaggatggtttctaaagatgaaattaaaaattgttccacaagggttaagtgtctggtggtaaagttgggagaaactggatggatgcacatcgcatggctggtggcgagcccatctctcttctctcgggtgagagaaccgggccaagctgagttggtttgttcactttaatgggtctccgtttcccctgccacctgtgctgaggacatttcccagcctgagctgggggaggcagcattttctgaagtgtggagttgtctctgtggagactcaagttacagatcttaaggggcctgcctagaattttctcctctgggcaggcgacccaggaaagggtttggagtgaggctgtgagcacttacttgatattttacaagtttggatttggtgttaatttttttccttgtccgttttttcctgttgactaacggctcatcttttccttgtttttgttttttttttgttctttttttccatgtcactaaaggccctcgggaccaaggatcacgtcatgactccgaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagctaaagcagctattgactggtttgatgcgtaaagaattctccgcgaaagtcactatcaagacgcaggtgcaggtgtccgagccgaccgaatcctcgggacagcag

SEQ ID NO: 62988 - DNA, 1961 bp, Homo sapiens
accgccggtaccggttcggaattcccgggcgtgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatggggtaggtgtctcatgagccagggagtatctttggtggggagtgtggaggattgcatgaatctccctgaagccagtccctagtgcatggtttagtattcttgttgtctagggatctgtgagggctttgatttgggggcagtgactttctttttacatccccattttatttttgtgagaacttgggagcctgaactcccatccataccactgaatagagattttgagtaatgatacttgtttccaaaaaaaaagaaaccatacatagatacgtatggattggagtcattaatatcctaggcaagaaacatggaagtgaagacttctttctctgcaagggaaaccgatgatcccactcctgggaaatagtagggaaacttgcggaagtgaccgtggtggcttcaataaatttggtggccctcgggaccaaggatcacgtcatgactccgaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagctaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccagatggcccaggagggggaccaggtggctctcacatggggggtaactacggggatgatcgtcgtggtgggtcagaacataaggtgggtgagaacataagggtgggtcagacataatgagga

SEQ ID NO: 62989 - DNA, 1711 bp, Homo sapiens
accgccggtaccggttcggaattcccgggcgtgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatggggtaggtgtctcatgagccagggagtatctttggtggggagtgtggaggattgcatgaatctccctgaagccagtccctagtgcatggtttagtattcttgttgtctagggatctgtgagggctttgatttgggggcagtgactttctttttacatccccattttatttttgtgagaacttgggagcctgaactcccatccataccactgaatagagattttgagtaatgatacttgtttccaaaaaaaaagaaaccatacatagatacgtatggattggagtcattaatatcctaggcaagaaacatggaagtgaagacttctttctctgcaagggaaaccgatgatcccactcctgggaaatagtagggaaacttggtatgtgtattcccatgtgtcctctagggagttggtaatggttaacctgacttcagcttccaggaattggctactcttcccgttttctatagtcatttgaatccacgagcttgatttgcactaatttgaccgacattgattttgtgtgtgacttggtttatggggccagctgactgaagtaagcagaccttttgggcaaaaatatgctttgacagtggtctcccacctatttgttccactgtctgccttcccctggttacttaaaattcatcagcttgtccaactggaccttctttccttcctgctgaagttgatttgaagtaaaaccttagatttgatgttaaaacagttgtcaaatctgttggtaaataagatttgaaggaccctactctgtctcccttgaaaaaggggaggaatgtcagtgttactgtgtcaataaactgatttaaagttgaaaaaaaa

SEQ ID NO: 62990 - DNA, 1261 bp, Homo sapiens
  misc_feature (908)..(908): n is a, c, g, or t
accgccggtaccggttcggaattcccgggcgtgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatgggcggaagtgaccgtggtggcttcaataaatttggtgncccgcagaccccaccgacacctacggccacaagcggtaccgcacaaaagggcaggagggccactcgccacatcaaggccccacaaagctcagcctgccacagtggagcacgaggtggtgcgggacctgccgccaagccagcaggagagggctacgcggtgccagtgatccagcggcacgagcacagcacagcagagcaacaccaacaacaacacagcaacacttccacacgtcctagcgccactgccaagcacacctcgatcccaagcacagacatggaccgcgacatcaagggacagggagcagagcagctgccggctgtgtgcccatggggaggccagcccaaacccccaa

SEQ ID NO: 62991 - DNA, 1441 bp, Homo sapiens
  misc_feature (668)..(668): n is a, c, g, or t
accgccggtaccggttcggaattcccgggcgtgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggagtgttcaagaaggaagtgtatcttcatacatcaccacncctgaaagcagatgtgcttttccagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctatgaaaaa

SEQ ID NO: 62992 - DNA, 735 bp, Homo sapiens
accgccggtaccggttcggaattcccgggcgtgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccacaccaggccctctctccagttttatcccctgcctaatgctgcgagaagcacagaataaactttttgtcactctcaaa

SEQ ID NO: 62993 - DNA, 765 bp, Homo sapiens
accgccggtaccggttcggaattcccgggcgtgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacagtgagtctttctcagcgggtcacctcttcctactctttctgaatattgcttttctttttcttgttttttggagacggagtctggtcctgttgcccaggctggagtgcagtggtgctgtctcagctcactgcaacatcagcctaccgggttcaaacgattctcctgcctcagctactgaggaggctgaggcgggaggatcccttgaattcaggagtttggggctgcagtgagctatgatggtgcctgtgaacagccactgcattccagcctgggcagtgtgttgaggccccatctcaaaaacataaaaaaaaaaacaaaaaacaaaaatgtttattggtttgtgattctgtttccatttattttctttggcttttaatttttttgactcttcttattttccatcagcatgaaagagagcatattttctaaaggaagaaccagttttaggccaattctgaaatggagaa

SEQ ID NO: 62994 - DNA, 505 bp, Homo sapiens
atatagggcagcaagccttaggaaacaagccatagtttgagggttctttatgagtcttccaacacttactttagactgcggttacaggtagtctcatttttgcttatgtgtcagcagattataaaccatttgagaaaggcacgcttctcttgtattttcggattaatgtgtcttgcatttaaagtctgttgatgattttttgtttctctaggtaaagaattctccggaaatcctatcaaggtctcatttgctactcgccgggcagactttaatcggggtggtggcaatggtcgtggaggccgagggcgaggagggtgaggagctacctgctagtggtgcagaggggtaatggggagagtgcagaagatggtaaaggcttgcatggaatgggttagatttaccaaacttggagagggagcagacccatacttggtctatctgcattaggacccatgggccgtggaggctatggaggtggtggcagtggtggtggtggccgaggagg

SEQ ID NO: 62995 - DNA, 648 bp, Homo sapiens
  misc_feature (114)..(114): n is a, c, g, or t
cagtcttgctcccatcagcgtgtgacataagagattacgtctgcaggtacccagccaagaagccaacagcgtggctttcagttcactgatgggagaagactgcgcgcatctgcntccaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaagatgcgccagtcttctcccatcagtgttgtgtatggctatcattggtgttgaggttagtttgattagtcatggtggggtggtgattagtcggttgttgatgagatattgggaggtggggatcaatagagggggagatagaatgatcagtactgcggcgggtaggcctaggatggtgggggcaatgaatgaagcgaacagattttcgttcatttcggttcctgatgggcgcaagatgcgcctcttcgtcccatcaggtccacatgagagtacttcttccgtgactgtacaatcaccccaaatcctctctacttggttgtccacatcctcatcgttactgatgggagaagatggaca

SEQ ID NO: 62996 - DNA, 2255 bp, Homo sapiens
accgccggtaccggttcggaattcccgggcgtgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatgggcggaagtgaccgtggtggcttcaataaatttggtggccctcgggaccaaggatcacgtcatgactccgaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagctaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccagatggcccaggagggggaccaggtggctctcacatggggggtaactacggggatgatcgtcgtggtggcagaggaggctatgatcgaggcggctaccggggccgcggcggggaccgtggaggcttccgagggggccggggtggtggggacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagttaaaaaaaaaaaaaaaaaaaaaattcggagggcatctaatggccggggtggcgggaaaaaggagggcactgagaactggcgccatgggccataagctggttccctggacccaggtttctcttggttaccaaagggggcgagaatctggccggggtcctcccctatattagggagagtcggaattcaaattgcgagaaagagccaggcgtttacccggtgcgtttaatagactccgcgcggaccaaaacgtcgcaccgacaggacaccgcacacagaacgaccggccgccggaacgctgccaccacgggccagcacagacgacgaacgccggggggcacacacaacacccccacatttatgtaaaccaaacacaaaacggcactgtggggagcgacgcggagaa

SEQ ID NO: 62997 - DNA, 1813 bp, Homo sapiens
accgccggtaccggttcggaattcccgggcgtgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatgggcggaagtgaccgtggtggcttcaataaatttggtggccctcgggaccaaggatcacgtcatgactccgaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagctaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccagatggcccaggagggggaccaggtggctctcacatggggggtaactacggggatgatcgtcgtggtggcagaggaggctatgatcgaggcggctaccggggccgcggcggggaccgtggaggcttccgagggggccggggtggtggggacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagttaaa

SEQ ID NO: 62998 - DNA, 2145 bp, Homo sapiens
accgccggtaccggttcggaattcccgggcgtgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatgggcggaagtgaccgtggtggcttcaataaatttggtggccctcgggaccaaggatcacgtcatgactccgaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagctaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccagatggcccaggagggggaccaggtggctctcacatggggggtaactacggggatgatcgtcgtggtggcagaggaggctatgatcgaggcggctaccggggccgcggcggggaccgtggaggcttccgagggggccggggtggtggggacagaggtggctttggccctggcaagatggattccaggtaagacatttaaatcagaataaaaaagtagagcagttgaacagaggccataggataacagggttttgttgagaaagtggtttcattttgagggctaggtggaaagacctgaggttgtaaccagtagtggagagggaaggaaaattaactcagggggagtgaatctgtagacccacttgagataagatactcgctgggttaggtaggaggggcagataggatatctaggcttggagaggctggtaactcaaatataatggatacttaatttttttttttttttttgcaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagttaaa

SEQ ID NO: 62999 - DNA, 1821 bp, Homo sapiens
accgccggtaccggttcggaattcccgggcgtgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatggggccctcgggaccaaggatcacgtcatgactccgaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagctaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccagatggcccaggagggggaccaggtggctctcacatggggggtaactacggggatgatcgtcgtggtggcagaggaggctatgatcgaggcggctaccggggccgcggcggggaccgtggaggcttccgagggggccggggtggtggggacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagttaaa

SEQ ID NO: 63000 - DNA, 1785 bp, Homo sapiens
accgccggtaccggttcggaattcccgggcgtgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatgggcggaagtgaccgtggtggcttcaataaatttggtggccctcgggaccaaggatcacgtcatgactccgaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagctaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccagatggcccaggagggggaccaggtggctctcacatggggggtaactacggggatgatcgtcgtggtgggtggtggggacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagttaaa

SEQ ID NO: 63001 - DNA, 1777 bp, Homo sapiens
  misc_feature (1548)..(1548): n is a, c, g, or t
accgccggtaccggttcggaattcccgggcgtgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatgggcggaagtgaccgtggtggcttcaataaatttggtggccctcgggaccaaggatcacgtcatgactccgaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagctaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccagatggcccaggagggggaccaggtggctctcacatggggggtaactacggggatgatcgtcgggggagaggaggtatgatcgangcggtacggggcggggggacgcgagctccgaggggcgggggggggaccgaggggctcgccggcagatgttccggggagccgacgacggggaagggaataaaaccggcccggtgggaagctggcgaccagtcccgtttgaccaccgcccgggttggggagaggaaaccgccaaggggaaaaaaaaagcagggaacgggcaacgagataaggagaagggtcacaaatagcg

SEQ ID NO: 63002 - DNA, 2316 bp, Homo sapiens
accgccggtaccggttcggaattcccgggcgtgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatgggcggaagtgaccgtggtggcttcaataaatttggtggccctcgggaccaaggatcacgtcatgactccgaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagctaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatccactgtgagaatatgaacttctcttggaggaatgaatgcaaccagtgtaaggcccctaatcccacctgtgagaatatgaacttctcttggaggaatgaatgcaaccagtgtaaggcccctaaaccagatggcccaggagggggaccaggtggctctcacatggggggtaactacggggatgatcgtcgtggtggcagaggaggctatgatcgaggcggctaccggggccgcggcggggaccgtggaggcttccgagggggccggggtggtggggacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagttaaaaaaaaaaaaaaaaaaaaaattcggagggcatctaatggccggggtggcgggaaaaaggagggcactgagaactggcgccatgggccataagctggttccctggacccaggtttctcttggttaccaaagggggcgagaatctggccggggtcctcccctatattagggagagtcggaattcaaattgcgagaaagagccaggcgtttacccggtgcgtttaatagactccgcgcggaccaaaacgtcgcaccgacaggacaccgcacacagaacgaccggccgccggaacgctgccaccacgggccagcacagacgacgaacgccggggggcacacacaacacccccacatttatgtaaaccaaacacaaaacggcactgtggggagcgacgcggagaa

SEQ ID NO: 63003 - DNA, 5101 bp, Homo sapiens
accgccggtaccggttcggaattcccgggcgtgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatggggtaggtgtctcatgagccagggagtatctttggtggggagtgtggaggattgcatgaatctccctgaagccagtccctagtgcatggtttagtattcttgttgtctagggatctgtgagggctttgatttgggggcagtgactttctttttacatccccattttatttttgtgagaacttgggagcctgaactcccatccataccactgaatagagattttgagtaatgatacttgtttccaaaaaaaaagaaaccatacatagatacgtatggattggagtcattaatatcctaggcaagaaacatggaagtgaagacttctttctctgcaagggaaaccgatgatcccactcctgggaaatagtagggaaacttggtatgtgtattcccatgtgtcctctagggagttggtaatggttaacctgacttcagcttccaggaattggctactcttcccgttttctatagtcatttgaatccacgagcttgatttgcactaatttgaccgacattgattttgtgtgtgacttggtttatggggccagctgactgaagtaagcagaccttttgggcaaaaatatgctttgacagtggtctcccacctatttgttccactgtctgccttcccctggttacttaaaattcatcagcttgtccaactggaccttctttccttcctgctgaagttgatttgaagtaaaaccttagatttgatgttaaaacagttgtcaaatctgttggtaaataagatttgaaggaccctactctgtctcccttgaaaaaggggaggaatgtcagtgttactgtttttggaaaaagtagatttttaaaccgagtttggaaatggtaagtatgcagaggtgggtgggggcaatctcaaaaacgtgcaaaaatgaggaaaacaaaaatgaggaaatgtgtgcgtgtgtttaatgcaaaactttaaaaagaaaaacaactgttatgtgactgttaacttgctctgcattttatgtgccacaggtatgaaaggtgacattgcaaaatactccgctcttctcgcagtgtagaaggggtgaccccgggggttgggggagatcaaaaacagctcagtagttaggacagagcttagctaagtttgtcttgctttaaggggaagttgcctttggttttgactttttatggaatggggttgggtctgcttgctgctttcaaagcaaaaaccacaaaaatgtgttcaaggctaccccagcctggtgtgaaatgtcttctgggtaaattggggtagggtttttaaaccaactacttggttgtcaaccacttgcgacaagaggaaaaaaaaacatctgctccatcggaagaacgaccaaggaaaatgggttattttttttccagaggaaatagataacgtaaccttttaaagcaaaatctttataaactgtgtctgagaaattgcacacgtgtgtgtgacatgctcaaaggtcagacaaggggtggtcaggaagggatgtattttagtagccacttgtatctttttccaaaaacacctacccatgtttggggaatgttaaacaaaatcaaaaaacaaccttttgtagccgttggaagcttcatgtcctttcttctaacttgtcttctccagcggaagtgaccgtggtggcttcaataaatttggtggtaagtgaacagagtttccaaaattcccaactcccagcaatgctttgtctgattgttcatttgcagatgtcttagcgtgttaatttaaatgtcaaaggttttgaggtgtccagaaccacctccagaaaggggtagggtagaatgccacctgttgcctggtgtgtgctaacctggagcaggtaggggtaagactcaatagtcatcttttaccaaatgggtttgccccaggttaataagaggggtctagtaggccttggactgggccgttgccacacctggcacttagtgaccatcatcatgagaaactggagagtgcgtgctggaacacgtggtgccatcttggctttaggatccttttgatcgttgtgtccaaggcttgtgtgtgtgtgagtgtgtgggagacaactccgaatgtttaattctggaagagggatgtaacattgccctgaggatggtgaagttggtatacatttataaagtacggaatggtgtcaatgaatgcaattctatgtatatggacttaactgagatgggcaaatagaaactagctctgggaaggaacatgtgcactacttcaagaaagattggaagcatgtgtggctcatgggaaataaccaggtcttaaacagcacaaactgaattcgtggaccaggaaggtcttaaacagcacaaactgaattcatggaaaaatgacaaatttgagaagtctcccagtaagctggaacttttctggtttggttaacaaaaggtttcttgatttgtttcaagatttaaagccaaaggtgtgggttcatgacttaggtgtcattgcgtgtgggtacaatatttatatatggcgaattcagataaacattggtcaaagatggtctctggaaaaacaaaatagaggctgcattacggaaataagatttctggtctgttccctgggacatgcttaaaaaatacaatagctattatgtatggtttttattttcatgtggtttcggggaaacaacacggttttaaggatggtttctaaagatgaaattaaaaattgttccacaagggttaagtgtctggtggtaaagttgggagaaactggatggatgcacatcgcatggctggtggcgagcccatctctcttctctcgggtgagagaaccgggccaagctgagttggtttgttcactttaatgggtctccgtttcccctgccacctgtgctgaggacatttcccagcctgagctgggggaggcagcattttctgaagtgtggagttgtctctgtggagactcaagttacagatcttaaggggcctgcctagaattttctcctctgggcaggcgacccaggaaagggtttggagtgaggctgtgagcacttacttgatattttacaagtttggatttggtgttaatttttttccttgtccgttttttcctgttgactaacggctcatcttttccttgtttttgttttttttttgttctttttttccatgtcactaaaggccctcgggaccaaggatcacgtcatgactccggtgagttcacacgtggtggcatgaaaagagtggctaaagtggtatcaagactgcctggatgttctttgaaactattataaaaaggaaactgaaaaaaatggggatagagaaggaagggagttaggtgtgtccttagttagcagtgagaagtatttgttacgaagtatttctcagaaatacctggcttgtgggttccacccccagtgatttaggtctgagaggaccctgaaaatctacctttctaacaagtccccagtgatgctgatgcgtctggaccacactcagatggtttacagcagtggttctttcaaaatgtggatcatgtccaagttggtgaacaaaactagtgaaagacctgaccacatgaagtaaagcattgaactcctgtttaggttgtattgatgtttgtgtactagatttgaatgtaaaatgggtttcttatttaattcggggaccttcaactgaaagttgataaatactgatggacttttctgtgtggtcttgttgggcatttcactcctgagccctggtttccatactgtatactgggtgttaacatgtttcaaaggataattgtcaaactgaatctgaaatttatcagcatggctggcatatagggactcaaaagggatgtggatttctttttagttgtcttccataaaccaaatgataccagttgcttgatggatactaggtgctttaggttttttcctgtgttttttattttaccttttcacatttgcattttctctgttcaacaagcagaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagctaaagcagctattgactggtttgatggtaaagaattctccggctctcggtgggaagtcgggtgccgagctcgagggtt

SEQ ID NO: 63004 - DNA, 1026 bp, Homo sapiens
accgccggtaccggttcggaattcccgggcgtgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatgggcggaagtgaccgtggtggcttcaataaatttggtgcagtggccagatccagctttggcagttcctcctggagctcctgtcggacagctccaactccagctgcatcacctgggaaggcaccaacggggagttcaagatgacggatcccgacgagg

SEQ ID NO: 63005 - DNA, 1717 bp, Homo sapiens
  misc_feature (944)..(944): n is a, c, g, or t
accgccggtaccggttcggaattcccgggcgtgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatgggcggaagtgaccgtggtggcttcaataaatttggtgtgttcaagaaggaagtgtatcttcatacatcaccacncctgaaagcagatgtgcttttccagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctatgaaaaa

SEQ ID NO: 63006 - DNA, 1037 bp, Homo sapiens
accgccggtaccggttcggaattcccgggcgtgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggagttgccattgccccaaatggagccttacagttggcaagtccaggcacagatggagtacagggacttcagacattaaccatgacaaattcaggcagtactcagcaaggtacaactattcttcagtatgcacagacctctgatggacagcagatacttgtgcccagcaatcaggtggtcgtacaaactgcatcaggagatatgcaaacatatcagatccgaactacaccttcagctacttctctgccacaaactgtggtgatgacatctcctgtgactctcacctctcagacaactaagacagatgacccccaattgaaaagagaaataaggttaatgaaaaacagagaagctgctcgagaatgtcgcagaaagaagaaagaatatgtgaaatgcctggaaaaccgagt

SEQ ID NO: 63007 - DNA, 1168 bp, Homo sapiens
accgccggtaccggttcggaattcccgggcgtgctcagtcctccaggcgtcggtgctcagcggtgttggaacttcgttgcttgcttgcctgtgcgcgcgtgcgcggacatggcctcaaacgattatacccaacaagcaacccaaaggtgagtgctatttttgggcttccagagtttgtagagggcaagggtggtcacgccatgttttctgatcacgctggttttccttttatttagctatggggcctaccccacccagcccgggcagggctattcccagcagagcagtcagccctacggacagcagagttacagtggttatagccagtccacggacacttcaggctatggccagagcagctattcttcttatggccagagccagaacagtgagtctttctcagcgggtcacctcttcctactctttctgaatattgcttttctttttcttgttttttggagacggagtctggtcctgttgcccaggctggagtgcagtggtgctgtctcagctcactgcaacatcagcctaccgggttcaaacgattctcctgcctcagcctcctgaagtagctgggattacaggtacctgctaccacgcctggctaattttgtgtttttagtagagatggggtttcaccgtgttggacaggctggtctggaactcctgacctcctgcctgccttgacctgccaaagtgctgggattacaggcgtcagccacaatgccctgaatgttgcttttcttaaacctgagcagcactgagatgttgaaactgttccatatttcttttccgtgaaacagtgtataagtcttaaaactttttgggatctgagtcctttacagggcattgtggcacacctgtagtcccagctactgaggaggctgaggcgggaggatcccttgaattcaggagtttggggctgcagtgagctatgatggtgcctgtgaacagccactgcattccagcctgggcagtgtgttgaggccccatctcaaaaacataaaaaaaaaaacaaaaaacaaaaatgtttattggtttgtgattctgtttccatttattttctttggcttttaatttttttgactcttcttattttccatcagcatgaaagagagcatattttctaaaggaagaaccagttttaggccaattctgaaatggagaa

SEQ ID NO: 63008 - DNA, 529 bp, Homo sapiens
tacaggcacacaccaccacatctgctgatttttgtatttttagtagagtggggtttcaccatgttgccctgagagaagagagaaagagacccccccccatattgttttatattgttttatactcagtatctgttttaagaagaaacaaggaagcgaaaccaaaggcaggcagcccagcgccaggcaccagacccaaaaccagacccaaaaccaggcctgggactgccagacctaacctggtagttaaaattcaacccatgacctagcaaccaatgttatccacagattccagacattgtatggaaggacatcgtgaaacttcccgttcgttgtttcactcttattaccggtgcatgcagcccctgtcacataccccctagattgctcaatcaatcacggccctttcacgtaaaatctttagcattgtgagcccttaaaagggccagaaactgtgcactcgagaagctcggattttgagacgttagtctgcagatgcttccagcttattaaagccacttccttcactacc

SEQ ID NO: 63009 - DNA, 343 bp, Homo sapiens
cccacctcctcctctcacctcctgtgtctgttattcactgttccagacacacaggccttcctgctagtccttgacaaggaagagctgtatgcaggaggctttctctggctcttcatgcgagtatctccagcgtgttactcaaatctcaactcagaagcacctctcagggctccagagatgccttctctggccacttgacgttagcagcacctgtatgcatgcaaccacactgtgctggcaccttcagtcacactcacctgctatatgtccttctgcttacctctttagtgtcttgtttctgctgctgaactgaaagcttcatataagcaaaaactgggttcgt

SEQ ID NO: 63010 - DNA, 3365 bp, Homo sapiens
  misc_feature (1)..(1): n is a, c, g, or t
ngcaaagaaatggctcaaaagcttcagctctttctgtgccctgggagctgagatgcacgtcagtggccttgccagcgtggccaattctctgctgactgccagaaaaaagaggccaggaagaaagaggaaagagaagagatcgctcaggggtgagaccatgcccttcatcttttcttttccctaatctcctctgcttgtgtccacccacactctccccacctggcaaaattgttcaaaattgctgtggagtttacctcagtttcctctttcagtctgtggtgtgtggtccatcctcttgctgagcacattgaaaggaactggctatctttgatctcttcctccagatcagagtcaaggaatgtgtttataatggacacttcatccaaagaaaatatccagttgttctgcaaaacttcagtgcaacctgttggaaggccttcttttaaaacagaatatccctcctcagaagaaaagcaaccatgctgtggtgaactaaaggtgttcttgtgtgccttgtcttttgtttactttgccaaagcattggcagaaggctatctgaagagcaccatcactcagatagagagaaggtttgatatcccttcttcactggtgggagttattgatggtagttttgaaattgggaatctcttagttataacatttgttagctactttggagccaaacttcacaggccaaaaataattggagcagggtgtgtaatcatgggagttggaacactgctcattgcaatgcctcagttcttcatggagcagtacaaatatgagagatattctccttcctccaattccactctcagcatctctccgtgtctcctagagtcaagcagtcaattaccagtttcagttatggaaaaatcaaaatccaaaataagtaacgaatgtgaagtggacactagctcttccatgtggatttatgttttcctgggcaatcttcttcgtggaataggagaaactcccattcagcctttgggcattgcctacctggatgattttgccagtgaagacaatgcagctttctatattgggtgtgtgcagacggttgcaattataggaccaatctttggtttcctgttaggctcattatgtgccaaactatatgttgacattggctttgtaaacctagatcacataaccattaccccaaaagatccccagtgggtaggagcctggtggcttggctatctaatagcaggaatcataagtcttcttgcagctgtgcctttctggtatttaccaaagagtttaccaagatcccaaagtagagaggattctaattcttcctctgagaaatccaagtttattatagatgatcacacagactaccaaacaccccagggagaaaatgcaaaaataatggaaatggcaagagattttcttccatcactgaagaatctttttggaaacccagtatacttcctatatttatgtacaagcactgttcagttcaattctctgttcggcatggtgacgtacaaaccaaagtacattgagcagcagtatggacagtcatcctccagggccaactttgtgatcgggctcatcaacattccagcagtggcccttggaatattctctggggggatagttatgaaaaaattcagaatcagtgtgtgtggagctgcaaaactctacttgggatcatctgtctttggttacctcctatttctttccctgtttgcactgggctgtgaaaattctgatgtggcaggactaactgtctcctaccaaggaaccaaacctgtctcttatcatgaacgagctctcttttcagattgcaactcaagatgcaaatgttcagagacaaaatgggaacccatgtgcggtgaaaatggaatcacatatgtatcagcttgtcttgctggttgtcaaacctccaacaggagtggaaaaaatattatattttacaactgcacttgtgtgggaattgcagcttctaaatccggaaattcctcaggcatagtgggaagatgtcagaaagacaatggatgtccccaaatgtttctgtatttccttgtaatttcagtcatcacatcctatactttatccctaggtggcatacctggatacatattacttctgaggtgcattaagccacagcttaagtcttttgccttgggtatctacacattagcaataagagttcttgcaggaatcccagctccagtgtattttggagttttgattgatacttcatgcctcaaatggggatttaaaagatgtggaagtagaggatcatgcagattatatgattcaaatgtcttcagacatatatatctgggactaactgtgatactgggcacagtgtcaattctcctaagcattgcagtacttttcattttaaagaaaaattatgtttcaaaacacagaagttttataaccaagagagaaagaacaatggtgtctacaagattccaaaaggaaaattacactacaagtgatcatctgctacaacccaactactggccaggcaaggaaactcaactttagaaacatgatgactggaagtcatgtcttctaattggttgacattttgcaaacaaataaattgtaatcaaaagagctctaaatttgtaatttctttctcctttcaaaaaatgtctactttgttttggtcctaggcattaggtaatataactgataatatactgaaacatataatggaagatgcagatgataaaactaattttgaactttttaatttatataaattattttatatcacttacttatttcactttattttgctttgtgctcattgatatatattagctgtactcctagaagaacaattgtctctattgtcacacatggttatatttaaagtaatttctgaactgtgtaatgtgtctagagtaagcaaatactgctaacaattaactcataccttgggttccttcaagtattactcctatagtattttctcccatagctgtcttcatctgtgtattttaataatgatcttaggatggagcagaacatggagaggaagatttcattttaagctcctccttttctttgaaatacaataatttatatagaaatgtgtagcagcaaattatattggggattagaattttgaattaatagctctcctactattaatttacatgtgctttttgtgtggcgctataagtgactatggttgtaaagtaataaaattgatgttaacatgcccaattattgttcttttatgaatccaatgaatttaaaactattgttaaatataatactgccccactttaatatatgtaagcaacttcctacttatacacgacgtgttcctaaaacatgtttgaaaggtgaatttctgaaagtctacaataaatgtaggtgttacaacagga

SEQ ID NO: 63011 - DNA, 910 bp, Homo sapiens
  misc_feature (1)..(1): n is a, c, g, or t
ngcaaagaaatggctcaaaagcttcagctctttctgtgccctgggagctgagatgcacgtcagtggccttgccagcgtggccaattctctgctgactgccagaaaaaagaggccaggaagaaagaggaaagagaagagatcgctcagggtctgtggtgtgtggtccatcctcttgctgagcacattgaaaggaactggctatctttgatctcttcctccagatcagagtcaaggaatgtgtttataatggacacttcatccaaagaaaatatccagttgttctgcaaaacttcagtgcaacctgttggaaggccttcttttaaaacagaatatccctcctcagaagaaaagcaaccatgctgtggtgaactaaaggtagagcaaccaagaagtaaatagtgttgatgctcttagttttctgtccagatatcatctatataatgaagttagaatgagaattgttttctcctttaaaaaaaaaaaaagatcttagatgcaatttactaaaaccacaccttgccaggcggtgcaagcaatctctacctgaccatgtgggttaaattactttcctgggctcatttaaatgcccccccaaacagaaaagagagaaatagtagaaactagtatttattgaacttctgccatgtgccagatattaagccaagcacagatataacatttaatttgtgaaacatcacattactcccattttgcaaataaaaatgggaataatgttacagagtagggagaagagttgcttttttttttttttaggattgttgtatcaaacaatagtttttagttttttgaggaacctccatactattatattttccaaagagactacatcaacttatgtaaccactaaccatgtacaaagattcccttttctttacattctaaccagttt

SEQ ID NO: 63012 - DNA, 457 bp, Homo sapiens
  misc_feature (1)..(1): n is a, c, g, or t
ngcaaagaaatggctcaaaagcttcagctctttctgtgccctgggagctgagatgcacgtcagtggccttgccagcgtggccaattctctgctgactgccagaaaaaagaggccaggaagaaagaggaaagagaagagatcgctcaggggtgagaccatgcccttcatcttttcttttccctaatctcctctgcttgtgtccacccacactctccccacctggcaaaattgttcaaaattgctgtggagtttacctcagtttcctctttcagtctgtggtgtgtggtccatcctcttgctgagcacattgaaaggaactggctatctttgatctcttcctccaggggatgaactgtagcctccttggaacatactacacttgcaataatttgcgcattaaccatcaagacacttcagtaaagctatgcagtgccaatagtttaagctggatcctatt

SEQ ID NO: 63013 - DNA, 270 bp, Homo sapiens
tatgtttttaacagcaattatttgtttttctcacagcaggaatcccagctccagtgtattttggagttttgattgatacttcatgcctcaaatggggatttaaaagatgtggaagtagaggatcatgcagattatatgattcaaatgtcttcaggtaccaaatcaaaagcattcccgcatctcattgctacagcatcccagatttacacaatgccactgacactaacaagttttcatgtcatttcactgcttgtaaggtaaagaatagtc

SEQ ID NO: 63014 - DNA, 3242 bp, Homo sapiens
  misc_feature (1)..(1): n is a, c, g, or t
ngcaaagaaatggctcaaaagcttcagctctttctgtgccctgggagctgagatgcacgtcagtggccttgccagcgtggccaattctctgctgactgccagaaaaaagaggccaggaagaaagaggaaagagaagagatcgctcagggtctgtggtgtgtggtccatcctcttgctgagcacattgaaaggaactggctatctttgatctcttcctccagatcagagtcaaggaatgtgtttataatggacacttcatccaaagaaaatatccagttgttctgcaaaacttcagtgcaacctgttggaaggccttcttttaaaacagaatatccctcctcagaagaaaagcaaccatgctgtggtgaactaaaggtgttcttgtgtgccttgtcttttgtttactttgccaaagcattggcagaaggctatctgaagagcaccatcactcagatagagagaaggtttgatatcccttcttcactggtgggagttattgatggtagttttgaaattgggaatctcttagttataacatttgttagctactttggagccaaacttcacaggccaaaaataattggagcagggtgtgtaatcatgggagttggaacactgctcattgcaatgcctcagttcttcatggagcagtacaaatatgagagatattctccttcctccaattccactctcagcatctctccgtgtctcctagagtcaagcagtcaattaccagtttcagttatggaaaaatcaaaatccaaaataagtaacgaatgtgaagtggacactagctcttccatgtggatttatgttttcctgggcaatcttcttcgtggaataggagaaactcccattcagcctttgggcattgcctacctggatgattttgccagtgaagacaatgcagctttctatattgggtgtgtgcagacggttgcaattataggaccaatctttggtttcctgttaggctcattatgtgccaaactatatgttgacattggctttgtaaacctagatcacataaccattaccccaaaagatccccagtgggtaggagcctggtggcttggctatctaatagcaggaatcataagtcttcttgcagctgtgcctttctggtatttaccaaagagtttaccaagatcccaaagtagagaggattctaattcttcctctgagaaatccaagtttattatagatgatcacacagactaccaaacaccccagggagaaaatgcaaaaataatggaaatggcaagagattttcttccatcactgaagaatctttttggaaacccagtatacttcctatatttatgtacaagcactgttcagttcaattctctgttcggcatggtgacgtacaaaccaaagtacattgagcagcagtatggacagtcatcctccagggccaactttgtgatcgggctcatcaacattccagcagtggcccttggaatattctctggggggatagttatgaaaaaattcagaatcagtgtgtgtggagctgcaaaactctacttgggatcatctgtctttggttacctcctatttctttccctgtttgcactgggctgtgaaaattctgatgtggcaggactaactgtctcctaccaaggaaccaaacctgtctcttatcatgaacgagctctcttttcagattgcaactcaagatgcaaatgttcagagacaaaatgggaacccatgtgcggtgaaaatggaatcacatatgtatcagcttgtcttgctggttgtcaaacctccaacaggagtggaaaaaatattatattttacaactgcacttgtgtgggaattgcagcttctaaatccggaaattcctcaggcatagtgggaagatgtcagaaagacaatggatgtccccaaatgtttctgtatttccttgtaatttcagtcatcacatcctatactttatccctaggtggcatacctggatacatattacttctgaggtgcattaagccacagcttaagtcttttgccttgggtatctacacattagcaataagagttcttgcaggaatcccagctccagtgtattttggagttttgattgatacttcatgcctcaaatggggatttaaaagatgtggaagtagaggatcatgcagattatatgattcaaatgtcttcagacatatatatctgggactaactgtgatactgggcacagtgtcaattctcctaagcattgcagtacttttcattttaaagaaaaattatgtttcaaaacacagaagttttataaccaagagagaaagaacaatggtgtctacaagattccaaaaggaaaattacactacaagtgatcatctgctacaacccaactactggccaggcaaggaaactcaactttagaaacatgatgactggaagtcatgtcttctaattggttgacattttgcaaacaaataaattgtaatcaaaagagctctaaatttgtaatttctttctcctttcaaaaaatgtctactttgttttggtcctaggcattaggtaatataactgataatatactgaaacatataatggaagatgcagatgataaaactaattttgaactttttaatttatataaattattttatatcacttacttatttcactttattttgctttgtgctcattgatatatattagctgtactcctagaagaacaattgtctctattgtcacacatggttatatttaaagtaatttctgaactgtgtaatgtgtctagagtaagcaaatactgctaacaattaactcataccttgggttccttcaagtattactcctatagtattttctcccatagctgtcttcatctgtgtattttaataatgatcttaggatggagcagaacatggagaggaagatttcattttaagctcctccttttctttgaaatacaataatttatatagaaatgtgtagcagcaaattatattggggattagaattttgaattaatagctctcctactattaatttacatgtgctttttgtgtggcgctataagtgactatggttgtaaagtaataaaattgatgttaacatgcccaattattgttcttttatgaatccaatgaatttaaaactattgttaaatataatactgccccactttaatatatgtaagcaacttcctacttatacacgacgtgttcctaaaacatgtttgaaaggtgaatttctgaaagtctacaataaatgtaggtgttacaacagga

SEQ ID NO: 63015 - DNA, 3079 bp, Homo sapiens
  misc_feature (31)..(31): n is a, c, g, or t
  misc_feature (36)..(36): n is a, c, g, or t
  misc_feature (2422)..(2422): n is a, c, g, or t
  misc_feature (2519)..(2519): n is a, c, g, or t
  misc_feature (2522)..(2522): n is a, c, g, or t
  misc_feature (2569)..(2569): n is a, c, g, or t
  misc_feature (2574)..(2574): n is a, c, g, or t
  misc_feature (2662)..(2662): n is a, c, g, or t
  misc_feature (3076)..(3079): n is a, c, g, or t
cagacactggcaagccgcagaagcccagttngccgnccatgaagcagcggttctcggcgctgcagctgctgaagctgctgctgctgctgcagccgccgctgccacgagcgctgcgcgaggcgctctgccctgagccctgcaactgcgtgcccgacggcgccctgcgctgccccggccccacggccggtctcactcgactatcacttgcctacctccctgtcaaagtgatcccatctcaagctttcagaggacttaatgaggtcataaaaattgaaatctctcagattgattccctggaaaggatagaagctaatgcctttgacaacctcctcaatttgtctgaaatactgatccagaacaccaaaaatctgagatacattgagcccggagcatttataaatcttccccgattaaaatacttgagcatctgtaacacaggcatcagaaagtttccagatgttacgaaggtcttctcctctgaatcaaatttcattctggaaatttgtgataacttacacataaccaccataccaggaaatgcttttcaagggatgaataatgaatctgtaacactcaaactatatggaaatggatttgaagaagtacaaagtcatgcattcaatgggacgacactgacttcactggagctaaaggaaaacgtacatctggagaagatgcacaatggagccttccgtggggccacagggccgaaaaccttggatatttcttccaccaaattgcaggccctgccgagctatggcctagagtccattcagaggctaattgccacgtcatcctattctctaaaaaaattgccatcaagagaaacatttgtcaatctcctggaggccacgttgacttaccccagccactgctgtgcttttagaaacttgccaacaaaagaacagaatttttcacattccatttctgaaaacttttccaaacaatgtgaaagcacagtaaggaaagtgagtaacaaaacactttattcttccatgcttgctgagagtgaactgagtggctgggactatgaatatggtttctgcttacccaagacaccccgatgtgctcctgaaccagatgcttttaatccctgtgaagacattatgggctatgacttccttagggtcctgatttggctgattaatattctagccatcatgggaaacatgactgttctttttgttctcctgacaagtcgttacaaacttacagtgcctcgttttctcatgtgcaatctctcctttgcagacttttgcatggggctctatctgctgctcatagcctcagttgattcccaaaccaagggccagtactataaccatgccatagactggcagacagggagtgggtgcagcactgctggctttttcactgtattcgcaagtgaactttctgtctacaccctcaccgtcatcactctagaaagatggcacaccatcacctatgctattcacctggaccaaaagctgcgattaagacatgccattctgattatgcttggaggatggctcttttcttctctaattgctatgttgccccttgtcggtgtcagcaattacatgaaggtcagtatttgcttccccatggatgtggaaaccactctctcacaagtctatatattaaccatcctgattctcaatgtggtggccttcttcataatttgtgcttgctacattaaaatttattttgcagttcgaaacccagaattaatggctaccaataaagatacaaagattgctaagaaaatggcaatcctcatcttcaccgatttcacctgcatggcacctatctctttttttgccatctcagctgccttcaaagtacctcttatcacagtaaccaactctaaagttttactggttcttttttatcccatcaattcttgtgccaatccatttctgtatgcaatattcactaagacattccaaagagatttctttcttttgctgagcaaatttggctgctgtaaacgtcgggctgaactttatagaaggaaagatttttcagcttacacctccaactgcaaaaatggcttcactggatcaaataagccttctcaatccaccttgaagttgtccacattgcactgtcaaggtacagctctcctagacaagactcgctacacagagtgttaactgttacatcagtaactgcattattgaattgttcttaaacctgtaaaaaaaaattacctgtaccagtaattttaacataaagggttggatttaggaaattatttatttttaggtacattaggcaagagacctctacctagtagaaagtgtagtctatgaccactgccacacgtaaaaactatttgtcattgttacatggcataaatactgaagttgagagtgtttagaaatttttatagaaattttgacacagtaattttgtttgatgaatcttttaaaaaacngaggaggtattttgcatatcttttttttcattttcgtaatttgtattgcattctataaaaatattagttcataacagatcagaaatttaaaataacnggnctttttcctcaggtagtttgaaaaacacactctagagatgcactgtncaatncggtagcgcactagccacatgtggctaaattaaaattaaataaaatgagaaatgtagtttctcagttgcactacgtttcaagccacgnttcaagttctcaatggctacgtgtgactagtgcttaccatactggacagcacagacacagaatattttcatcaccacagaaagttctatctgttctattatagagacttttatctatgccctatctggattctacttatttataatttaaggtaaacatctgaaagcacatttcagcctatttgcttagtgaaacattaagctgtagactgtaaactcctcgtgagtaggaaccctgtctcagtgcattttgttttcctgcttcctacctcaagatcttggcaatggtacactacaaatgtgctgagttagaattactctgaagttatgaaacatataatgaaaacaattttttctagagcttatatttttatttgaatgaaataaaatgtttaaatatttaaaaataaaaaannnn

SEQ ID NO: 63016 - DNA, 3057 bp, Homo sapiens
  misc_feature (31)..(31): n is a, c, g, or t
  misc_feature (36)..(36): n is a, c, g, or t
  misc_feature (2400)..(2400): n is a, c, g, or t
  misc_feature (2497)..(2497): n is a, c, g, or t
  misc_feature (2500)..(2500): n is a, c, g, or t
  misc_feature (2547)..(2547): n is a, c, g, or t
  misc_feature (2552)..(2552): n is a, c, g, or t
  misc_feature (2640)..(2640): n is a, c, g, or t
  misc_feature (3054)..(3057): n is a, c, g, or t
cagacactggcaagccgcagaagcccagttngccgnccatgaagcagcggttctcggcgctgcagctgctgaagctgctgctgctgctgcagccgccgctgccacgagcgctgcgcgaggcgctctgccctgagccctgcaactgcgtgcccgacggcgccctgcgctgccccggccccacggccggtctcactcgactatcacttgcctacctccctgtcaaagtgatcccatctcaagctttcagaggacttaatgaggtcataaaaattgaaatctctcagattgattccctggaaaggatagaagctaatgcctttgacaacctcctcaatttgtctgaaatactgatccagaacaccaaaaatctgagatacattgagcccggagcatttataaatcttccccgattaaaatacttgagcatctgtaacacaggcatcagaaagtttccagatgttacgaaggtcttctcctctgaatcaaatttcattctggaaatttgtgataacttacacataaccaccataccaggaaatgcttttcaagggatgaataatgaatctgtaacactcaaactatatggaaatggatttgaagaagtacaaagtcatgcattcaatgggacgacactgacttcactggagctaaaggaaaacgtacatctggagaagatgcacaatggagccttccgtggggccacagggccgaaaaccttggatatttcttccaccaaattgcaggccctgccgagctatggcctagagtccattcagaggctaattgccacgtcatcctattctctaaaaaaattgccatcaagagaaacatttgtcaatctcctggaggccacgttgacttaccccagccactgctgtgcttttagaaacttgccaacaaaagaacagaatttttcacattccatttctgaaaacttttccaaacaatgtgaaagcacagtaaggaaagtgagtaacaaaacactagtgaactgagtggctgggactatgaatatggtttctgcttacccaagacaccccgatgtgctcctgaaccagatgcttttaatccctgtgaagacattatgggctatgacttccttagggtcctgatttggctgattaatattctagccatcatgggaaacatgactgttctttttgttctcctgacaagtcgttacaaacttacagtgcctcgttttctcatgtgcaatctctcctttgcagacttttgcatggggctctatctgctgctcatagcctcagttgattcccaaaccaagggccagtactataaccatgccatagactggcagacagggagtgggtgcagcactgctggctttttcactgtattcgcaagtgaactttctgtctacaccctcaccgtcatcactctagaaagatggcacaccatcacctatgctattcacctggaccaaaagctgcgattaagacatgccattctgattatgcttggaggatggctcttttcttctctaattgctatgttgccccttgtcggtgtcagcaattacatgaaggtcagtatttgcttccccatggatgtggaaaccactctctcacaagtctatatattaaccatcctgattctcaatgtggtggccttcttcataatttgtgcttgctacattaaaatttattttgcagttcgaaacccagaattaatggctaccaataaagatacaaagattgctaagaaaatggcaatcctcatcttcaccgatttcacctgcatggcacctatctctttttttgccatctcagctgccttcaaagtacctcttatcacagtaaccaactctaaagttttactggttcttttttatcccatcaattcttgtgccaatccatttctgtatgcaatattcactaagacattccaaagagatttctttcttttgctgagcaaatttggctgctgtaaacgtcgggctgaactttatagaaggaaagatttttcagcttacacctccaactgcaaaaatggcttcactggatcaaataagccttctcaatccaccttgaagttgtccacattgcactgtcaaggtacagctctcctagacaagactcgctacacagagtgttaactgttacatcagtaactgcattattgaattgttcttaaacctgtaaaaaaaaattacctgtaccagtaattttaacataaagggttggatttaggaaattatttatttttaggtacattaggcaagagacctctacctagtagaaagtgtagtctatgaccactgccacacgtaaaaactatttgtcattgttacatggcataaatactgaagttgagagtgtttagaaatttttatagaaattttgacacagtaattttgtttgatgaatcttttaaaaaacngaggaggtattttgcatatcttttttttcattttcgtaatttgtattgcattctataaaaatattagttcataacagatcagaaatttaaaataacnggnctttttcctcaggtagtttgaaaaacacactctagagatgcactgtncaatncggtagcgcactagccacatgtggctaaattaaaattaaataaaatgagaaatgtagtttctcagttgcactacgtttcaagccacgnttcaagttctcaatggctacgtgtgactagtgcttaccatactggacagcacagacacagaatattttcatcaccacagaaagttctatctgttctattatagagacttttatctatgccctatctggattctacttatttataatttaaggtaaacatctgaaagcacatttcagcctatttgcttagtgaaacattaagctgtagactgtaaactcctcgtgagtaggaaccctgtctcagtgcattttgttttcctgcttcctacctcaagatcttggcaatggtacactacaaatgtgctgagttagaattactctgaagttatgaaacatataatgaaaacaattttttctagagcttatatttttatttgaatgaaataaaatgtttaaatatttaaaaataaaaaannnn

SEQ ID NO: 63017 - DNA, 900 bp, Homo sapiens
  misc_feature (31)..(31): n is a, c, g, or t
  misc_feature (36)..(36): n is a, c, g, or t
cagacactggcaagccgcagaagcccagttngccgnccatgaagcagcggttctcggcgctgcagctgctgaagctgctgctgctgctgcagccgccgctgccacgagcgctgcgcgaggcgctctgccctgagccctgcaactgcgtgcccgacggcgccctgcgctgccccggccccacggccggtctcactcgactatcacttgcctacctccctgtcaaagtgatcccatctcaagctttcagaggacttaatgaggtcataaaaattgaaatctctcagattgattccctggaaaggatagaagctaatgcctttgacaacctcctcaatttgtctgaaatactgatccagaacaccaaaaatctgagatacattgagcccggagcatttataaatcttccccgattaaaatacttgagcatctgtaacacaggcatcagaaagtttccagatgttacgaaggtcttctcctctgaatcaaatttcattctggaaatttgtgataacttacacataaccaccataccaggaaatgcttttcaagggatgaataatgaatctgtaacactcaaactatatggaaatggatttgaagaagtacaaagtcatgcattcaatgggacgacactgacttcactggagctaaaggaaaacgtacatctggagaagatgcacaatggagccttccgtggggccacagggccgaaaaccttgtgagtagaatggtgctgcctcccctccctgcccagtgtaccccaacaggactgcttagggtgtccctccacatcatccccaagctgatatgtgagacatcagcctctacacctgaaaaggctgctgttggaaagacaaagtgtatcacagctgccataataaagtaccccaaaccgagagg

SEQ ID NO: 63018 - DNA, 476 bp, Homo sapiens
tgcaaaaccagaggaaaggcttaagtgttaaacatctctggccttggatcccagctatgccactgttttcctttgacattaagcaagctacataaccacactgagggttaggcttcttgtcggtataatggaaatgatgatgaggattaaatcataaaataaacatagagtggctgatgaagtatctagcacttaatagacacttaataaattgatggtggtggtgatgatggagaactagatattatgaatgcctgtaataaccttagtaatatatgttacaggaggaaaaatgtgtttccaaactgtttctttcagtttcttcccattcctaaaccctctcctccctccttcagcaaactatatggaaatggatttgaagaagtacaaagtcatgcattcaatgggacgacactgacttcactgtaagtatttgcttatttccccagctcaggaataaaaatgaaatattactc

SEQ ID NO: 63019 - DNA, 547 bp, Homo sapiens
cctcggcttcccaaagtgttgggattacaatcatgagccactgtgcccggccttataattcttagtaataagaaaataaacaatgaaatgtaagataggcaaaagatttggaaatgtcaccaagaagatatatggatggcaaataagcacatgaaaagatgctcaatgtcgttaatcactaggggaatgcaaattaaaatcatgagatactactaaatacctagaagaatgactaaaaaaaacaagaaatatctgaccattccaagtattggccgggatatggaggaaatagaattattgtgggaatgtaaaatggtatcattttggaaaacagtttaccagtttcttaaaagttaaacatacacctactatccagccacctctaagacttgtacataaatgtttgtagcaactttatttgtaattttatcagttgtgtacttaaataaatgcagtttattgtaaaaatgaaaacaaattagtaaatcacttgcggcccggaagctttattccctttaagtgaggggaaaattttagcttggcactg

SEQ ID NO: 63020 - DNA, 425 bp, Homo sapiens
gtcctctagcccagcaagctttggggagggagtaagcggaactgcaaaagagctcgctcagctgtttctggattggggcgcagagaaagaaatcgcgatcagggaactgagtactggagtccctcaaaataacccgaagggtcaaatagtgagctccaagcaaagcgttgacccggctacccctgagcagcgccctacgctgggttccactccacttcccctcccccgcgcggggcgatagccaggcgcggtcccttcccacgcgggccgcggcgagtgcggacagctcccttccgggctgcggaaggcgggaagtctgcggttcgcgggctccggctggcgggcgcccctcggagtccctgaagtcggccgggccccgcaggacccgcgccttctcggccccaactgtccctcgcgaagcgtcc

SEQ ID NO: 63021 - DNA, 282 bp, Homo sapiens
tcaggcacagtgagagcccagttgcagaattatcattgatacagacaccaaaagtctgcacttcgagcagttcgagatgacaagattgagcgtccttaccatccatgccccaatgcaaagaattggtcattccatttcaggtcaaagtgaacccaggcacagtgtggcccccagagggggaccagcaaacagggctaccctggctgctccaggaggaactcagaaacagcttctctcatcccactgggccaaggttttgccaggtgcctggtgggagaggag

SEQ ID NO: 63022 - DNA, 3551 bp, Homo sapiens
gttgactgtgacacgggtgttacatatcttcctgtgccccttctccctgtagggtgaagctctgggcctcggcttttggtggggagataaaatccattgctgctaagtactccggttcccagcttctgcaaaagaaatacaaagagtatgagaaagacgttgccatagaagaaatcgatggcctccaactggtaaagaagctggcaaagaacatggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggattttttacccaaatctccaccttggctgatgtgcaggagaatgtcatggaataccttcacgtgcttagccggcccaaagtcatcgaccaggagcatgatgtggtgtggaccgaagcttacattgacagcactctccctcaggcacaaaagctgactgatgatcagggccccgtcctgatgaccactgtagccatgcctgtgtttagtaagcagaacgaaaccagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaagggaaacgggttttggtgatgacaaatgactactattatacagacatcaagggtactcctttcagtttaggtgtggcgctttccagaggtcatgggaaatatttcttccgagggaatgtaaccatcgaagaaggcctgcatgacttagaacatcccgatgtgtccttggcagatgaatggtcctactgcaacactgacctacaccctgagcaccgccatctgtctcagttagaagcgattaagctctacctaaaaggcaaagaacctctgctccagtgtgataaagaattgatccaagaagtcctttttgacgcggtggtgagtgcccccattgaagcgtattggaccagcctggccctcaacaaatctgaaaattctgacaagggcgtggaggttgccttcctcggcactcgcacgggcctctccagaatcaacctgtttgtcggggctgagcagctcaccaatcaggacttcctgaaagctggcgacaaggagaacatttttaacgcagaccatttccctctctggtaccgaagagccgctgagcagattccagggagcttcgtctactcgatcccattcagcactggaccagtcaataaaagcaatgtggtgacagcaagtacatccatccagctcctggatgaacggaaatctcctgtggtggcagctgtaggcattcagatgaaacttgaatttttccaaaggaagttctggactgccagcagacagtgtgcttccctggatggcaaatgctccatcagctgtgatgatgagactgtgaattgttacctcatagacaataatggatttattttggtgtctgaagactacacacagactggagacttttttggtgagatcgagggagctgtgatgaacaaattgctaacaatgggctcctttaaaagaattaccctttatgactaccaagccatgtgtagagccaacaaggaaagcagcgatggcgcccatggcctcctggatccttataatgccttcctctctgcagtaaaatggatcatgacagaacttgtcttgttcctggtggaatttaacctctgcagttggtggcactccgatatgacagctaaagcccagaaattgaaacagaccctggagccttgtgatactgaatatccagcattcgtctctgagcgcaccatcaaggagactacagggaatattgcttgtgaagactgctccaagtcctttgtcatccagcaaatcccaagcagcaacctgttcatggtggtggtggacagcagctgcctctgtgaatctgtggcccccatcaccatggcacccattgaaatcaggtataatgaatcccttaagtgtgaacgtctaaaggcccagaagatcagaaggcgcccagaatcttgtcatggcttccatcctgaggagaatgcaagggagtgtgggggtgcgccgagtctccaagcccagacagtcctccttctgctccctctgcttttgatgctcttctcaaggtgacactgactgagatgttctcttggcatgctaaatcatggataaactgtgaaccaaaatatggtgcaacatacgagacatgaatatagtccaaccatcagcatctcatcatgattttaaactgtgcgtgatataaactcttaaagatatgttgacaaaaagttatctatcatctttttactttgccagtcatgcaaatgtgagtttgccacatgataatcacccttcatcagaaatgggaccgcaagtggtaggcagtgtcccttctgcttgaaacctattgaaaccaatttaaaactgtgtactttttaaataaagtatattaaaatcataaaaaaaaaatctccg

SEQ ID NO: 63023 - DNA, 3489 bp, Homo sapiens
gttgactgtgacacgggtgttacatatcttcctgtgccccttctccctgtagggtgaagctctgggcctcggcttttggtggggagataaaatccattgctgctaagtactccggttcccagcttctgcaaaagaaatacaaagagtatgagaaagacgttgccatagaagaaatcgatggcctccaactggtaaagaagctggcaaagaacatggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggattttttacccaaatctccaccttggctgatgtgcaggagaatgtcatggaataccttcacgtgcttagccggcccaaagtcatcgaccaggagcatgatgtggtgtggaccgaagcttacattgacagcactctccctcaggcacaaaagctgactgatgatcagggccccgtcctgatgaccactgtagccatgcctgtgtttagtaagcagaacgaaaccagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaagggtttaggtgtggcgctttccagaggtcatgggaaatatttcttccgagggaatgtaaccatcgaagaaggcctgcatgacttagaacatcccgatgtgtccttggcagatgaatggtcctactgcaacactgacctacaccctgagcaccgccatctgtctcagttagaagcgattaagctctacctaaaaggcaaagaacctctgctccagtgtgataaagaattgatccaagaagtcctttttgacgcggtggtgagtgcccccattgaagcgtattggaccagcctggccctcaacaaatctgaaaattctgacaagggcgtggaggttgccttcctcggcactcgcacgggcctctccagaatcaacctgtttgtcggggctgagcagctcaccaatcaggacttcctgaaagctggcgacaaggagaacatttttaacgcagaccatttccctctctggtaccgaagagccgctgagcagattccagggagcttcgtctactcgatcccattcagcactggaccagtcaataaaagcaatgtggtgacagcaagtacatccatccagctcctggatgaacggaaatctcctgtggtggcagctgtaggcattcagatgaaacttgaatttttccaaaggaagttctggactgccagcagacagtgtgcttccctggatggcaaatgctccatcagctgtgatgatgagactgtgaattgttacctcatagacaataatggatttattttggtgtctgaagactacacacagactggagacttttttggtgagatcgagggagctgtgatgaacaaattgctaacaatgggctcctttaaaagaattaccctttatgactaccaagccatgtgtagagccaacaaggaaagcagcgatggcgcccatggcctcctggatccttataatgccttcctctctgcagtaaaatggatcatgacagaacttgtcttgttcctggtggaatttaacctctgcagttggtggcactccgatatgacagctaaagcccagaaattgaaacagaccctggagccttgtgatactgaatatccagcattcgtctctgagcgcaccatcaaggagactacagggaatattgcttgtgaagactgctccaagtcctttgtcatccagcaaatcccaagcagcaacctgttcatggtggtggtggacagcagctgcctctgtgaatctgtggcccccatcaccatggcacccattgaaatcaggtataatgaatcccttaagtgtgaacgtctaaaggcccagaagatcagaaggcgcccagaatcttgtcatggcttccatcctgaggagaatgcaagggagtgtgggggtgcgccgagtctccaagcccagacagtcctccttctgctccctctgcttttgatgctcttctcaaggtgacactgactgagatgttctcttggcatgctaaatcatggataaactgtgaaccaaaatatggtgcaacatacgagacatgaatatagtccaaccatcagcatctcatcatgattttaaactgtgcgtgatataaactcttaaagatatgttgacaaaaagttatctatcatctttttactttgccagtcatgcaaatgtgagtttgccacatgataatcacccttcatcagaaatgggaccgcaagtggtaggcagtgtcccttctgcttgaaacctattgaaaccaatttaaaactgtgtactttttaaataaagtatattaaaatcataaaaaaaaaatctccg

SEQ ID NO: 63024 - DNA, 582 bp, Homo sapiens
tgcaccatcatctaggtcccagaagacttcgttcttacgttagagagggggagagaggtctggggaaagttgaaggtgtcctggagtctatttccgtctaaccaacccctgcctttccccataggagaatgcaagggagtgtgggggtgcgccgagtctccaagcccagacagtcctccttctgctccctctgcttttgatgctcttctcaaggtgacactgactgagatgttctcttactgactgagatgttctcttggcatgctaaatcatggataaactgtgaaccaaaatatggtgcaacatacgagacatgaatatagtccaaccatcagcatctcatcatgattttaaactgtgcgtgatataaactcttaaagatatgttgacaaaaagttatctatcatctttttactttgccagtcatgcaaatgtgagtttgccacatgataatcacccttcatcagaaatgggaccgcaagtggtaggcagtgtcccttctgcttgaaacctattgaaaccaatttaaaactgtgtactttttaaataaagtatattaaaatcataaaaaaaaaatctccg

SEQ ID NO: 63025 - DNA, 535 bp, Homo sapiens
  misc_feature (157)..(159): n is a, c, g, or t
gttcttctggaggttgtaaatgacttgtgaacttaccttggaaatccagtgtcttcatggaccataaatccatcctggccagagctctcaggcatggctaggaacagccagctgctagcagcttctctggctagctcaggcagggaaccctcattcnnngtctcctcgcaagcccagccatataatcgaatccttattacaaatggacgatccccttagttctggccaaggctgccagattagcacgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaaggggtacatttttctcaaacatttttgctgcttaatttaaaacaaaccactgtgaaaaattagctttgaaagctatatctggaataatcgtgagcggcagactaatataaaaaatggaagaaaattaaagagtgg

SEQ ID NO: 63026 - DNA, 434 bp, Homo sapiens
  misc_feature (157)..(159): n is a, c, g, or t
gttcttctggaggttgtaaatgacttgtgaacttaccttggaaatccagtgtcttcatggaccataaatccatcctggccagagctctcaggcatggctaggaacagccagctgctagcagcttctctggctagctcaggcagggaaccctcattcnnngtctcctcgcaagcccagccatataatcgaatccttattacaaatggacgatccccttagttctggccaaggctgccagattagcacggtgagtgtgagtgtggggttgtggccagcatggggaggacacagcaagctgacttaaaataactcctattccctctccatctgccatggactttgtttcggcccctacagccagaggaaagaggtgggtttctctgaagcacaataccaatatttttctaatttgtcctataaaatctttcccctga

SEQ ID NO: 63027 - DNA, 402 bp, Homo sapiens
ttttcaccagagttcaactgattttcttcctaaactgtaactgaagctaaaccatgaatattgaagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggtccatccatgttgtaaatggtaggatttccttctttccaaggctgggtaccaaagacattttttgctgtgaagtcacctcctctcccaacttgtcctttaaaatatatgtatagaaagaaaggccttaaaa

SEQ ID NO: 63028 - DNA, 3545 bp, Homo sapiens
gttgactgtgacacgggtgttacatatcttcctgtgccccttctccctgtagggtgaagctctgggcctcggcttttggtggggagataaaatccattgctgctaagtactccggttcccagcttctgcaaaagaaatacaaagagtatgagaaagacgttgccatagaagaaatcgatggcctccaactggtaaagaagctggcaaagaacatggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggattttttacccaaatctccaccttggctgatgtgcaggagaatgtcatggaataccttcacgtgcttagccggcccaaagtcatcgaccaggagcatgatgtggtgtggaccgaagcttacattgacagcactctccctcaggcacaaaagagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaagggaaacgggttttggtgatgacaaatgactactattatacagacatcaagggtactcctttcagtttaggtgtggcgctttccagaggtcatgggaaatatttcttccgagggaatgtaaccatcgaagaaggcctgcatgacttagaacatcccgatgtgtccttggcagatgaatggtcctactgcaacactgacctacaccctgagcaccgccatctgtctcagttagaagcgattaagctctacctaaaaggcaaagaacctctgctccagtgtgataaagaattgatccaagaagtcctttttgacgcggtggtgagtgcccccattgaagcgtattggaccagcctggccctcaacaaatctgaaaattctgacaagggcgtggaggttgccttcctcggcactcgcacgggcctctccagaatcaacctgtttgtcggggctgagcagctcaccaatcaggacttcctgaaagctggcgacaaggagaacatttttaacgcagaccatttccctctctggtaccgaagagccgctgagcagattccagggagcttcgtctactcgatcccattcagcactggaccagtcaataaaagcaatgtggtgacagcaagtacatccatccagctcctggatgaacggaaatctcctgtggtggcagctgtaggcattcagatgaaacttgaatttttccaaaggaagttctggactgccagcagacagtgtgcttccctggatggcaaatgctccatcagctgtgatgatgagactgtgaattgttacctcatagacaataatggatttattttggtgtctgaagactacacacagactggagacttttttggtgagatcgagggagctgtgatgaacaaattgctaacaatgggctcctttaaaagaattaccctttatgactaccaagccatgtgtagagccaacaaggaaagcagcgatggcgcccatggcctcctggatccttataatgccttcctctctgcagtaaaatggatcatgacagaacttgtcttgttcctggtggaatttaacctctgcagttggtggcactccgatatgacagctaaagcccagaaattgaaacagaccctggagccttgtgatactgaatatccagcattcgtctctgagcgcaccatcaaggagactacagggaatattgcttgtgaagactgctccaagtcctttgtcatccagcaaatcccaagcagcaacctgttcatggtggtggtggacagcagctgcctctgtgaatctgtggcccccatcaccatggcacccattgaaatcaggtagtagaaaaaagcaatccttggaaacatgccttaactacagtcaacataatgaatcccttaagtgtgaacgtctaaaggcccagaagatcagaaggcgcccagaatcttgtcatggcttccatcctgaggagaatgcaagggagtgtgggggtgcgccgagtctccaagcccagacagtcctccttctgctccctctgcttttgatgctcttctcaaggtgacactgactgagatgttctcttactgactgagatgttctcttggcatgctaaatcatggataaactgtgaaccaaaatatggtgcaacatacgagacatgaatatagtccaaccatcagcatctcatcatgattttaaactgtgcgtgatataaactcttaaagatatgttgacaaaaagttatctatcatctttttactttgccagtcatgcaaatgtgagtttgccacatgataatcacccttcatcagaaatgggaccgcaagtggtaggcagtgtcccttctgcttgaaacctattgaaaccaatttaaaactgtgtactttttaaataaagtatattaaaatcataaaaaaaaaatctccg

SEQ ID NO: 63029 - DNA, 490 bp, Homo sapiens
atccctcagactcttatgcctaccatcctgaggagaatgcaagggagtgtgggggtgcgccgagtctccaagcccagacagtcctccttctgctccctctgcttttgatgctcttctcaaggtgacactgactgagatgttctcttactgactgagatgttctcttggcatgctaaatcatggataaactgtgaaccaaaatatggtgcaacatacgagacatgaatatagtccaaccatcagcatctcatcatgattttaaactgtgcgtgatataaactcttaaagatatgttgacaaaaagttatctatcatctttttactttgccagtcatgcaaatgtgagtttgccacatgataatcacccttcatcagaaatgggaccgcaagtggtaggcagtgtcccttctgcttgaaacctattgaaaccaatttaaaactgtgtactttttaaataaagtatattaaaatcataaaaaaaaaatctccg

SEQ ID NO: 63030 - DNA, 486 bp, Homo sapiens
acagaagcggcctgatcgaagggcagtcaatctacctgtcagatggcgggtagtggaagagaccgtctgacaggaacttccccgtaacgtccctctgcttttgatgctcttctcaaggtgacactgactgagatgttctcttactgactgagatgttctcttggcatgctaaatcatggataaactgtgaaccaaaatatggtgcaacatacgagacatgaatatagtccaaccatcagcatctcatcatgattttaaactgtgcgtgatataaactcttaaagatatgttgacaaaaagttatctatcatctttttactttgccagtcatgcaaatgtgagtttgccacatgataatcacccttcatcagaaatgggaccgcaagtggtaggcagtgtcccttctgcttgaaacctattgaaaccaatttaaaactgtgtactttttaaataaagtatattaaaatcataaaaaaaaaatctccg

SEQ ID NO: 63031 - DNA, 1772 bp, Homo sapiens
gttgactgtgacacgggtgttacatatcttcctgtgccccttctccctgtagggtgaagctctgggcctcggcttttggtggggagataaaatccattgctgctaagtactccggttcccagcttctgcaaaagaaatacaaagagtatgagaaagacgttgccatagaagaaatcgatggcctccaactggtaaagaagctggcaaagaacatggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggattttttacccaaatctccaccttggctgatgtgcaggagaatgtcatggaataccttcacgtgcttagccggcccaaagtcatcgaccaggagcatgatgtggtgtggaccgaagcttacattgacagcactctccctcaggcacaaaagagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaaggggtacatttttctcaaacatttttgctgcttaatttaaaacaaaccactgtgaaaaattagctttgaaagctatatctggaataatcgtgagcggcagactaatataaaaaatggaagaaaattaaagagtgg

SEQ ID NO: 63032 - DNA, 617 bp, Homo sapiens
cacacacacacacaccccccattcaaggaggggacagattttcctttgcatctggtgttttggaaaccaagaagtctacaaggtaaattcatatcaagcaaagagttaacttttctactcccaacttggagccaatgtttagaggcatctgaccttggctttcctgtcattaaaagtccctaggactgtcaccctgctgggcttctcaccctcatcggtccactcccaagccctgtccatgaaacaggacttgggaaggtaaagattgccctggctgatgacttcacggacttttgtttttcttttctttttcttcttccccttgctagtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaaggggtacatttttctcaaacatttttgctgcttaatttaaaacaaaccactgtgaaaaattagctttgaaagctatatctggaataatcgtgagcggcagactaatataaaaaatggaagaaaattaaagagtgg

SEQ ID NO: 63033 - DNA, 1769 bp, Homo sapiens
gttgactgtgacacgggtgttacatatcttcctgtgccccttctccctgtagggtgaagctctgggcctcggcttttggtggggagataaaatccattgctgctaagtactccggttcccagcttctgcaaaagaaatacaaagagtatgagaaagacgttgccatagaagaaatcgatggcctccaactggtaaagaagctggcaaagaacatggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggattttttacccaaatctccaccttggctgatgtgcaggagaatgtcatggaataccttcacgtgcttagccggcccaaagtcatcgaccaggagcatgatgtggtgtggaccgaagcttacattgacagcactctccctcaggcacaaaagctgactgatgatcagggccccgtcctgatgaccactgtagccatgcctgtgtttagtaagcagaacgaaaccagatcgaagggcattcttctgggagtggttggcacagatgtcccagtgaaagaacttctgaagaccatccccaaatacaagtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaaggggtacatttttctcaaacatttttgctgcttaatttaaaacaaaccactgtgaaaaattagctttgaaagctatatctggaataatcgtgagcggcagactaatataaaaaatggaagaaaattaaagagtgg

SEQ ID NO: 63034 - DNA, 3499 bp, Homo sapiens
gttgactgtgacacgggtgttacatatcttcctgtgccccttctccctgtagggtgaagctctgggcctcggcttttggtggggagataaaatccattgctgctaagtactccggttcccagcttctgcaaaagaaatacaaagagtatgagaaagacgttgccatagaagaaatcgatggcctccaactggtaaagaagctggcaaagaacatggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggattttttacccaaatctccaccttggctgatgtgcaggagaatgtcatggaataccttcacgtgcttagccggcccaaagtcatcgaccaggagcatgatgtggtgtggaccgaagcttacattgacagcactctccctcaggcacaaaagagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaagggaaacgggttttggtgatgacaaatgactactattatacagacatcaagggtactcctttcagtttaggtgtggcgctttccagaggtcatgggaaatatttcttccgagggaatgtaaccatcgaagaaggcctgcatgacttagaacatcccgatgtgtccttggcagatgaatggtcctactgcaacactgacctacaccctgagcaccgccatctgtctcagttagaagcgattaagctctacctaaaaggcaaagaacctctgctccagtgtgataaagaattgatccaagaagtcctttttgacgcggtggtgagtgcccccattgaagcgtattggaccagcctggccctcaacaaatctgaaaattctgacaagggcgtggaggttgccttcctcggcactcgcacgggcctctccagaatcaacctgtttgtcggggctgagcagctcaccaatcaggacttcctgaaagctggcgacaaggagaacatttttaacgcagaccatttccctctctggtaccgaagagccgctgagcagattccagggagcttcgtctactcgatcccattcagcactggaccagtcaataaaagcaatgtggtgacagcaagtacatccatccagctcctggatgaacggaaatctcctgtggtggcagctgtaggcattcagatgaaacttgaatttttccaaaggaagttctggactgccagcagacagtgtgcttccctggatggcaaatgctccatcagctgtgatgatgagactgtgaattgttacctcatagacaataatggatttattttggtgtctgaagactacacacagactggagacttttttggtgagatcgagggagctgtgatgaacaaattgctaacaatgggctcctttaaaagaattaccctttatgactaccaagccatgtgtagagccaacaaggaaagcagcgatggcgcccatggcctcctggatccttataatgccttcctctctgcagtaaaatggatcatgacagaacttgtcttgttcctggtggaatttaacctctgcagttggtggcactccgatatgacagctaaagcccagaaattgaaacagaccctggagccttgtgatactgaatatccagcattcgtctctgagcgcaccatcaaggagactacagggaatattgcttgtgaagactgctccaagtcctttgtcatccagcaaatcccaagcagcaacctgttcatggtggtggtggacagcagctgcctctgtgaatctgtggcccccatcaccatggcacccattgaaatcaggtataatgaatcccttaagtgtgaacgtctaaaggcccagaagatcagaaggcgcccagaatcttgtcatggcttccatcctgaggagaatgcaagggagtgtgggggtgcgccgagtctccaagcccagacagtcctccttctgctccctctgcttttgatgctcttctcaaggtgacactgactgagatgttctcttactgactgagatgttctcttggcatgctaaatcatggataaactgtgaaccaaaatatggtgcaacatacgagacatgaatatagtccaaccatcagcatctcatcatgattttaaactgtgcgtgatataaactcttaaagatatgttgacaaaaagttatctatcatctttttactttgccagtcatgcaaatgtgagtttgccacatgataatcacccttcatcagaaatgggaccgcaagtggtaggcagtgtcccttctgcttgaaacctattgaaaccaatttaaaactgtgtactttttaaataaagtatattaaaatcataaaaaaaaaatctccg

SEQ ID NO: 63035 - DNA, 2736 bp, Homo sapiens
gttgactgtgacacgggtgttacatatcttcctgtgccccttctccctgtagggtgaagctctgggcctcggcttttggtggggagataaaatccattgctgctaagtactccggttcccagcttctgcaaaagaaatacaaagagtatgagaaagacgttgccatagaagaaatcgatggcctccaactggtaaagaagctggcaaagaacatggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggattttttacccaaatctccaccttggctgatgtgcaggagaatgtcatggaataccttcacgtgcttagccggcccaaagtcatcgaccaggagcatgatgtggtgtggaccgaagcttacattgacagcactctccctcaggcacaaaagagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaagggaaacgggttttggtgatgacaaatgactactattatacagacatcaagggtactcctttcagtttaggtgtggcgctttccagaggtcatgggaaatatttcttccgagggaatgtaaccatcgaagaaggcctgcatgacttagaacatcccgatgtgtccttggcagatgaatggtcctactgcaacactgacctacaccctgagcaccgccatctgtctcagttagaagcgattaagctctacctaaaaggcaaagaacctctgctccagtgtgataaagaattgatccaagaagtcctttttgacgcggtggtgagtgcccccattgaagcgtattggaccagcctggccctcaacaaatctgaaaattctgacaagggcgtggaggttgccttcctcggcactcgcacgggcctctccagaatcaacctgtttgtcggggctgagcagctcaccaatcaggacttcctgaaagctggcgacaaggagaacatttttaacgcagaccatttccctctctggtaccgaagagccgctgagcagattccagggagcttcgtctactcgatcccattcagcactggaccagtcaataaaagcaatgtggtgacagcaagtacatccatccagctcctggatgaacggaaatctcctgtggtggcagctgtaggcattcagatgaaacttgaatttttccaaaggaagttctggactgccagcagacagtgtgcttccctggatggcaaatgctccatcagctgtgatgatgagactgtgaattgttacctcatagacaataatggatttattttggtgtctgaagactacacacagactggagacttttttggtgagatcgagggagctgtgatgaacaaattgctaacaatgggctcctttaaaagacccaggaccacaactttttcttctacctttctccaagatggcttttaagttcaaggttacctcatgattcaatgtagctgctgagccccagccatcatatctgcaattcaggcttgcaaaagaagagttcagggagttccaaaagctccaaaaggccaagtttcaaattactttttaataaatgctt

SEQ ID NO: 63036 - DNA, 1453 bp, Homo sapiens
gttgactgtgacacgggtgttacatatcttcctgtgccccttctccctgtagggtgaagctctgggcctcggcttttggtggggagataaaatccattgctgctaagtactccggttcccagcttctgcaaaagaaatacaaagagtatgagaaagacgttgccatagaagaaatcgatggcctccaactggtaaagaagctggcaaagaacatggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggaaccaaaagcttaggaagactagaaagagtctccatagatctcctggccacaggctgtgtctctcatcccagttaattatcttctaatatcatgccagacaccacagatggttcgcatcttcacatacctcattggacgagaggctgcgtttgcagacaatctaaagtggatggcctgtgccaacaaaggtacatggtccagacagaacagtcacgagatgcagcagccttcatcagcctgggtccctgagtgagcacatggagcagatgactttcactgccccttgcatctgccaacccacactggattataaatagtgttcatgacaaataaacttttatgttaagccactga

SEQ ID NO: 63037 - DNA, 1296 bp, Homo sapiens
tgtttttttttttaacatccaatctttcccagcatatgcacataagaaggtgaatgaagcaatgtgaaacttacttctctttagtcaagtgaaaaaaaggctaaacatttgttagatggtaaaatattgtgtcaagcgagtaggcaaattccaaaattacacagtggttgatacattaacatcctcaaatatttgagcatgcacttcctttgagatctgtaaattaaatcaccagtgggttagataaaaatacaaaacaaatggcaatctaaccatctcagaaaaggttcaggtttttttctccctaaaactgagaacttgctaaataatttttgaaaagcataaacgtaatacaccctgggttacgatcgagggcagaagggaaggcatttccaaggctcctgctgtagtgtttttcccatttttgttaatacctcaaaaactcccagagatgactttattcctggcccctgcagagctcccctccccacccccaccttgtagactgtaacagattgcaccacatggtgtctgtttaaaaaaaaaaaaaaaattcccatagggacctggatatcccattaatgggctttatgttcctcatggcaaattagctttacacaggaatttccaaacattgttttctgttaagaagggaggaataccatatataatgtatattttttctacaattagtaggaatcagacaaggaaaaggaaatgtcatctattcatacctttctctccaaattcagtgttctttccatatgctccattgtactccaccactcttctccatgaaaactatgaatttatggtttttttttagaaaaatggagttttcaaaatgaaagtcaaataattttttccaaagccgtttgtggactgttgcaaatgcataaatattcaaagctcattttctgcagaaacacttctggtatatgaaattattaaactgtagaatgctaaagatcagaagaagctacagtttttctttaaacttgaaaaaaaattaagaagtattaaggaaaaagcttaatactctggaaaccagacatctggtctttctcatgcgtagggagcagtgtgaatgaaagtgaagtcaaacggacagtttttttctgcattatgcacaaggtgttttaaattgtcagcttaaggtttagatgaagataatctttaactttgtttacaatttttgctattttgcattatccccctttttccataaaaaataaagtgaatatgtgtgcatatttattttgaatcaaaattaaacttattttgagattattttgt

SEQ ID NO: 63038 - DNA, 1803 bp, Homo sapiens
  misc_feature (57)..(57): n is a, c, g, or t
acgcttgtcacttacgtgagcgcagccaatcagcactagaggttgggatatttcggnccaaaggagaacggggacttgtggggacgctcctgcgcaccaatgaatgtgcatggagatggagaggcgggcctgcaagtgcgaacaagccaatcacggaatcccggcggccggcggcccgggaggcagtcgcgcgctcgcatccccaagatggcggccgttaaggacagttgtggcaaaggagaaatggccacagggaatgggcggcggctccacctggggattcctgaggccgtgtttgtggaagatgtagattccttcatgaaacagcctgggaatgagactgcagatacagtattaaagaagctggatgaacagtaccagaagtataagtttatggaactcaaccttgctcaaaagaaaagaaggctaaaaggtcagattcctgaaattaaacagactttggaaattctaaaatacatgcagaagaaaaaagagtccaccaactcaatggagaccagattcttgctggcagataacctgtattgcaaagcttcagttcctcctaccgataaagtgtgtctgtggttgggggctaatgtaatgcttgaatatgatattgatgaagctcaggcattgttggaaaagaatttatcgactgccacaaagaatcttgattccctggaggaagaccttgactttcttcgagatcaatttactaccacagaagtcaatatggccagggtttataattgggatgtaaaaagaagaaacaaggatgactctaccaagaacaaagcataatgctggcaattaaaaatgtggtttagttttccaaacatgttatcttaaatacccctttatccttacaggttgacataactttgaatgttttaacagcaagaattttaagaaaagataaacaccattttatttatttataaaaacaaaattagtttcaaatatttttgacattgtgatttttttttccacatttctcagcaaagctaatggtattttaatcattatttttgcctgtcataagaaaactcttagctgaaatggccgaaaactgtgagacatgctatggaagctgaatgccggacgctagcacagtttactttttccctttctaatcggctgatgttactctcacttgatgtggttaaaccattttagaggtagagaagacagacagtttgaatatttgtaaacttgtttttctttggtatatttaggacttagtggtcctctgttgctattgtcttctataagtggagtttcatgacttactgcttaacgaataactaactactatgatattctggacattttaggaaatggtaatttgccttgctacacattaagagggctattaagactacattttttctaacctcagataagtgcagtgtctttgcaatgccaacataagggagatcttggccaacgtgaaataaaattactcattcaaaactctgcctaaggtgattttgtagttcttaacagttctccagagcatcttgaacaggaatattaagataaatgtgaatctgcaatggctgaaaagagttgtgagcttttttattcatgataaaaccttataggaatagtataaaaaatccctgtggaaagctactagtacattgaccagcgctgggtgatacagattctgataaaaacataaatgtattagttcatctccatgtagtaaaaagtatacttatacaatgttttgtacttgtatttcatgaaattaaaacagtgatgctaaaactatggcagagcacttttttcatgttactc

SEQ ID NO: 63039 - DNA, 365 bp, Homo sapiens
agatctccgccccgccccctccccccccttcaaaactctgcctaaggtgattttgtagttcttaacagttctccagagcatcttgaacaggaatattaagataaatgtgaatctgcaatggctgaaaagagttgtgagcttttttattcatgataaaaccttataggaatagtataaaaaatccctgtggaaagctactagtacattgaccagcgctgggtgatacagattctgataaaaacataaatgtattagttcatctccatgtagtaaaaagtatacttatacaatgttttgtacttgtatttcatgaaattaaaacagtgatgctaaaactatggcagagcacttttttcatgttactc

SEQ ID NO: 63040 - DNA, 331 bp, Homo sapiens
cctactactactactactactaaattcgcggccgtgcgacagagcatcttgaacaggaatattaagataaatgtgaatctgcaatggctgaaaagagttgtgagcttttttattcatgataaaaccttataggaatagtataaaaaatccctgtggaaagctactagtacattgaccagcgctgggtgatacagattctgataaaaacataaatgtattagttcatctccatgtagtaaaaagtatacttatacaatgttttgtacttgtatttcatgaaattaaaacagtgatgctaaaactatggcagagcacttttttcatgttactc

SEQ ID NO: 63041 - DNA, 1619 bp, Homo sapiens
  misc_feature (38)..(38): n is a, c, g, or t
tggctaggacaggcgtgtgttatcggccgaggcgttangacagttgtggcaaaggagaaatggccacagggaatgggcggcggctccacctggggattcctgaggccgtgtttgtggaagatgtagattccttcatgaaacagcctgggaatgagactgcagatacagtattaaagaagctggatgaacagtaccagaagtataagtttatggaactcaaccttgctcaaaagaaaagaaggctaaaaggtcagattcctgaaattaaacagactttggaaattctaaaatacatgcagaagaaaaaagagtccaccaactcaatggagaccagattcttgctggcagataacctgtattgcaaagcttcagttcctcctaccgataaagtgtgtctgtggttgggggctaatgtaatgcttgaatatgatattgatgaagctcaggcattgttggaaaagaatttatcgactgccacaaagaatcttgattccctggaggaagaccttgactttcttcgagatcaatttactaccacagaagtcaatatggccagggtttataattgggatgtaaaaagaagaaacaaggatgactctaccaagaacaaagcataatgctggcaattaaaaatgtggtttagttttccaaacatgttatcttaaatacccctttatccttacaggttgacataactttgaatgttttaacagcaagaattttaagaaaagataaacaccattttatttatttataaaaacaaaattagtttcaaatatttttgacattgtgatttttttttccacatttctcagcaaagctaatggtattttaatcattatttttgcctgtcataagaaaactcttagctgaaatggccgaaaactgtgagacatgctatggaagctgaatgccggacgctagcacagtttactttttccctttctaatcggctgatgttactctcacttgatgtggttaaaccattttagaggtagagaagacagacagtttgaatatttgtaaacttgtttttctttggtatatttaggacttagtggtcctctgttgctattgtcttctataagtggagtttcatgacttactgcttaacgaataactaactactatgatattctggacattttaggaaatggtaatttgccttgctacacattaagagggctattaagactacattttttctaacctcagataagtgcagtgtctttgcaatgccaacataagggagatcttggccaacgtgaaataaaattactcattcaaaactctgcctaaggtgattttgtagttcttaacagttctccagagcatcttgaacaggaatattaagataaatgtgaatctgcaatggctgaaaagagttgtgagcttttttattcatgataaaaccttataggaatagtataaaaaatccctgtggaaagctactagtacattgaccagcgctgggtgatacagattctgataaaaacataaatgtattagttcatctccatgtagtaaaaagtatacttatacaatgttttgtacttgtatttcatgaaattaaaacagtgatgctaaaactatggcagagcacttttttcatgttactc

SEQ ID NO: 63042 - DNA, 1639 bp, Homo sapiens
  misc_feature (38)..(38): n is a, c, g, or t
tggctaggacaggcgtgtgttatcggccgaggcgttangacagttgtggcaaaggagaaatggccacagggaatgggcggcggctccacctggggattcctgaggccgtgtttgtgtattatttttgatattaaaggaagatgtagattccttcatgaaacagcctgggaatgagactgcagatacagtattaaagaagctggatgaacagtaccagaagtataagtttatggaactcaaccttgctcaaaagaaaagaaggctaaaaggtcagattcctgaaattaaacagactttggaaattctaaaatacatgcagaagaaaaaagagtccaccaactcaatggagaccagattcttgctggcagataacctgtattgcaaagcttcagttcctcctaccgataaagtgtgtctgtggttgggggctaatgtaatgcttgaatatgatattgatgaagctcaggcattgttggaaaagaatttatcgactgccacaaagaatcttgattccctggaggaagaccttgactttcttcgagatcaatttactaccacagaagtcaatatggccagggtttataattgggatgtaaaaagaagaaacaaggatgactctaccaagaacaaagcataatgctggcaattaaaaatgtggtttagttttccaaacatgttatcttaaatacccctttatccttacaggttgacataactttgaatgttttaacagcaagaattttaagaaaagataaacaccattttatttatttataaaaacaaaattagtttcaaatatttttgacattgtgatttttttttccacatttctcagcaaagctaatggtattttaatcattatttttgcctgtcataagaaaactcttagctgaaatggccgaaaactgtgagacatgctatggaagctgaatgccggacgctagcacagtttactttttccctttctaatcggctgatgttactctcacttgatgtggttaaaccattttagaggtagagaagacagacagtttgaatatttgtaaacttgtttttctttggtatatttaggacttagtggtcctctgttgctattgtcttctataagtggagtttcatgacttactgcttaacgaataactaactactatgatattctggacattttaggaaatggtaatttgccttgctacacattaagagggctattaagactacattttttctaacctcagataagtgcagtgtctttgcaatgccaacataagggagatcttggccaacgtgaaataaaattactcattcaaaactctgcctaaggtgattttgtagttcttaacagttctccagagcatcttgaacaggaatattaagataaatgtgaatctgcaatggctgaaaagagttgtgagcttttttattcatgataaaaccttataggaatagtataaaaaatccctgtggaaagctactagtacattgaccagcgctgggtgatacagattctgataaaaacataaatgtattagttcatctccatgtagtaaaaagtatacttatacaatgttttgtacttgtatttcatgaaattaaaacagtgatgctaaaactatggcagagcacttttttcatgttactc

SEQ ID NO: 63043 - DNA, 1749 bp, Homo sapiens
  misc_feature (57)..(57): n is a, c, g, or t
acgcttgtcacttacgtgagcgcagccaatcagcactagaggttgggatatttcggnccaaaggagaacggggacttgtggggacgctcctgcgcaccaatgaatgtgcatggagatggagaggcgggcctgcaagtgcgaacaagccaatcacggaatcccggcggccggcggcccgggaggcagtcgcgcgctcgcatccccaagatggcggccgttaaggacagttgtggcaaaggagaaatggccacagggaatgggcggcggctccacctggggattcctgaggccgtgtttgtggaagatgtagattccttcatgaaacagcctgggaatgagactgcagatacagtattaaagaagctggatgaacagtaccagaagtataagtttatggaactcaaccttgctcaaaagaaaagaaggctaaaaggtcagattcctgaaattaaacagactttggaaattctaaaatacatgcagaagaaaaaagagtccaccaactcaatggagaccagattcttgctggcagataacctgtattgcaaagcttcagttcctcctaccgataaagtgtgtctgtggttgggggctaatgtaatgcttgaatatgatattgatgaagctcaggcattgttggaaaagaatttatcgactgccacaaagaatcttgattccctggaggaagaccttgactttcttcgagatcaatttactaccacagaagtcaatatggccagggtttataattgggatgtaaaaagaagaaacaaggatgactctaccaagaacaaagcataatgctggcaattaaggttgacataactttgaatgttttaacagcaagaattttaagaaaagataaacaccattttatttatttataaaaacaaaattagtttcaaatatttttgacattgtgatttttttttccacatttctcagcaaagctaatggtattttaatcattatttttgcctgtcataagaaaactcttagctgaaatggccgaaaactgtgagacatgctatggaagctgaatgccggacgctagcacagtttactttttccctttctaatcggctgatgttactctcacttgatgtggttaaaccattttagaggtagagaagacagacagtttgaatatttgtaaacttgtttttctttggtatatttaggacttagtggtcctctgttgctattgtcttctataagtggagtttcatgacttactgcttaacgaataactaactactatgatattctggacattttaggaaatggtaatttgccttgctacacattaagagggctattaagactacattttttctaacctcagataagtgcagtgtctttgcaatgccaacataagggagatcttggccaacgtgaaataaaattactcattcaaaactctgcctaaggtgattttgtagttcttaacagttctccagagcatcttgaacaggaatattaagataaatgtgaatctgcaatggctgaaaagagttgtgagcttttttattcatgataaaaccttataggaatagtataaaaaatccctgtggaaagctactagtacattgaccagcgctgggtgatacagattctgataaaaacataaatgtattagttcatctccatgtagtaaaaagtatacttatacaatgttttgtacttgtatttcatgaaattaaaacagtgatgctaaaactatggcagagcacttttttcatgttactc

SEQ ID NO: 63044 - DNA, 1366 bp, Homo sapiens
  misc_feature (57)..(57): n is a, c, g, or t
acgcttgtcacttacgtgagcgcagccaatcagcactagaggttgggatatttcggnccaaaggagaacggggacttgtggggacgctcctgcgcaccaatgaatgtgcatggagatggagaggcgggcctgcaagtgcgaacaagccaatcacggaatcccggcggccggcggcccgggaggcagtcgcgcgctcgcatccccaagatggcggccgttaaggacaaagaatcttgattccctggaggaagaccttgactttcttcgagatcaatttactaccacagaagtcaatatggccagggtttataattgggatgtaaaaagaagaaacaaggatgactctaccaagaacaaagcataatgctggcaattaaaaatgtggtttagttttccaaacatgttatcttaaatacccctttatccttacaggttgacataactttgaatgttttaacagcaagaattttaagaaaagataaacaccattttatttatttataaaaacaaaattagtttcaaatatttttgacattgtgatttttttttccacatttctcagcaaagctaatggtattttaatcattatttttgcctgtcataagaaaactcttagctgaaatggccgaaaactgtgagacatgctatggaagctgaatgccggacgctagcacagtttactttttccctttctaatcggctgatgttactctcacttgatgtggttaaaccattttagaggtagagaagacagacagtttgaatatttgtaaacttgtttttctttggtatatttaggacttagtggtcctctgttgctattgtcttctataagtggagtttcatgacttactgcttaacgaataactaactactatgatattctggacattttaggaaatggtaatttgccttgctacacattaagagggctattaagactacattttttctaacctcagataagtgcagtgtctttgcaatgccaacataagggagatcttggccaacgtgaaataaaattactcattcaaaactctgcctaaggtgattttgtagttcttaacagttctccagagcatcttgaacaggaatattaagataaatgtgaatctgcaatggctgaaaagagttgtgagcttttttattcatgataaaaccttataggaatagtataaaaaatccctgtggaaagctactagtacattgaccagcgctgggtgatacagattctgataaaaacataaatgtattagttcatctccatgtagtaaaaagtatacttatacaatgttttgtacttgtatttcatgaaattaaaacagtgatgctaaaactatggcagagcacttttttcatgttactc

SEQ ID NO: 63045 - DNA, 1031 bp, Homo sapiens
  misc_feature (9)..(9): n is a, c, g, or t
caaaattangtttcaaatatttttgtttttataaataaataaaatggtgtttatcttttcttaaaattcttgctgttaaaacattcaaagttatgtcaacctgtaaggataaaggggtatttaagataacatgtttggaaaagataaacaccattttatttatttataaaaacaaaattagtttcaaatatttttgacattgtgatttttttttccacatttctcagcaaagctaatggtattttaatcattatttttgcctgtcataagaaaactcttagctgaaatggccgaaaactgtgagacatgctatggaagctgaatgccggacgctagcacagtttactttttccctttctaatcggctgatgttactctcacttgatgtggttaaaccattttagaggtagagaagacagacagtttgaatatttgtaaacttgtttttctttggtatatttaggacttagtggtcctctgttgctattgtcttctataagtggagtttcatgacttactgcttaacgaataactaactactatgatattctggacattttaggaaatggtaatttgccttgctacacattaagagggctattaagactacattttttctaacctcagataagtgcagtgtctttgcaatgccaacataagggagatcttggccaacgtgaaataaaattactcattcaaaactctgcctaaggtgattttgtagttcttaacagttctccagagcatcttgaacaggaatattaagataaatgtgaatctgcaatggctgaaaagagttgtgagcttttttattcatgataaaaccttataggaatagtataaaaaatccctgtggaaagctactagtacattgaccagcgctgggtgatacagattctgataaaaacataaatgtattagttcatctccatgtagtaaaaagtatacttatacaatgttttgtacttgtatttcatgaaattaaaacagtgatgctaaaactatggcagagcacttttttcatgttactc

SEQ ID NO: 63046 - DNA, 1019 bp, Homo sapiens
  misc_feature (57)..(57): n is a, c, g, or t
acgcttgtcacttacgtgagcgcagccaatcagcactagaggttgggatatttcggnccaaaggagaacggggacttgtggggacgctcctgcgcaccaatgaatgtgcatggagatggagaggcgggcctgcaagtgcgaacaagccaatcacggaatcccggcggccggcggcccgggaggcagtcgcgcgctcgcatccccaagatggcggccgttaaggacagttgtggcaaaggagaaatggccacagggaatgggcggcggctccacctggggattcctgaggccgtgtttgtggaagatgtagattccttcatgaaacagcctgggaatgagactgcagatacagtattaaagaagctggatgaacagtaccagaagtataagtttatggaactcaaccttgctcaaaagaaaagaaggctaaaaggtcagattcctgaaattaaacagactttggaaattctaaaatacatgcagaagaaaaaagagtccaccaactcaatggagaccagattcttgctggcagataacctgtattgcaaagcttcagttcctcctaccgataaagtgtgtctgtggttgggggctaatgtaatgcttgaatatgatattgatgaagctcaggcattgttggaaaagaatttatcgactgccacaaagaatcttgattccctggaggaagaccttgactttcttcgagatcaatttactaccacagaagtcaagcatcttgaacaggaatattaagataaatgtgaatctgcaatggctgaaaagagttgtgagcttttttattcatgataaaaccttataggaatagtataaaaaatccctgtggaaagctactagtacattgaccagcgctgggtgatacagattctgataaaaacataaatgtattagttcatctccatgtagtaaaaagtatacttatacaatgttttgtacttgtatttcatgaaattaaaacagtgatgctaaaactatggcagagcacttttttcatgttactc

SEQ ID NO: 63047 - DNA, 903 bp, Homo sapiens
  misc_feature (38)..(38): n is a, c, g, or t
  misc_feature (751)..(751): n is a, c, g, or t
  misc_feature (753)..(753): n is a, c, g, or t
  misc_feature (756)..(756): n is a, c, g, or t
  misc_feature (759)..(759): n is a, c, g, or t
  misc_feature (771)..(771): n is a, c, g, or t
  misc_feature (775)..(775): n is a, c, g, or t
  misc_feature (777)..(777): n is a, c, g, or t
tggctaggacaggcgtgtgttatcggccgaggcgttangacagttgtggcaaaggagaaatggccacagggaatgggcggcggctccacctggggattcctgaggccgtgtttgtggaagatgtagattccttcatgaaacagcctgggaatgagactgcagatacagtattaaagaagctggatgaacagtaccagaagtataagtttatggaactcaaccttgctcaaaagaaaagaaggctaaaaggtcagattcctgaaattaaacagactttggaaattctaaaatacatgcagaagaaaaaagagtccaccaactcaatggagaccagattcttgctggcagataacctgtattgcaaagcttcagttcctcctaccgataaagtgtgtctgtggttgggggctaatgtaatgcttgaatatgatattgatgaagctcaggcattgttggaaaagaatttatcgactgccacaaagaatcttgattccctggaggaagaccttgactttcttcgagatcaatttactaccacagaagtcaatatggccagggtttataattgggatgtaaaaagaagaaacaaggatgactctaccaagaacaaagcataatgctggcaattaaaaatgtggtttagttttccaaacatgttatcttaaatacccctttatccttacaggttgacataactttgaatgttttaacagcaagaattttaagaaaagataaacaccattttattttnanacnatngttcaatttgcncggntnttccatctcccaagagggtgtaacctttggcgccaaactgtgaggcgcgggagatgggggccccgcgacacccggggcccctgcaaaagaggagttttcggtgccgctgtttcgcccacatatctc

SEQ ID NO: 63048 - DNA, 1470 bp, Homo sapiens
gacattagtagaaaatgcaaagttagtaagaccgtgtcctgttgtttatttttgcctgcaaaatactaagttactctttttcttgttcacaggctaaaaggtcagattcctgaaattaaacagactttggaaattctaaaatacatgcagaagaaaaaagagtccaccaactcaatggagaccagattcttgctggcagataacctgtattgcaaagcttcagttcctcctaccgataaagtgtgtctgtggttgggggctaatgtaatgcttgaatatgatattgatgaagctcaggcattgttggaaaagaatttatcgactgccacaaagaatcttgattccctggaggaagaccttgactttcttcgagatcaatttactaccacagaagtcaatatggccagggtttataattgggatgtaaaaagaagaaacaaggatgactctaccaagaacaaagcataatgctggcaattaaaaatgtggtttagttttccaaacatgttatcttaaatacccctttatccttacaggttgacataactttgaatgttttaacagcaagaattttaagaaaagataaacaccattttatttatttataaaaacaaaattagtttcaaatatttttgacattgtgatttttttttccacatttctcagcaaagctaatggtattttaatcattatttttgcctgtcataagaaaactcttagctgaaatggccgaaaactgtgagacatgctatggaagctgaatgccggacgctagcacagtttactttttccctttctaatcggctgatgttactctcacttgatgtggttaaaccattttagaggtagagaagacagacagtttgaatatttgtaaacttgtttttctttggtatatttaggacttagtggtcctctgttgctattgtcttctataagtggagtttcatgacttactgcttaacgaataactaactactatgatattctggacattttaggaaatggtaatttgccttgctacacattaagagggctattaagactacattttttctaacctcagataagtgcagtgtctttgcaatgccaacataagggagatcttggccaacgtgaaataaaattactcattcaaaactctgcctaaggtgattttgtagttcttaacagttctccagagcatcttgaacaggaatattaagataaatgtgaatctgcaatggctgaaaagagttgtgagcttttttattcatgataaaaccttataggaatagtataaaaaatccctgtggaaagctactagtacattgaccagcgctgggtgatacagattctgataaaaacataaatgtattagttcatctccatgtagtaaaaagtatacttatacaatgttttgtacttgtatttcatgaaattaaaacagtgatgctaaaactatggcagagcacttttttcatgttactc

SEQ ID NO: 63049 - DNA, 2964 bp, Homo sapiens
atatatagagttaagaagtctaggtctgcttccagaagaaaacagttccacgttgcttgaaattgaaaatcaagataaaaatgttcacaattaagctccttctttttattgttcctctagttatttcctccagaattgatcaagacaattcatcatttgattctctatctccagagccaaaatcaagatttgctatgttagacgatgtaaaaattttagccaatggcctccttcagttgggacatggtcttaaagactttgtccataagacgaagggccaaattaatgacatatttcaaaaactcaacatatttgatcagtctttttatgatctatcgctgcaaaccagtgaaatcaaagaagaagaaaaggaactgagaagaactacatataaactacaagtcaaaaatgaagaggtaaagaatatgtcacttgaactcaactcaaaacttgaaagcctcctagaagaaaaaattctacttcaacaaaaagtgaaatatttagaagagcaactaactaacttaattcaaaatcaacctgaaactccagaacacccagaagtaacttcacttaaaacttttgtagaaaaacaagataatagcatcaaagaccttctccagaccgtggaagaccaatataaacaattaaaccaacagcatagtcaaataaaagaaatagaaaatcagctcagaaggactagtattcaagaacccacagaaatttctctatcttccaagccaagagcaccaagaactactccctttcttcagttgaatgaaataagaaatgtaaaacatgatggcattcctgctgaatgtaccaccatttataacagaggtgaacatacaagtggcatgtatgccatcagacccagcaactctcaagtttttcatgtctactgtgatgttatatcaggtagtccatggacattaattcaacatcgaatagatggatcacaaaacttcaatgaaacgtgggagaactacaaatatggttttgggaggcttgatggagaattttggttgggcctagagaagatatactccatagtgaagcaatctaattatgttttacgaattgagttggaagactggaaagacaacaaacattatattgaatattctttttacttgggaaatcacgaaaccaactatacgctacatctagttgcgattactggcaatgtccccaatgcaatcccggaaaacaaagatttggtgttttctacttgggatcacaaagcaaaaggacacttcaactgtccagagggttattcaggaggctggtggtggcatgatgagtgtggagaaaacaacctaaatggtaaatataacaaaccaagagcaaaatctaagccagagaggagaagaggattatcttggaagtctcaaaatggaaggttatactctataaaatcaaccaaaatgttgatccatccaacagattcagaaagctttgaatgaactgaggcaaatttaaaaggcaataatttaaacattaacctcattccaagttaatgtggtctaataatctggtattaaatccttaagagaaagcttgagaaatagattttttttatcttaaagtcactgtctatttaagattaaacatacaatcacataaccttaaagaataccgtttacatttctcaatcaaaattcttataatactatttgttttaaattttgtgatgtgggaatcaattttagatggtcacaatctagattataatcaataggtgaacttattaaataacttttctaaataaaaaatttagagacttttattttaaaaggcatcatatgagctaatatcacaactttcccagtttaaaaaactagtactcttgttaaaactctaaacttgactaaatacagaggactggtaattgtacagttcttaaatgttgtagtattaatttcaaaactaaaaatcgtcagcacagagtatgtgtaaaaatctgtaatacaaatttttaaactgatgcttcattttgctacaaaataatttggagtaaatgtttgatatgatttatttatgaaacctaatgaagcagaattaaatactgtattaaaataagttcgctgtctttaaacaaatggagatgactactaagtcacattgactttaacatgaggtatcactataccttatttgttaaaatatatactgtatacattttatatattttaacacttaatactatgaaaacaaataattgtaaaggaatcttgtcagattacagtaagaatgaacatatttgtggcatcgagttaaagtttatatttcccctaaatatgctgtgattctaatacattcgtgtaggttttcaagtagaaataaacctcgtaacaagttactgaacgtttaaacagcctgacaagcatgtatatatgtttaaaattcaataaacaaagacccagtccctaaattatagaaatttaaattattcttgcatgtttatcgacatcacaacagatccctaaatccctaaatccctaaagattagatacaaattttttaccacagtatcacttgtcagaatttatttttaaatatgattttttaaaactgccagtaagaaattttaaattaaacccatttgttaaaggatatagtgcccaagttatatggtgacctacctttgtcaatacttagcattatgtatttcaaattatccaatatacatgtcatatatatttttatatgtcacatatataaaagatatgtatgatctatgtgaatcctaagtaaatattttgttccagaaaagtacaaaataataaaggtaaaaataatctataattttcaggaccacagactaagctgtcgaaattaacgctgatttttttagggccagaataccaaaatggctcctctcttcccccaaaattggacaatttcaaatgcaaaataattcattatttaatatatgagttgcttcctctatttggtttccttaaa

SEQ ID NO: 63050 - DNA, 3361 bp, Homo sapiens
atatatagagttaagaagtctaggtctgcttccagaagaaaacagttccacgttgcttgaaattgaaaatcaagataaaaatgttcacaattaagctccttctttttattgttcctctagttatttcctccagaattgatcaagacaattcatcatttgattctctatctccagagccaaaatcaagatttgctatgttagacgatgtaaaaattttagccaatggcctccttcagttgggacatggtcttaaagactttgtccataagacgaagggccaaattaatgacatatttcaaaaactcaacatatttgatcagtctttttatgatctatcgctgcaaaccagtgaaatcaaagaagaagaaaaggaactgagaagaactacatataaactacaagtcaaaaatgaagaggtaaagaatatgtcacttgaactcaactcaaaacttgaaagcctcctagaagaaaaaattctacttcaacaaaaagtgaaatatttagaagagcaactaactaacttaattcaaaatcaacctgaaactccagaacacccagaagtaacttcacttaaaacttttgtagaaaaacaagataatagcatcaaagaccttctccagaccgtggaagaccaatataaacaattaaaccaacagcatagtcaaataaaagaaatagaaaatcagctcagaaggactagtattcaagaacccacagaaatttctctatcttccaagccaagagcaccaagaactactccctttcttcagttgaatgaaataagaaatgtaaaacatgatggcattcctgctgaatgtaccaccatttataacagaggtgaacatacaagtggcatgtatgccatcagacccagcaactctcaagtttttcatgtctactgtgatgttatatcaggtagtccatggacattaattcaacatcgaatagatggatcacaaaacttcaatgaaacgtgggagaactacaaatatggttttgggaggcttgatggagaattttggttgggcctagagaagatatactccatagtgaagcaatctaattatgttttacgaattgagttggaagactggaaagacaacaaacattatattgaatattctttttacttgggaaatcacgaaaccaactatacgctacatctagttgcgattactggcaatgtccccaatgcaatcccggaaaacaaagatttggtgttttctacttgggatcacaaagcaaaaggacacttcaactgtccagagggttattcaggtatctttttctgataccaatactttattttcatatcttcaaagtatcttcccacattattagctattatctgcaatgacaacttttaaaaatccgaatcccaaataagcgttttctctctagacgaaaacctcttaactataatgaaagtgttcattctagttcaatcaggtattttacctctaatcttcctcagattttctattttttggtagtgtatagattatttatacagattatttaaaattgggacttatacagattatttaaaactgggatacatgcatctaaaacactgtaatatttataagaaaggaagataaacttacggggaaatacagtaacagtaactacatacgagtctgtacccattaaattgcatatctatctcctttaggaggctggtggtggcatgatgagtgtggagaaaacaacctaaatggtaaatataacaaaccaagagcaaaatctaagccagagaggagaagaggattatcttggaagtctcaaaatggaaggttatactctataaaatcaaccaaaatgttgatccatccaacagattcagaaagctttgaatgaactgaggcaaatttaaaaggcaataatttaaacattaacctcattccaagttaatgtggtctaataatctggtattaaatccttaagagaaagcttgagaaatagattttttttatcttaaagtcactgtctatttaagattaaacatacaatcacataaccttaaagaataccgtttacatttctcaatcaaaattcttataatactatttgttttaaattttgtgatgtgggaatcaattttagatggtcacaatctagattataatcaataggtgaacttattaaataacttttctaaataaaaaatttagagacttttattttaaaaggcatcatatgagctaatatcacaactttcccagtttaaaaaactagtactcttgttaaaactctaaacttgactaaatacagaggactggtaattgtacagttcttaaatgttgtagtattaatttcaaaactaaaaatcgtcagcacagagtatgtgtaaaaatctgtaatacaaatttttaaactgatgcttcattttgctacaaaataatttggagtaaatgtttgatatgatttatttatgaaacctaatgaagcagaattaaatactgtattaaaataagttcgctgtctttaaacaaatggagatgactactaagtcacattgactttaacatgaggtatcactataccttatttgttaaaatatatactgtatacattttatatattttaacacttaatactatgaaaacaaataattgtaaaggaatcttgtcagattacagtaagaatgaacatatttgtggcatcgagttaaagtttatatttcccctaaatatgctgtgattctaatacattcgtgtaggttttcaagtagaaataaacctcgtaacaagttactgaacgtttaaacagcctgacaagcatgtatatatgtttaaaattcaataaacaaagacccagtccctaaattatagaaatttaaattattcttgcatgtttatcgacatcacaacagatccctaaatccctaaatccctaaagattagatacaaattttttaccacagtatcacttgtcagaatttatttttaaatatgattttttaaaactgccagtaagaaattttaaattaaacccatttgttaaaggatatagtgcccaagttatatggtgacctacctttgtcaatacttagcattatgtatttcaaattatccaatatacatgtcatatatatttttatatgtcacatatataaaagatatgtatgatctatgtgaatcctaagtaaatattttgttccagaaaagtacaaaataataaaggtaaaaataatctataattttcaggaccacagactaagctgtcgaaattaacgctgatttttttagggccagaataccaaaatggctcctctcttcccccaaaattggacaatttcaaatgcaaaataattcattatttaatatatgagttgcttcctctatttggtttccttaaa

SEQ ID NO: 63051 - DNA, 2922 bp, Homo sapiens
atatatagagttaagaagtctaggtctgcttccagaagaaaacagttccacgttgcttgaaattgaaaatcaagataaaaatgttcacaattaagctccttctttttattgttcctctagttatttcctccagaattgatcaagacaattcatcatttgattctctatctccagagccaaaatcaagatttgctatgttagacgatgtaaaaattttagccaatggcctccttcagttgggacatggtcttaaagactttgtccataagacgaagggccaaattaatgacatatttcaaaaactcaacatatttgatcagtctttttatgatctatcgctgcaaaccagtgaaatcaaagaagaagaaaaggaactgagaagaactacatataaactacaagtcaaaaatgaagaggtaaagaatatgtcacttgaactcaactcaaaacttgaaagcctcctagaagaaaaaattctacttcaacaaaaagtgaaatatttagaagagcaactaactaacttaattcaaaatcaacctgaaactccagaacacccagaagtaacttcacttaaaacttttgtagaaaaacaagataatagcatcaaagaccttctccagaccgtggaagaccaatataaacaattaaaccaacagcatagtcaaataaaagaaatagaaaatcagctcagaaggactagtattcaagaacccacagaaatttctctatcttccaagccaagagcaccaagaactactccctttcttcagttgaatgaaataagaaatgtaaaacatgatgatacaagtggcatgtatgccatcagacccagcaactctcaagtttttcatgtctactgtgatgttatatcaggtagtccatggacattaattcaacatcgaatagatggatcacaaaacttcaatgaaacgtgggagaactacaaatatggttttgggaggcttgatggagaattttggttgggcctagagaagatatactccatagtgaagcaatctaattatgttttacgaattgagttggaagactggaaagacaacaaacattatattgaatattctttttacttgggaaatcacgaaaccaactatacgctacatctagttgcgattactggcaatgtccccaatgcaatcccggaaaacaaagatttggtgttttctacttgggatcacaaagcaaaaggacacttcaactgtccagagggttattcaggaggctggtggtggcatgatgagtgtggagaaaacaacctaaatggtaaatataacaaaccaagagcaaaatctaagccagagaggagaagaggattatcttggaagtctcaaaatggaaggttatactctataaaatcaaccaaaatgttgatccatccaacagattcagaaagctttgaatgaactgaggcaaatttaaaaggcaataatttaaacattaacctcattccaagttaatgtggtctaataatctggtattaaatccttaagagaaagcttgagaaatagattttttttatcttaaagtcactgtctatttaagattaaacatacaatcacataaccttaaagaataccgtttacatttctcaatcaaaattcttataatactatttgttttaaattttgtgatgtgggaatcaattttagatggtcacaatctagattataatcaataggtgaacttattaaataacttttctaaataaaaaatttagagacttttattttaaaaggcatcatatgagctaatatcacaactttcccagtttaaaaaactagtactcttgttaaaactctaaacttgactaaatacagaggactggtaattgtacagttcttaaatgttgtagtattaatttcaaaactaaaaatcgtcagcacagagtatgtgtaaaaatctgtaatacaaatttttaaactgatgcttcattttgctacaaaataatttggagtaaatgtttgatatgatttatttatgaaacctaatgaagcagaattaaatactgtattaaaataagttcgctgtctttaaacaaatggagatgactactaagtcacattgactttaacatgaggtatcactataccttatttgttaaaatatatactgtatacattttatatattttaacacttaatactatgaaaacaaataattgtaaaggaatcttgtcagattacagtaagaatgaacatatttgtggcatcgagttaaagtttatatttcccctaaatatgctgtgattctaatacattcgtgtaggttttcaagtagaaataaacctcgtaacaagttactgaacgtttaaacagcctgacaagcatgtatatatgtttaaaattcaataaacaaagacccagtccctaaattatagaaatttaaattattcttgcatgtttatcgacatcacaacagatccctaaatccctaaatccctaaagattagatacaaattttttaccacagtatcacttgtcagaatttatttttaaatatgattttttaaaactgccagtaagaaattttaaattaaacccatttgttaaaggatatagtgcccaagttatatggtgacctacctttgtcaatacttagcattatgtatttcaaattatccaatatacatgtcatatatatttttatatgtcacatatataaaagatatgtatgatctatgtgaatcctaagtaaatattttgttccagaaaagtacaaaataataaaggtaaaaataatctataattttcaggaccacagactaagctgtcgaaattaacgctgatttttttagggccagaataccaaaatggctcctctcttcccccaaaattggacaatttcaaatgcaaaataattcattatttaatatatgagttgcttcctctatttggtttccttaaa

SEQ ID NO: 63052 - DNA, 2465 bp, Homo sapiens
atatatagagttaagaagtctaggtctgcttccagaagaaaacagttccacgttgcttgaaattgaaaatcaagataaaaatgttcacaattaagctccttctttttattgttcctctagttatttcctccagaattgatcaagacaattcatcatttgattctctatctccagagccaaaatcaagatttgctatgttagacgatgtaaaaattttagccaatggcctccttcagttgggacatggtcttaaagactttgtccataagacgaagggccaaattaatgacatatttcaaaaactcaacatatttgatcagtctttttatgatctatcgctgcaaaccagtgaaatcaaagaagaagaaaaggaactgagaagaactacatataaactacaagtcaaaaatgaagaggtaaagaatatgtcacttgaactcaactcaaaacttgaaagcctcctagaagaaaaaattctacttcaacaaaaagtgaaatatttagaagagcaactaactaacttaattcaaaatcaacctgaaactccagaacacccagaagtaacttcacttaaagaattgagttggaagactggaaagacaacaaacattatattgaatattctttttacttgggaaatcacgaaaccaactatacgctacatctagttgcgattactggcaatgtccccaatgcaatcccggaaaacaaagatttggtgttttctacttgggatcacaaagcaaaaggacacttcaactgtccagagggttattcaggaggctggtggtggcatgatgagtgtggagaaaacaacctaaatggtaaatataacaaaccaagagcaaaatctaagccagagaggagaagaggattatcttggaagtctcaaaatggaaggttatactctataaaatcaaccaaaatgttgatccatccaacagattcagaaagctttgaatgaactgaggcaaatttaaaaggcaataatttaaacattaacctcattccaagttaatgtggtctaataatctggtattaaatccttaagagaaagcttgagaaatagattttttttatcttaaagtcactgtctatttaagattaaacatacaatcacataaccttaaagaataccgtttacatttctcaatcaaaattcttataatactatttgttttaaattttgtgatgtgggaatcaattttagatggtcacaatctagattataatcaataggtgaacttattaaataacttttctaaataaaaaatttagagacttttattttaaaaggcatcatatgagctaatatcacaactttcccagtttaaaaaactagtactcttgttaaaactctaaacttgactaaatacagaggactggtaattgtacagttcttaaatgttgtagtattaatttcaaaactaaaaatcgtcagcacagagtatgtgtaaaaatctgtaatacaaatttttaaactgatgcttcattttgctacaaaataatttggagtaaatgtttgatatgatttatttatgaaacctaatgaagcagaattaaatactgtattaaaataagttcgctgtctttaaacaaatggagatgactactaagtcacattgactttaacatgaggtatcactataccttatttgttaaaatatatactgtatacattttatatattttaacacttaatactatgaaaacaaataattgtaaaggaatcttgtcagattacagtaagaatgaacatatttgtggcatcgagttaaagtttatatttcccctaaatatgctgtgattctaatacattcgtgtaggttttcaagtagaaataaacctcgtaacaagttactgaacgtttaaacagcctgacaagcatgtatatatgtttaaaattcaataaacaaagacccagtccctaaattatagaaatttaaattattcttgcatgtttatcgacatcacaacagatccctaaatccctaaatccctaaagattagatacaaattttttaccacagtatcacttgtcagaatttatttttaaatatgattttttaaaactgccagtaagaaattttaaattaaacccatttgttaaaggatatagtgcccaagttatatggtgacctacctttgtcaatacttagcattatgtatttcaaattatccaatatacatgtcatatatatttttatatgtcacatatataaaagatatgtatgatctatgtgaatcctaagtaaatattttgttccagaaaagtacaaaataataaaggtaaaaataatctataattttcaggaccacagactaagctgtcgaaattaacgctgatttttttagggccagaataccaaaatggctcctctcttcccccaaaattggacaatttcaaatgcaaaataattcattatttaatatatgagttgcttcctctatttggtttccttaaa

SEQ ID NO: 63053 - DNA, 1366 bp, Homo sapiens
  misc_feature (20)..(20): n is a, c, g, or t
  misc_feature (50)..(50): n is a, c, g, or t
  misc_feature (66)..(66): n is a, c, g, or t
  misc_feature (83)..(83): n is a, c, g, or t
  misc_feature (90)..(90): n is a, c, g, or t
  misc_feature (92)..(92): n is a, c, g, or t
  misc_feature (104)..(104): n is a, c, g, or t
  misc_feature (120)..(120): n is a, c, g, or t
  misc_feature (136)..(136): n is a, c, g, or t
  misc_feature (155)..(155): n is a, c, g, or t
  misc_feature (164)..(164): n is a, c, g, or t
  misc_feature (188)..(189): n is a, c, g, or t
  misc_feature (239)..(239): n is a, c, g, or t
  misc_feature (246)..(246): n is a, c, g, or t
cgtaagtactagtcggccanataaaccaagtaatgtgtcatagggtgttnttagttatcacacatntcagtagtaagtaacanatttttntntatatcagacanaatatgaattcaaatngccattatatatctanctatgagtatctcctaganattttccanatgcatttcctttcgatttccatnntatagctggcattttttgccacagtactctgtcaggtcttaatatacgcnctatagnaagcatgacctatcatttcttcatgtttgctcgtgccgaattcggcacgaggttcttaaatgttgtagtattaatttcaaaactaaaaatcgtcagcacagagtatgtgtaaaaatctgtaatacaaatttttaaactgatgcttcattttgctacaaaataatttggagtaaatgtttgatatgatttatttatgaaacctaatgaagcagaattaaatactgtattaaaataagttcgctgtctttaaacaaatggagatgactactaagtcacattgactttaacatgaggtatcactataccttatttgttaaaatatatactgtatacattttatatattttaacacttaatactatgaaaacaaataattgtaaaggaatcttgtcagattacagtaagaatgaacatatttgtggcatcgagttaaagtttatatttcccctaaatatgctgtgattctaatacattcgtgtaggttttcaagtagaaataaacctcgtaacaagttactgaacgtttaaacagcctgacaagcatgtatatatgtttaaaattcaataaacaaagacccagtccctaaattatagaaatttaaattattcttgcatgtttatcgacatcacaacagatccctaaatccctaaatccctaaagattagatacaaattttttaccacagtatcacttgtcagaatttatttttaaatatgattttttaaaactgccagtaagaaattttaaattaaacccatttgttaaaggatatagtgcccaagttatatggtgacctacctttgtcaatacttagcattatgtatttcaaattatccaatatacatgtcatatatatttttatatgtcacatatataaaagatatgtatgatctatgtgaatcctaagtaaatattttgttccagaaaagtacaaaataataaaggtaaaaataatctataattttcaggaccacagactaagctgtcgaaattaacgctgatttttttagggccagaataccaaaatggctcctctcttcccccaaaattggacaatttcaaatgcaaaataattcattatttaatatatgagttgcttcctctatttggtttccttaaa

SEQ ID NO: 63054 - DNA, 1293 bp, Homo sapiens
  misc_feature (20)..(20): n is a, c, g, or t
  misc_feature (50)..(50): n is a, c, g, or t
  misc_feature (66)..(66): n is a, c, g, or t
  misc_feature (83)..(83): n is a, c, g, or t
  misc_feature (90)..(90): n is a, c, g, or t
  misc_feature (92)..(92): n is a, c, g, or t
  misc_feature (104)..(104): n is a, c, g, or t
  misc_feature (120)..(120): n is a, c, g, or t
  misc_feature (136)..(136): n is a, c, g, or t
  misc_feature (155)..(155): n is a, c, g, or t
  misc_feature (164)..(164): n is a, c, g, or t
  misc_feature (188)..(189): n is a, c, g, or t
  misc_feature (239)..(239): n is a, c, g, or t
  misc_feature (246)..(246): n is a, c, g, or t
cgtaagtactagtcggccanataaaccaagtaatgtgtcatagggtgttnttagttatcacacatntcagtagtaagtaacanatttttntntatatcagacanaatatgaattcaaatngccattatatatctanctatgagtatctcctaganattttccanatgcatttcctttcgatttccatnntatagctggcattttttgccacagtactctgtcaggtcttaatatacgcnctatagnaagcatgacctatcatttcttcatgtttgctcgtgccgaattcggcacgaggaaatttttaaactgatgcttcattttgctacaaaataatttggagtaaatgtttgatatgatttatttatgaaacctaatgaagcagaattaaatactgtattaaaataagttcgctgtctttaaacaaatggagatgactactaagtcacattgactttaacatgaggtatcactataccttatttgttaaaatatatactgtatacattttatatattttaacacttaatactatgaaaacaaataattgtaaaggaatcttgtcagattacagtaagaatgaacatatttgtggcatcgagttaaagtttatatttcccctaaatatgctgtgattctaatacattcgtgtaggttttcaagtagaaataaacctcgtaacaagttactgaacgtttaaacagcctgacaagcatgtatatatgtttaaaattcaataaacaaagacccagtccctaaattatagaaatttaaattattcttgcatgtttatcgacatcacaacagatccctaaatccctaaatccctaaagattagatacaaattttttaccacagtatcacttgtcagaatttatttttaaatatgattttttaaaactgccagtaagaaattttaaattaaacccatttgttaaaggatatagtgcccaagttatatggtgacctacctttgtcaatacttagcattatgtatttcaaattatccaatatacatgtcatatatatttttatatgtcacatatataaaagatatgtatgatctatgtgaatcctaagtaaatattttgttccagaaaagtacaaaataataaaggtaaaaataatctataattttcaggaccacagactaagctgtcgaaattaacgctgatttttttagggccagaataccaaaatggctcctctcttcccccaaaattggacaatttcaaatgcaaaataattcattatttaatatatgagttgcttcctctatttggtttccttaaa

SEQ ID NO: 63055 - DNA, 389 bp, Homo sapiens
gtaaaacctgtctaaggagaatagacagtagttagttcaacttactcattacgtattaggaagattaacctggttatcattgttttatacatatatatatgaaatatatatgagtattcgtataaatataatacttttaccttgtttatgtatttactcaatattctccttttcctctaaaataatctgaagtgactattatcaataagtttactatgccaaaattcattaattgcctttcacttaacttttgggaccataataaataataaaatgtattgccataacattaataaactaccttacaaaaccaccaattaaaatcaaacaaacaaaaaagtgttatttacatctgtcaacataaatctactaaaaatacatgatttcat

SEQ ID NO: 63056 - DNA, 764 bp, Homo sapiens
ccagaagaaaacagttccacgttgcttgaaattgaaaatcaagataaaaatgttcacaattaagctccttctttttattgttcctctagttatttcctccagaattgatcaagacaattcatcatttgattctctatctccagagccaaaatcaagatttgctatgttagacgatgtaaaaattttagccaatggcctccttcagttgggacatggtcttaaagactttgtccataagacgaagggccaaattaatgacatatttcaaaaactcaacatatttgatcagtctttttatgatctatcgctgcaaaccagtgaaatcaaagaagaagaaaaggaactgagaagaactacatataaactacaagtcaaaaatgaagaggtaaagaatatgtcacttgaactcaactcaaaacttgaaagcctcctagaagaaaaaattctacttcaacaaaaagtgaaatatttagaagagcaactaactaacttaattcaaaatcaacctgaaactccagaacacccagaagtaacttcacttaaagtaagtagaaaataaagagggttcatgtttatgttttcaatgtggatcttttaaaaaaaatatttctaaggcatgccatttgaaatactttgttgcattgttgaaatacttttttttccaagaaaaataatctccagaaaataaaatttcctattataatttcaagttagttttttgtttccctaatgttatatatgaaaacactgaaaatttgcatttt

SEQ ID NO: 63057 - DNA, 796 bp, Homo sapiens
atatatagagttaagaagtctaggtctgcttccagaagaaaacagttccacgttgcttgaaattgaaaatcaagataaaaatgttcacaattaagctccttctttttattgttcctctagttatttcctccagaattgatcaagacaattcatcatttgattctctatctccagagccaaaatcaagatttgctatgttagacgatgtaaaaattttagccaatggcctccttcagttgggacatggtcttaaagactttgtccataagacgaagggccaaattaatgacatatttcaaaaactcaacatatttgatcagtctttttatgatctatcgctgcaaaccagtgaaatcaaagaagaagaaaaggaactgagaagaactacatataaactacaagtcaaaaatgaagaggtaaagaatatgtcacttgaactcaactcaaaacttgaaagcctcctagaagaaaaaattctacttcaacaaaaagtgaaatatttagaagagcaactaactaacttaattcaaaatcaacctgaaactccagaacacccagaagtaacttcacttaaaacttttgtagaaaaacaagataatagcatcaaagaccttctccagaccgtggaagaccaatataaacaattaaaccaacagcatagtcaaataaaagaaatagaaaatcagctcagaaggactagtattcaagaacccacagaaatttctctatcttccggtaaacatgatggggcattctgctgatgtccacatttatacagaggtgacatacagttgcc

SEQ ID NO: 63058 - DNA, 2910 bp, Homo sapiens
atatatagagttaagaagtctaggtctgcttccagaagaaaacagttccacgttgcttgaaattgaaaatcaagataaaaatgttcacaattaagctccttctttttattgttcctctagttatttcctccagaattgatcaagacaattcatcatttgattctctatctccagagccaaaatcaagatttgctatgttagacgatgtaaaaattttagccaatggcctccttcagttgggacatggtcttaaagactttgtccataagacgaagggccaaattaatgacatatttcaaaaactcaacatatttgatcagtctttttatgatctatcgctgcaaaccagtgaaatcaaagaagaagaaaaggaactgagaagaactacatataaactacaagtcaaaaatgaagaggtaaagaatatgtcacttgaactcaactcaaaacttgaaagcctcctagaagaaaaaattctacttcaacaaaaagtgaaatatttagaagagcaactaactaacttaattcaaaatcaacctgaaactccagaacacccagaagtaacttcacttaaaacttttgtagaaaaacaagataatagcatcaaagaccttctccagaccgtggaagaccaatataaacaattaaaccaacagcatagtcaaataaaagaaatagaaaatcagctcagaaggactagtattcaagaacccacagaaatttctctatcttccaagccaagagcaccaagaactactccctttcttcagttgaatgaaataagaaatgtaaaacatgatggcattcctgctgaatgtaccaccatttataacagaggtgaacatacaagtggcatgtatgccatcagacccagcaactctcaagtttttcatgtctactgtgatgttatatcaggtagtccatggacattaattcaacatcgaatagatggatcacaaaacttcaatgaaacgtgggagaactacaaatatggttttgggaggcttgatggagaattttggttgggcctagagaagatatactccatagtgaagcaatctaattatgttttacgaattgagttggaagactggaaagacaacaaacattatattgaatattctttttacttgggaaatcacgaaaccaactatacgctacatctagttgcgattactggcaatgtccccaatgcaatcccggaaaacaaagatttggtgttttctacttgggatcacaaagcaaaaggacacttcaactgtccagagggttattcaggaggctggtggtggcatgatgagtgtggagaaaacaacctaaatggtaaatataacaaaccaagagcaaaatctaagccagagaggagaagaggattatcttggaagtctcaaaatggaaggttatactctataaaatcaaccaaaatgttgatccatccaacagattcagaaagctttgaatgaactgaggcaaatttaaaaggcaataatttaaacattaacctcattccaagttaatgtggtctaataatctggtattaaatccttaagagaaagcttgagaaatagattttttttatcttaaagtcactgtctatttaagattaaacatacaatcacataaccttaaagaataccgtttacatttctcaatcaaaattcttataatactatttgttttaaattttgtgatgtgggaatcaattttagatggtcacaatctagattataatcaataggtgaacttattaaataacttttctaaataaaaaatttagagacttttattttaaaaggcatcatatgagctaatatcacaactttcccagtttaaaaaactagtactcttgttaaaactctaaacttgactaaatacagaggactggtaattgtacagttcttaaatgttgtagtattaatttcaaaactaaaaatcgtcagcacagagtatgtgtaaaaatctgtaatacaaatttttaaactgatgcttcattttgctacaaaataatttggagtaaatgtttgatatgatttatttatgaaacctaatgaagcagaattaaatactgtattaaaataagttcgctgtctttaaacaaatggagatgactactaagtcacattgactttaacatgaggtatcactataccttatttgttaaaatatatactgtatacattttatatattttaacacttaatactatgaaaacaaataattgtaaaggaatcttgtcagattacagtaagaatgaacatatttgtggcatcgagttaaagtttatatttcccctaaatatgctgtgattctaatacattcgtgtaggttttcaagtagaaataaacctcgtaacaagttactgaacgtttaaacagcctgacaagcatgtatatatgttttgcatgtttatcgacatcacaacagatccctaaatccctaaatccctaaagattagatacaaattttttaccacagtatcacttgtcagaatttatttttaaatatgattttttaaaactgccagtaagaaattttaaattaaacccatttgttaaaggatatagtgcccaagttatatggtgacctacctttgtcaatacttagcattatgtatttcaaattatccaatatacatgtcatatatatttttatatgtcacatatataaaagatatgtatgatctatgtgaatcctaagtaaatattttgttccagaaaagtacaaaataataaaggtaaaaataatctataattttcaggaccacagactaagctgtcgaaattaacgctgatttttttagggccagaataccaaaatggctcctctcttcccccaaaattggacaatttcaaatgcaaaataattcattatttaatatatgagttgcttcctctatttggtttccttaaa

SEQ ID NO: 63059 - DNA, 2910 bp, Homo sapiens
atatatagagttaagaagtctaggtctgcttccagaagaaaacagttccacgttgcttgaaattgaaaatcaagataaaaatgttcacaattaagctccttctttttattgttcctctagttatttcctccagaattgatcaagacaattcatcatttgattctctatctccagagccaaaatcaagatttgctatgttagacgatgtaaaaattttagccaatggcctccttcagttgggacatggtcttaaagactttgtccataagacgaagggccaaattaatgacatatttcaaaaactcaacatatttgatcagtctttttatgatctatcgctgcaaaccagtgaaatcaaagaagaagaaaaggaactgagaagaactacatataaactacaagtcaaaaatgaagaggtaaagaatatgtcacttgaactcaactcaaaacttgaaagcctcctagaagaaaaaattctacttcaacaaaaagtgaaatatttagaagagcaactaactaacttaattcaaaatcaacctgaaactccagaacacccagaagtaacttcacttaaaacttttgtagaaaaacaagataatagcatcaaagaccttctccagaccgtggaagaccaatataaacaattaaaccaacagcatagtcaaataaaagaaatagaaaatcagctcagaaggactagtattcaagaacccacagaaatttctctatcttccaagccaagagcaccaagaactactccctttcttcagttgaatgaaataagaaatgtaaaacatgatggcattcctgctgaatgtaccaccatttataacagaggtgaacatacaagtggcatgtatgccatcagacccagcaactctcaagtttttcatgtctactgtgatgttatatcaggtagtccatggacattaattcaacatcgaatagatggatcacgagaattttggttgggcctagagaagatatactccatagtgaagcaatctaattatgttttacgaattgagttggaagactggaaagacaacaaacattatattgaatattctttttacttgggaaatcacgaaaccaactatacgctacatctagttgcgattactggcaatgtccccaatgcaatcccggaaaacaaagatttggtgttttctacttgggatcacaaagcaaaaggacacttcaactgtccagagggttattcaggaggctggtggtggcatgatgagtgtggagaaaacaacctaaatggtaaatataacaaaccaagagcaaaatctaagccagagaggagaagaggattatcttggaagtctcaaaatggaaggttatactctataaaatcaaccaaaatgttgatccatccaacagattcagaaagctttgaatgaactgaggcaaatttaaaaggcaataatttaaacattaacctcattccaagttaatgtggtctaataatctggtattaaatccttaagagaaagcttgagaaatagattttttttatcttaaagtcactgtctatttaagattaaacatacaatcacataaccttaaagaataccgtttacatttctcaatcaaaattcttataatactatttgttttaaattttgtgatgtgggaatcaattttagatggtcacaatctagattataatcaataggtgaacttattaaataacttttctaaataaaaaatttagagacttttattttaaaaggcatcatatgagctaatatcacaactttcccagtttaaaaaactagtactcttgttaaaactctaaacttgactaaatacagaggactggtaattgtacagttcttaaatgttgtagtattaatttcaaaactaaaaatcgtcagcacagagtatgtgtaaaaatctgtaatacaaatttttaaactgatgcttcattttgctacaaaataatttggagtaaatgtttgatatgatttatttatgaaacctaatgaagcagaattaaatactgtattaaaataagttcgctgtctttaaacaaatggagatgactactaagtcacattgactttaacatgaggtatcactataccttatttgttaaaatatatactgtatacattttatatattttaacacttaatactatgaaaacaaataattgtaaaggaatcttgtcagattacagtaagaatgaacatatttgtggcatcgagttaaagtttatatttcccctaaatatgctgtgattctaatacattcgtgtaggttttcaagtagaaataaacctcgtaacaagttactgaacgtttaaacagcctgacaagcatgtatatatgtttaaaattcaataaacaaagacccagtccctaaattatagaaatttaaattattcttgcatgtttatcgacatcacaacagatccctaaatccctaaatccctaaagattagatacaaattttttaccacagtatcacttgtcagaatttatttttaaatatgattttttaaaactgccagtaagaaattttaaattaaacccatttgttaaaggatatagtgcccaagttatatggtgacctacctttgtcaatacttagcattatgtatttcaaattatccaatatacatgtcatatatatttttatatgtcacatatataaaagatatgtatgatctatgtgaatcctaagtaaatattttgttccagaaaagtacaaaataataaaggtaaaaataatctataattttcaggaccacagactaagctgtcgaaattaacgctgatttttttagggccagaataccaaaatggctcctctcttcccccaaaattggacaatttcaaatgcaaaataattcattatttaatatatgagttgcttcctctatttggtttccttaaa

SEQ ID NO: 63060 - DNA, 2909 bp, Homo sapiens
atatatagagttaagaagtctaggtctgcttccagaagaaaacagttccacgttgcttgaaattgaaaatcaagataaaaatgttcacaattaagctccttctttttattgttcctctagttatttcctccagaattgatcaagacaattcatcatttgattctctatctccagagccaaaatcaagatttgctatgttagacgatgtaaaaattttagccaatggcctccttcagttgggacatggtcttaaagactttgtccataagacgaagggccaaattaatgacatatttcaaaaactcaacatatttgatcagtctttttatgatctatcgctgcaaaccagtgaaatcaaagaagaagaaaaggaactgagaagaactacatataaactacaagtcaaaaatgaagaggtaaagaatatgtcacttgaactcaactcaaaacttgaaagcctcctagaagaaaaaattctacttcaacaaaaagtgaaatatttagaagagcaactaactaacttaattcaaaatcaacctgaaactccagaacacccagaagtaacttcacttaaaaccaatataaacaattaaaccaacagcatagtcaaataaaagaaatagaaaatcagctcagaaggactagtattcaagaacccacagaaatttctctatcttccaagccaagagcaccaagaactactccctttcttcagttgaatgaaataagaaatgtaaaacatgatggcattcctgctgaatgtaccaccatttataacagaggtgaacatacaagtggcatgtatgccatcagacccagcaactctcaagtttttcatgtctactgtgatgttatatcaggtagtccatggacattaattcaacatcgaatagatggatcacaaaacttcaatgaaacgtgggagaactacaaatatggttttgggaggcttgatggagaattttggttgggcctagagaagatatactccatagtgaagcaatctaattatgttttacgaattgagttggaagactggaaagacaacaaacattatattgaatattctttttacttgggaaatcacgaaaccaactatacgctacatctagttgcgattactggcaatgtccccaatgcaatcccggaaaacaaagatttggtgttttctacttgggatcacaaagcaaaaggacacttcaactgtccagagggttattcaggaggctggtggtggcatgatgagtgtggagaaaacaacctaaatggtaaatataacaaaccaagagcaaaatctaagccagagaggagaagaggattatcttggaagtctcaaaatggaaggttatactctataaaatcaaccaaaatgttgatccatccaacagattcagaaagctttgaatgaactgaggcaaatttaaaaggcaataatttaaacattaacctcattccaagttaatgtggtctaataatctggtattaaatccttaagagaaagcttgagaaatagattttttttatcttaaagtcactgtctatttaagattaaacatacaatcacataaccttaaagaataccgtttacatttctcaatcaaaattcttataatactatttgttttaaattttgtgatgtgggaatcaattttagatggtcacaatctagattataatcaataggtgaacttattaaataacttttctaaataaaaaatttagagacttttattttaaaaggcatcatatgagctaatatcacaactttcccagtttaaaaaactagtactcttgttaaaactctaaacttgactaaatacagaggactggtaattgtacagttcttaaatgttgtagtattaatttcaaaactaaaaatcgtcagcacagagtatgtgtaaaaatctgtaatacaaatttttaaactgatgcttcattttgctacaaaataatttggagtaaatgtttgatatgatttatttatgaaacctaatgaagcagaattaaatactgtattaaaataagttcgctgtctttaaacaaatggagatgactactaagtcacattgactttaacatgaggtatcactataccttatttgttaaaatatatactgtatacattttatatattttaacacttaatactatgaaaacaaataattgtaaaggaatcttgtcagattacagtaagaatgaacatatttgtggcatcgagttaaagtttatatttcccctaaatatgctgtgattctaatacattcgtgtaggttttcaagtagaaataaacctcgtaacaagttactgaacgtttaaacagcctgacaagcatgtatatatgtttaaaattcaataaacaaagacccagtccctaaattatagaaatttaaattattcttgcatgtttatcgacatcacaacagatccctaaatccctaaatccctaaagattagatacaaattttttaccacagtatcacttgtcagaatttatttttaaatatgattttttaaaactgccagtaagaaattttaaattaaacccatttgttaaaggatatagtgcccaagttatatggtgacctacctttgtcaatacttagcattatgtatttcaaattatccaatatacatgtcatatatatttttatatgtcacatatataaaagatatgtatgatctatgtgaatcctaagtaaatattttgttccagaaaagtacaaaataataaaggtaaaaataatctataattttcaggaccacagactaagctgtcgaaattaacgctgatttttttagggccagaataccaaaatggctcctctcttcccccaaaattggacaatttcaaatgcaaaataattcattatttaatatatgagttgcttcctctatttggtttccttaaa

SEQ ID NO: 63061 - DNA, 239 bp, Homo sapiens
atcagtttatatccactaatttttaaaatattttaaccattgttaaatgtacaattcagtagcattaagtaaattcacaatgttgtacaaccatcactactatttatttccaaaactttttcatcacccagatactcttccttaatttttcaggcatattttatatatttgaaacttttttcaaaatttgagtcagtgttgtattgtataaagctttatcctttctgttcaaaatcatg

SEQ ID NO: 63062 - DNA, 580 bp, Homo sapiens
gggagatgcaggcggggagacacaaggtagaaggggcaaagtcctcacctaggaccttgagggagttaatgtgtaatattctaggatataagcttgaccacgagttgagaccctgagcacaggcctccaggagccgctgggagctgccgccaggagctgtcaccatgacgggggaacttgaggttaagaacatggacatgaagccggggtcaaccctgaagatcacaggcagcatcgccgatggcactgatggctttgtaattaatctgggccaggggacagacaagctgaacctgcatttcaaccctcgcttcagcgaatccaccattgtctgcaactcattggacggcagcaactgggggcaagaacaacgggaagatcacctgtgcttcagcccagggtcagaggtcaagttcacagtgacctttgagagtgacaaattcaaggtgaagctgccagatgggcacgagctgacttttcccaacaggctgggtcacagccacctgagctacctgagcgtaaggggcgggttcaacatgtcctctttcaagttaaaagaataaaagacttccagccgaga

SEQ ID NO: 63063 - DNA, 632 bp, Homo sapiens
gggagatgcaggcggggagacacaaggtagaaggggcaaagtcctcacctaggaccttgagggagttaatgtgtaatattctaggatataagcttgaccacgagttgagaccctgagcacaggcctccaggagccgctgggagctgccgccaggagctgtcaccatgacgggggaacttgaggttaagaacatggacatgaagccggggtcaaccctgaagatcacaggcagcatcgccgatggcactgatggctttgtaattaatctgggccaggggacagacaagctgaacctgcatttcaaccctcgcttcagcgaatccaccattgtctgcaactcattggacggcagcaactgggggcaagaacaacgggaagatcacctgtgcttcagcccagggtcagaggtcaagttcacagtgacctttgagagtgacaaattcaaggtgaagctgccagatgggcacgagctgacttttcccaacaggctgggtcacagccacctgagctacctgagcgtaaggggcgggttcaacatgtcctctttcaagttaaaagaataaaagacttccagccgagagagcgatgcggcagatcctttattaacttaacccaacacaccagacgcagta

SEQ ID NO: 63064 - DNA, 548 bp, Homo sapiens
cctgagctacctgagcgtaaggggcgggttcaacatgtcctctttcaagttaaaagaataaaagacttccagccgagaagccgagattctctgtcctggttcttcttccgagtcacaccaggatcaacagagcttgggtgtgttcccctatccctacctgcagttcctgccccagggctaaaagcaaacaaaataatctgtttttatcgagtcttcctgtggcaagaactgtggcttgtgactcctttctctcttgggtccctcaagtttacaaaaacatgggatacccctggtctgaggacctctgaatgaaggcaccccatgatccagaatgtcctgctctcagggatcctgaggtcccgtagtgatcctgcctcctgccacacatcctctggttgcatacctgtagtgacagggagtgcaccacctcacgttagctgtttgtggctaaatttaaccggtcttccgatacctaaggagggcatttctctttccgtgcattttaatgctcctggcattttcataatactgaggaggaaacagatatg

SEQ ID NO: 63065 - DNA, 1127 bp, Homo sapiens
gggagatgcaggcggggagacacaaggtagaaggggcaaagtcctcacctaggaccttgagggagttaatgtgtaatattctaggatataagcttgaccacgagttgagaccctgagcacaggcctccaggagccgctgggagctgccgccaggagctgtcaccatgacgggggaacttgaggttaagaacatggacatgaagccggggtcaaccctgaagatcacaggcagcatcgccgatggcactgatggctttgtaattaatctgggccaggggacagacaagctgaacctgcatttcaaccctcgcttcagcgaatccaccattgtctgcaactcattggacggcagcaactgggggcaagaacaacgggaagatcacctgtgcttcagcccagggtcagaggtcaagttcacagtgacctttgagagtgacaaattcaaggtgaagctgccagatgggcacgagctgacttttcccaacaggctgggtcacagccacctgagctacctgagcgtaaggggcgggttcaacatgtcctctttcaagttaaaagaataaaagacttccagccgagaaaaaaacaaacacaaaaaaaaaaaaaacaaagaagagggagggacgcgctctcatagaatatttccctcccgagagggggccccaggttatagacgccgttcccgcagttttctctggataccagagggggcccccctatatagggacagctgcgtatatataagagcctgaggacgctgtggcccgggcagttttacaacaccgttctgtgagccgtgtgcgacacacctgccgtatcacctggggaacacctttgtggcagaaggagcacccttatatcttcgggggggggggcacccacataactgggcgggcccacaatacttactccactacgagggaagtatttttaaacgggccctcatagggggcaaagttctctacaagacagctttctacaaggggctgctactaacggtgtgtggttaacccacttcgccggcctaattttgttgctgtatcacggccttagaaaaagtgtggtgcgcgaccaacacggggagagaatagtagtattttggcgcaacactttttttatccctgcgg

SEQ ID NO: 63066 - DNA, 440 bp, Homo sapiens
tcccatgtatttgagaagttgaagtcagtaagtgaatcaaaagatattaagcatttattaattatttttctgtgccacaaagggacagaatttttagaattgctggagaaaggcagaagacaagactgtaaaggtaaatatgaaccaaattgtgaaaggactgtaggatttcatggtaggaatagattaccaacagcagagtgggagaagtaggtaagtatgggcatgatgaaggcgaccctaggcaggctaggataaaactctatgtaatcattattttatgtaactacctgaaaaaaaaaataaggctttagtttggatgcagggtggtggtatgctcttattttcaaattaaaagtaagatacagacttttactaagcagaaagatgattataatttggaagaacctgataactttcactatccgtggcagcctggt

SEQ ID NO: 63067 - DNA, 229 bp, Homo sapiens
caaagaggagacaccatatatatttttggaatgaatgaaacagaagcttagagtcagagattgtgggtttggatgccaactctgtatcccactgacaatttttccgagcctcagtttgctcatctcatcagtaaaatggggaatgtacacttccctcacagggtggctgtgagattaaagtaagaagacacctttggaaatgctagtttgctgcagatttggctagtac

SEQ ID NO: 63068 - DNA, 421 bp, Homo sapiens
tcctgtaaattcccactgtagatcctcagcactggcagtttcctctacctgaagcattctttccctgatcgtgccctgtttggcttcttcttgactttcaggtcatagcttctcagtcttctgagagatcttttctgaccattacccccaaaccgaagaaaccacagttactatttcatcctgctttaattctcttcatagcattacaccacttttttaatctgtttaatatttgtcatatccttcattacaatgttaagctctctaagagtagggactaatttgatcttgttcaccatatgtaagcacccaatatatattcatgaataggtagataatgaatgaatgaatgaatgagcaaatgaacataggtagtaccttaaagactgctgaaattttaggagccagtgctgggactatc

SEQ ID NO: 63069 - DNA, 188 bp, Homo sapiens
gaccctatgtcagatactaggtaagcatctgtgatacaaagatgactatgcggagtttcttgtgtctttatgtaaaatgtcttcactacattttgatttggaagaacagctttctcatcataagtcaagcctactcatcagcattggatttctcttttatcataataaaggtattttgaagattcatc

SEQ ID NO: 63070 - DNA, 390 bp, Homo sapiens
ttcatacataaacaggggttagtaattaaaatactaggcattttgttaagcagaatttgggggaaaaaagaagaagaaaagaaaagattacaaccagcaaccagagtcagattatcagatttccttactcctttctagttctactccaagattagacattgggacctaccaaaggagaaagggctgcagaaatgtgtgtagtcagacaggatagctagagaaccaaaggcccttctctccttttcccacccatacccccaagtgacagaacctgcttccagaaacttgcaatctgggggagcagaaaatgcaagcttgctataggcaggcagatcccagagaaaaagccaaggaggagaactgagttatacttgctcactgcttatttcc

SEQ ID NO: 63071 - DNA, 333 bp, Homo sapiens
actggtattcttacttacaattgttctctcatcttcaaaacaacctagctggtttggagaacagtctttccatcgttaaaatgtggccatgtacatttcaattcaaaattattcagtggctctccatattctgacacattatattaaaatgcaaccttggactcaggcctcatataacaatcgcttgaaccatgcagacatattcactgatccaaccaaacttgtgaccttcccccttgaccccttgtatttatgctgatgtgaaatgccattgttgttatgtatcctgtaaggatcatctcaaatataaaaatgtccttaagtatttcctgc

SEQ ID NO: 63072 - DNA, 256 bp, Homo sapiens
cacaaattcaggaaaattaccagaagccgctggaagaattggaggtattgaaagaagcagcaagccacgtcctttcaaagcacaacaatgaactaaaggcggctgaggcgctcgtgagggaagctgaggcaaagatgcaggaaagcaaccacctgctgctcatggtcaatgctaatctgagagaattcagtgataaaaagctacatgttcaagaagaacaaaatctgacctcagagctcattgtccaaggaagagg

SEQ ID NO: 63073 - DNA, 289 bp, Homo sapiens
ctttatgaagtagtaattcctgagaggtgtgctggctgaaaacataataggttctggaagagccaggtaaatgcctggatttagacatgcaggggttaatcaaaataatttaggagcgttttcagctggtcagcctcatatgggatcttcgaacccgtggcgagaagaaaaccggtgtttaggaagcaccaggcacagtgctcggaagggagaggctggccggccagtgtgcagctcagctgcttcgaggacggaacctgcagcctggctgtgtcccagcagacccagg

SEQ ID NO: 63074 - DNA, 223 bp, Homo sapiens
atttcacaggcgaacaatttctaaagattaacaaagtctaggaatgtctgaggcagtgaaatgtcttaggcaaagataaaatttaccaggattagaacagccaaggaattaggaaatcgtgttgaacagattgcccagaaaattggcaggacttaaagatggagtcaaggaaaaatgtcatccagaaactaaatcaatgcaaggaacatagggaagctgatag

SEQ ID NO: 63075 - DNA, 461 bp, Homo sapiens
gcctctaatcccagctacttgggaggctgaggtaggagaatcacttgaacccaggaggcagaggttgcagtgagccaagattatgccgctgcactccagcctgggcaacagagcgagactctgtctcaaaaaaataatatggtaataataataaaagcagtgcccagagaacaaggattgttggctgttccaccccagggggccccttgcacaggaggtgccatctctgcctcccaaagctctaagagccactgtcccccatcccaagagacagggtcttgctttgtcacccaggctggaatgcagtggtgcaatcacggttcactgtagcctcgacctcccaggctcaggtgatcttcccgcctcagcctcccaagtagctgggactataggcaggcaccaccatgtccagctaatttttttttttaattttttgtagagatagggttttgccatgttgc

SEQ ID NO: 63076 - DNA, 176 bp, Homo sapiens
gatcatttaccctctccaagcttttggtgttttattatcattactcccattttacagatgtggaaacagaggctccagcaggtaattgtcagagctggaatgcaaactcaggtctctctcaccctttctagtacactgatagaaggcagtggctcggcagtgggcaggaagtaaaa

SEQ ID NO: 63077 - DNA, 594 bp, Homo sapiens
cattgaaaacatgactttcataaagcttgaaacagaagaatctcatttgcatgtcttccttctctactaaatataagcagattcctcctcctggtcaagtgatgtgggttagagacttctcaatctttccagtcctaaatgtatatctcatcattccagcgatgattccctccaacatggtatagggtttaaatcatgaaaaataattcctttcaatttagactctcatattttcattgaactatatttttccacgttccctaccctttgagtcttacagaagaaacctattaaaatatcacatcactatataagaggacagatattttaatttgcttggctatagtaatcactttactatgtatatttatatcaaagcaccatgttgtacacctaaaatatgtaaaatttgaaaaaaagttgaaaaatatcaaaataattatatcagtcaggcaatatttttagtgaaaagacattggctttttatttggcacaaagtgaacctcaactcaagcagttatttcatgcttattttctaagcagataagcttcaaacatattaaagtatctagttacgtagattctttactctta

SEQ ID NO: 63078 - DNA, 667 bp, Homo sapiens
gtataaatttgtattatttttgatattacaactttgtattaaaaaggaaaatatatttaggtgtttgtcatagattttttttcatatgcaactcaaaacacattcttatgtcaaaatacaatagcaaaatacaagtcaatatttactcataattaaatgcaaactttatgaaactggtggaaagtgtggaaaaatttaagtaaatttttacctctactaaaaattatttagacaacttaaaggaatactggattcaaacttcagttactattcactgtaaatattatgatcaactgaactgacttaccattcatgggataaaacatgatacaattctcagtatttgcttttctgttaagagcttggaatatgactgatgcttcagtgtcatttttttattattgaatataaaattaggtgcaatagatacatttattgtagccttaagaaggaaatcaatgctaagctgttgggcataaaactttacagtaacattagataacaagataataaaacactttaattttaatcgaccttttaagaatgatctttattattctatccaaatcaaggtagacttcaaaatttatagtttgaacaggaagaaagtagtgaatacaaaattcttaaaattggttcatatgatcatttttttattaatagcatg

SEQ ID NO: 63079 - DNA, 251 bp, Homo sapiens
aatccccggagataactaaattcagttttgttctgaaatttttattttctgggtagaaacatattttcatgaagttataattatattcattttctttctcagcccaatagtattaagaatgatgaatgatcaactcatgtttctggaaagagcatttattgatccattagggttaccagacaggcctttttataggtaagaaaagaaaatatgactcctttctgtaatatcactttttcttctaattattt

SEQ ID NO: 63080 - DNA, 1641 bp, Homo sapiens
taggttaaaaatgcccagctggcaggggccaaaggagtcattctctactccgaccctgctgactactttgctcctggggtgaagtcctatccagacggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacgagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaagcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattttttagagaatccgtattgaatttgtgtggtatgtcactcagaaagaatcgtaatgggtatattgataaattttaaaattggtatatttgaaataaagttgaatattata

SEQ ID NO: 63081 - DNA, 1734 bp, Homo sapiens
taggttaaaaatgcccagctggcaggggccaaaggagtcattctctactccgaccctgctgactactttgctcctggggtgaagtcctatccagacggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacgagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattttttagagaatccgtattgaatttgtgtggtatgtcactcagaaagaatcgtaatgggtatattgataaattttaaaattggtatatttgaaataaagttgaatattata

SEQ ID NO: 63082 - DNA, 1876 bp, Homo sapiens
cagggtcggcggctcagcgccgtagagacaaagccgcccgcccgccagcccgctagctcctcgcgcgagctcctcctccacgggaacctccctcccctcccaggcgccgccgcagccggagcggctcccgggccctgggccgccgccggccaggaagaaatacttgtgttggctgcatttccagggatgctaccagagctcaaggctgtcacctggtcttgcccagaagagccgttcttagaggcaggacttgatgaaggctttcctgctgatggaataggtttgctagagctggccttggaattagaacccttcatgtggcctttataaatatgcgtttgagacagagttatatgcagaagttgaaaatgcctggaagatttctggtttctttcactacttatcctgcctttttgcatcgctgccagatttggatgatatgatattcagaggggcaccttaatcaaagccattcttcaacaagacccacctggcataagattgcacacataattcaagatggccagtcaacctcctgaagacactgcggagtctcaggcctctgatgagctggagtgcaaaatctgttacaatcgatacaatctgaaacagaggaaacccaaagtgctggagtgttgtcatagggtttgtgccaaatgcctctacaagatcatagactttggggactccccacaaggtgtcattgtctgtcctttctgcaggtttgagacgtgcctgccagatgatgaagttagtagcctgcccgatgacaacaacatccttgtaaacttgacttgtggaggcaaagggaagaagtgcctgccagagaaccctactgagctgctgctcacccccaagaggctggcctctctggtcagtccttctcacacgtcctccaactgcctggtcataaccatcatggaggtgcagagagagagctccccgtccctgagctccactcctgtggtagaattttataggcctgcgaagtttcgactctgtcaccactgtgtcacacaactggactgtgtggaactgcacgtccctgctgtttcagacatccatccgggtgttagtgtggttgctaggtttgctctacttcagctccttacccttaggaatctacttactggtgtctaagaaagtcacccttggggtcgtctttgtcagcctggtcccttcgagcctcgttattcttatggtgtatggtttttgccagtgtgtttgtcatgaatttctagactgtatggcacctccttcttaactgatatgcaaaataagaaattggacacacattgccctgtttgagtgtgaagttagataatttataatttattttcttttatgttctttatgattagtatccatgacattaacaaaacccttggccacatgttgacttgattggttttcctgtaggctggaagtaaaaatgttcatttctacttaggggttagcaaaattgtataagctcacacttcatggagcactgacagcagtgagtcttcccagagaaaggacagggtttctctcagcactgccagacagacggcaggggtgtggtgtgttatactatagggagagcatggatccctcctttcgtattcatggatgttctatgatggcagttggacacaagaggaaagttgctctgagacacaaagtgtgtactcctttcccaccccatacccctggtattggaacaccctagaattgtcttcaggtgttttctctcttaagtcactctctgtggtcggcgatcccattgagatacttgtttcctctgcccattctcccttgccaagaggaaactcggttccattcccttgggtagtttcaactgaataccagttttgccacattactaaggagaatg

SEQ ID NO: 63083 - DNA, 1721 bp, Homo sapiens
cagggtcggcggctcagcgccgtagagacaaagccgcccgcccgccagcccgctagctcctcgcgcgagctcctcctccacgggaacctccctcccctcccaggcgccgccgcagccggagcggctcccgggccctgggccgccgccggccagacccttcatgtggcctttataaatatgcgtttgagacagagttatatgcagaagttgaaaatgcctggaagatttctggtttctttcactacttatcctgcctttttgcatcgctgccagatttggatgatatgatattcagaggggcaccttaatcaaagccattcttcaacaagacccacctggcataagattgcacacataattcaagatggccagtcaacctcctgaagacactgcggagtctcaggcctctgatgagctggagtgcaaaatctgttacaatcgatacaatctgaaacagaggaaacccaaagtgctggagtgttgtcatagggtttgtgccaaatgcctctacaagatcatagactttggggactccccacaaggtgtcattgtctgtcctttctgcaggtttgagacgtgcctgccagatgatgaagttagtagcctgcccgatgacaacaacatccttgtaaacttgacttgtggaggcaaagggaagaagtgcctgccagagaaccctactgagctgctgctcacccccaagaggctggcctctctggtcagtccttctcacacgtcctccaactgcctggtcataaccatcatggaggtgcagagagagagctccccgtccctgagctccactcctgtggtagaattttataggcctgcgaagtttcgactctgtcaccactgtgtcacacaactggactgtgtggaactgcacgtccctgctgtttcagacatccatccgggtgttagtgtggttgctaggtttgctctacttcagctccttacccttaggaatctacttactggtgtctaagaaagtcacccttggggtcgtctttgtcagcctggtcccttcgagcctcgttattcttatggtgtatggtttttgccagtgtgtttgtcatgaatttctagactgtatggcacctccttcttaactgatatgcaaaataagaaattggacacacattgccctgtttgagtgtgaagttagataatttataatttattttcttttatgttctttatgattagtatccatgacattaacaaaacccttggccacatgttgacttgattggttttcctgtaggctggaagtaaaaatgttcatttctacttaggggttagcaaaattgtataagctcacacttcatggagcactgacagcagtgagtcttcccagagaaaggacagggtttctctcagcactgccagacagacggcaggggtgtggtgtgttatactatagggagagcatggatccctcctttcgtattcatggatgttctatgatggcagttggacacaagaggaaagttgctctgagacacaaagtgtgtactcctttcccaccccatacccctggtattggaacaccctagaattgtcttcaggtgttttctctcttaagtcactctctgtggtcggcgatcccattgagatacttgtttcctctgcccattctcccttgccaagaggaaactcggttccattcccttgggtagtttcaactgaataccagttttgccacattactaaggagaatg

SEQ ID NO: 63084 - DNA, 1736 bp, Homo sapiens
ctccgggcaccacgggggccgccgtcctggcaccaacttgaggggctgtgcggcggagggcggctgcggagcgcccgcgcgggctgcacctgctcagggagctgcccctctgttgttgttgttattttccttcttggcgtgccatcgaggcttttgggggaaaaaaagacccttcatgtggcctttataaatatgcgtttgagacagagttatatgcagaagttgaaaatgcctggaagatttctggtttctttcactacttatcctgcctttttgcatcgctgccagatttggatgatatgatattcagaggggcaccttaatcaaagccattcttcaacaagacccacctggcataagattgcacacataattcaagatggccagtcaacctcctgaagacactgcggagtctcaggcctctgatgagctggagtgcaaaatctgttacaatcgatacaatctgaaacagaggaaacccaaagtgctggagtgttgtcatagggtttgtgccaaatgcctctacaagatcatagactttggggactccccacaaggtgtcattgtctgtcctttctgcaggtttgagacgtgcctgccagatgatgaagttagtagcctgcccgatgacaacaacatccttgtaaacttgacttgtggaggcaaagggaagaagtgcctgccagagaaccctactgagctgctgctcacccccaagaggctggcctctctggtcagtccttctcacacgtcctccaactgcctggtcataaccatcatggaggtgcagagagagagctccccgtccctgagctccactcctgtggtagaattttataggcctgcgaagtttcgactctgtcaccactgtgtcacacaactggactgtgtggaactgcacgtccctgctgtttcagacatccatccgggtgttagtgtggttgctaggtttgctctacttcagctccttacccttaggaatctacttactggtgtctaagaaagtcacccttggggtcgtctttgtcagcctggtcccttcgagcctcgttattcttatggtgtatggtttttgccagtgtgtttgtcatgaatttctagactgtatggcacctccttcttaactgatatgcaaaataagaaattggacacacattgccctgtttgagtgtgaagttagataatttataatttattttcttttatgttctttatgattagtatccatgacattaacaaaacccttggccacatgttgacttgattggttttcctgtaggctggaagtaaaaatgttcatttctacttaggggttagcaaaattgtataagctcacacttcatggagcactgacagcagtgagtcttcccagagaaaggacagggtttctctcagcactgccagacagacggcaggggtgtggtgtgttatactatagggagagcatggatccctcctttcgtattcatggatgttctatgatggcagttggacacaagaggaaagttgctctgagacacaaagtgtgtactcctttcccaccccatacccctggtattggaacaccctagaattgtcttcaggtgttttctctcttaagtcactctctgtggtcggcgatcccattgagatacttgtttcctctgcccattctcccttgccaagaggaaactcggttccattcccttgggtagtttcaactgaataccagttttgccacattactaaggagaatg

SEQ ID NO: 63085 - DNA, 820 bp, Homo sapiens
acatgttccctgggcctatctcggaaggggccacaatgaccctgcaatgcacaaagtcagcgggaccctggaagatggtggtgtgggatgaggacggcttccagggccggcggcacgagttcacggccgagtgccccagcgtgctggagcttggcttcgagactgtgcgatctttgaaagtgctgagtggagcgtgggtgggcttcgagcatgctggcttccaagggcagcagtacattctggaacgaggcgaatatccaagctgggatgcctggggcggcaacacggcctaccccgccgagaggctcacctccttccggcctgcggcctgtgctaaccaccgtgactcgaggctgacaatcttcgagcaagagaacttcctgggcaagaaaggagagctgagcgatgactatccttccctccaggccatgggatgggaaggcaatgaagtagggtccttccacgtccactctggggcctgggtttgctcccagtttccgggctaccgaggatttcagtatgtgctggaatgcgatcaccattccggtgactacaaacatttccgggagtggggctctcatgccccgaccttccaggtgcagagcatccgcaggatccagcagtgaacaggggtgcggcacggaggagcgcatgcgtgcttatctgcaatggaggcgctctggaggctgtggtgtgttctctccttctgcctccccctgtaacctgtgtgaacccagcacccatgtgaactggtccgtgcacagtcagcacaaaaaactcaaacgaataaaaaagagaaagtctggtattaaaaaaactt

SEQ ID NO: 63086 - DNA, 903 bp, Homo sapiens
cagtgttggtgttcactcactatatgtctttaagaaaattaaaactatggaaaatttgtctagcatatcagaagttgtaaatgctatatctggtatccagaggctggctgtaaaaagttccttggggtcactctatctcacattttttttggttagcattttaaaaatgcaaagccacatactttgaaatatattattccaaattgagctcccttccctttgcacatattttttcctccccttattgaagtcagctctaaccccaaattctagtatccaaaagtatttttatttgtataatgctatctgaaaaatgtgtttatattatattttcagagctgcaattcttattcgccatttcaatacctagagatagagagtcttgtatttgaagccacacacactggtgtaatatgcttagtactctaggtcaaggatttgttggtaaatggaacattttagcatagtcatgatttttggttgcctagacatcaggtaaacattcagtacactaaagaaactatcctggacactccctcctgcttccaccaatttttttctcacccccttttcaaaaattgaaaactctatgagtgtctttttgagaccataaagcagactttagtaactttctatttctgtaagtactaaatgtctggcattttaaacttttgtagaatacattatgttggacactggaataatactatttattttcacctgtgaaaaatgacttcattgtacttgaaacacctcctttgcatttctccatttgtgccattcactagtggaaataaattgtattataccatgatctactggctttttaaaactgtattaaatatgcacatttttggtatagctattatcatttgtatgtatatattgtatatacatatgagt

SEQ ID NO: 63087 - DNA, 485 bp, Homo sapiens
gggggcttctgctagattccaccaacaggacgaacaagagggaaacaaaggcaagaggaagaagggacttgctccattctaatcagccttattgcacccctcagagatcacagcagcagtcagtgctctcctcagagatctgaattctactttcatgcggcccctcccctgagctcctgagatagccaatgtttgagccacctcctcagaagtttgagcctcaacaccgtgggatcccttctttgtgctccagagatccagtaacagccagccatcaccctctcttcattcttcataggcctgaactaaggtgttcagggccctccttcaagcttttaggttctgatgactccaaccacttcttttgttccatcctttcctagctctaggaatggtagctgctacctgcagtgattacctgttaccttttataattccttttgaccaatttcccatattaaaatatttctcaataactaaaaaga

SEQ ID NO: 63088 - DNA, 1007 bp, Homo sapiens
  misc_feature (41)..(41): n is a, c, g, or t
  misc_feature (495)..(495): n is a, c, g, or t
  misc_feature (825)..(825): n is a, c, g, or t
  misc_feature (901)..(901): n is a, c, g, or t
ctaatctaaaatttgtttgtatgttttataggtatgatttncccaattttgctgtcctgagaggaaatattacaaatgatagctaggtttcttagataattggagaaagtgctgtgtaaacatcaaaatattcagggcatttgttattatttatgcagaaatatagccaaaatactggcatattttcagttagcaatataatagtaataatagaaagtaaaacattttaaaagaggtttttctggaaattttttcctcaggatcacaaaaagtttttatttttcataagtatttcagtgatataatgagcacaagatacgttttgatgaaaagtaatgtttacatgaaaaaggaaatgcttattgatatttaaagacaattccctactctctctccttttccacatggtgaagtcgggagctccagatagaaatccaaagagagagaaagacaggggcagggaaggtacagtgtggaataatgtggactgtctcncatgacacttaagaggtcatgtgatgctagtgactttgctgatgtgtcaaggctagggctgagaggctgtgtccagcactgtcatctccactacctgaggcagaagcagaactgcagccggggcctccctgtgcttccagcactgaaagtaaagtgaacaagggttatgtggtcaacatgtgtgatttcttatagggaattttggttttgtattactaaaatacatagggtctggtgcaatgactcatacctataattccagtgcttttgggaggaaaaggcaggaggatgtcttgagtccaggagtttgaaactagcctaggcaacatngcgagatgccgtctctacaaaaatgaaaaaaatttgtctgagcgtggtggcatgctcctatagtccctattacttnggaggctgaggcgggaggattgcttgagcctaggagtttgaggctacagtgataccgattgcatcactgcattccagcctaggcaacagagcaagactccatctct

SEQ ID NO: 63089 - DNA, 465 bp, Homo sapiens
cctgggcaacatagggagaccccatctttaaaaaaactaaaaaaattagctgagtgtagtggtgcttgcctgtagtcctagctacctgggaggctgacatgggtagatccccttaagtccccaggaggtccaaggctgcagtgagtccatgatggggccactgcactcccagcttgggtgaccagagcgagatattctgtctcaaaaacaagcaaaactatgaaaaaaaagtcaacatttcttgaaatacttctcatatttggtagaggagggagatatattgggataaaggacataggaagataggattttattataatattaatttctgtagttattcaacacaaattaatttttattgagcatttgctattagggcagtcactgggcttttacgtcagaatatagagattaattcctttccttaaggatctaatcatacaatggatgttttagattagaaaa

SEQ ID NO: 63090 - DNA, 307 bp, Homo sapiens
atggaatgtcgggcaaagctcccctcccctctccagcaggcttgaggatggcactgtcacctccaccttagagatggccactgtcacctgcccaagccatcgagagacaaagcacagcccctgtctacctgacagcggggtctgtcttctttctttctaccaccacctgcctccagtagagggattcctcagaaatgaccttccaggtgaaaatccattcatccctcgccctccatcccaccccataatacagtgtattctctgaggctctttttaggagctgagttaataaagactgtcaaatccc

SEQ ID NO: 63091 - DNA, 263 bp, Homo sapiens
tttctaataagaacataaaataaaggctaattaaaagaaggtgactgagtccaggaaggcactaattaaagatgatatacagccaggtaaaaaagaacaattcacaggcacaagactatataaccattgttttattttcaaatgttatacaaaatatactttactgaactataattgatcattaatagtggcacagtctttagatttggaataacttggaaataaatcccaaccctgtcacttactaaatccataatttggca

SEQ ID NO: 63092 - DNA, 402 bp, Homo sapiens
ctaaattgtaccctgtaaatatgtagaattacaatatgccaatgaaaaatttaaaaatttcattttaatgtataaataggaatgtgagttcattcttttaaggtgagactacaaatgtcagagaaaccagatgtgtgggtcagctaaaatagtttccccgaggaatacaaaatgatcagaagggtccagggtgagtgtgaatctgaataagggaaatgggtgcactactgagtggctaatgacagcaggttctaatgtatccatgttcacaaaagggagatgtctggtaggcaaactgagtctacacactggcttcacgttaggtacaggaaaatatggttactgctaagaaacccccatactctttgttttctaacctttttttttcaaattaaatgcatt

SEQ ID NO: 63093 - DNA, 558 bp, Homo sapiens
actcaataaaataaaatatctttgaaacttcatcaaatacatttggcagtgagcagaagttagattgctggtagaaagaaattatccttcttggaaagtaaaaaaaaaatgcttaagtaaaattgcagcagttttgacatgtgtattttatgtttcagaaattctacaggttataggtttataaatggagaactggtcttggatttaaatgaattggcatcgtatctcagacttctagctttctacccatgtgaatttaggtgcgtactaatcacatatgtgttttaagtttatcactggctatatacatggttacttttgtatatgcctgtgcattgaatgaaaatacctggcatgtggttgttataagcaatagacagtttttggccagagagccaggcagacaagtgttaatatcacttaagccctctgtgtctcaagttcaaaatttctaaaatgagtgaatataatatttgtttgaattaaagtatacaaagcatgtatctcagtgtctaagacattgtaagacaccaataaatgtccagtatttctgttgtt

SEQ ID NO: 63094 - DNA, 540 bp, Homo sapiens
tccagcaccacctgcagaagctagagggccgccgcctggactttgactaaaagaagcggcagggcaagatccccgatgaggagctgcgccaggcgctggagaagtttgaggactccaaggaggtagcagaaaccagcatgcacaacctcctggagaccgacattgagcagatgagtcaactccgggccctggcggaggcgcagctgaacgaccactggcaggccatgcagatcctggacgagctggcagagaagctcaagcgcaggatgcgggaagcttcctcacgccccaagcgggagtataagcccaagttctgggagccctttgacctcggagagcctgagcagtccaacgggggcttcccctgcaccacagtccccaagatcgcagcttcatcccctttccaatcttccaacaagtccatctgtactcctagcaggagcatgccgcccctagaccagccaagctgcaaggtgctgtatgacttccagcctgagaaccatggggagctgggcttccatgagggcgacgtcttcacgc

SEQ ID NO: 63095 - DNA, 581 bp, Homo sapiens
ctcctaggaagaggttgtttaggatcctaattgtagttcggaggttcattctaaaggttcttctcgattccctttttctaaagacaaggagaacgacccccttgcaggcaccccgtttggtttctagtttggaagtgcattctaaagggtcttctccatggctttttctcccaaattaagttcagtgggtttgtctgcactgagactttttgttgacactaagttaagagggatagaaggaatttccatggccctgcttcgcaactgattctctagaaagccctttctgttatcctgtccttccctcacctaaccacaggctgctcctactgtgggggcaagcacagctctccccaccttcattgaatttgaacctttcatctgttaaataagaagtgaaacctacaatgcagggttccaggtttccttctcagaaccaaaccagataaaatgtgtaaagtaggtcctttccctgaggctgcacgattctgggctctcccagcccttccttggtttttttttttttttttttttgaaacagtctccctctgtcacccaggctggagttcagtggcatgatt

SEQ ID NO: 63096 - DNA, 711 bp, Homo sapiens
aggctcagaaggtccagaaatcaggggaaggagacccctatctgtccttcttctggaagagctggaaaggaagtctgctcaggaaataaccttggaagatggtggccacgaagacctttgctctgctgctgctgtccctgttcctggcagtgggactaggagagaagaaagagggtcacttcagcgctctcccctccctgcctgttggatctcatgctaaggtgagcagccctcaacctcgaggccccaggtacgcggaagggactttcatcagtgactacagtattgccatggacaagattcaccaacaagactttgtgaactggctgctggcccaaaaggggaagaagaatgactggaaacacaacatcacccagagggaggctcgggcgctggagctggccagtcaagctaataggaaggaggaggaggcagtggagccacagagctccccagccaagaaccccagcgatgaagatttgctgcgggacttgctgattcaagagctgttggcctgcttgctggatcagacaaacctctgcaggctcaggtctcggtgactctgaccacacccagctcaggactcgattctgcccttcacttagcacctgcctcagccccactccagaatagccaagagaacccaaaccaataaagtttatgctaagtcgagcccattgtgaaaatttattaaaatgactactgagcact

SEQ ID NO: 63097 - DNA, 504 bp, Homo sapiens
tcgcaaattattacgtggggtataaagaaaacaaagaggaagctgtgaccaggtaccaggcttatggtatgggacttttcaaagccaagccttgaaggatgagaaggagctatgcacacagcaggtgaaggagaaggggcagtgaactggctggagaagagcaggtgcaaaggccctgcacgggaaggtggttcagcatctgcaggattagcgaggaggcctgtacaactgccacagggcaggcaagggaaggagagatatgaaaggaacctgcggaacattatggagaatattatgaagaatttgtatttttcctaaggaatccgttttgggacagggaactgatttaatttacatttttgaaaaaccctctcaggaggctgaggtgggtggatcacgaggtcaagagatcgagaccatcctggccaacgtggtgaaaccctgtctctactaaaaatacaaaaactagctgggtgtgatagcacgtgcctgtagtcccagcta

SEQ ID NO: 63098 - DNA, 459 bp, Homo sapiens
gttttaacatctgcttgcaaatcataatcacctgggagcttaataaactggagacgtcctggccctacccttgggagatttgatttggcaggcctgggtgggaccttatcctaggcgtttttgaccagccccccaggtgacttgaatgccattagatatatgggttgatgggatgactttcaggatgactgccaaggaaatcgttggccaaggattacttcctgttttctagaactgcatttccggagccttatctgtgacctcatggttaatagagagtagaactctgctgctgcttctacggagccagctgaggggcactggggaattctggccccattgtgattctcagtcagagagaatgctggggagtcctccggtggggccagtaggatgggaaagggagagtcccactttgatttcagcatctgaggcttttggtattagcgacagaatagg

SEQ ID NO: 63099 - DNA, 1549 bp, Homo sapiens
agctcagtggcatgatcgtggctcactgcagtctcgacctcctgggctcgggtggtcctcccgcctcagcctcctgagtggtgggaccacaggtgtgcaccaccgtgtccagctaatttttgtagagatggggtctcatcatgctgcccaggctggtctcaaactccagggctcgagtgatccgccatccttggcctcccaaagtgctggattacagacctgagccaccacaccaggctgccccacacattgtaaagtttcgcttccctctaatgtcagattccaaagacagcagccttcatgagtcagaaagaaacatcggtcattttgaaatcaacatccaactgaagtgtagaaaggcctctggatttttgaaacggcaacaacagatgatgtaatacaaagacgcccccaccccactgctttcccactgcatgctttacatgacatggcacagcttccacgccagcagcttcaatcatgtaaagcgaatgcagtcccatcaagaccacagcattggctgagcagctactccatgctgggcaccgtcctgggcactggaagtacagcagagaacgaaaccaagaccacaccctccagaagcctgcattccagcaggacagacagacttccatacacagagcaggaaaatgcacagcgtgtcagatgatgatgattactatgagaaaaataaagcaggcaaagagaacaggactatttggatgagggtggtgcaaattcaaataatcagacagcctttgctgggaaggtgatatctgagcaaagattcgagaaggtggggagagccccggagccttccccgcagagcagaggaggcccgggaagctctggactcatagcggttcagcacggccacgacacggccacttccagacagagcccctggctgctgggtagggaccgcagcacctcagagaaccctttctggggtcacttctggcaccctctgcaaacctcaagggggagcgtgaggctgggggctgtccatcagggtccaggcacctcctgaaggaacctctcaaagccagccgatcaccggctccagacccacgctgtcagacatctctgtggccaccagaccactgccactctcacgggtgtgatgacatgggacctgcctactggtagtcttctgccttcgtggaattctgcaacttccttcctgcctcggccacagcatgtcagccaagcacctgtcagggtccctccctggcaggacgatgtttagaagctcaacaccgtgctcctgcctcctcttcagacccatcagaacttgctaccatgggtgtgttttaataaataacttcatttctgcagcaaataaataaataaataaatgtagttgcaatattgcctttaaaagcacttttaagcatcaattgtgaaataaaaagcccgagcaaaagccctctttgagcgtgaagtgtctaaacgtttatttgtactactattgttgtaaagggtagattttgtagcattttgaggtggtgattcaactgcattaacagcatcccgagaccgcctgcca

SEQ ID NO: 63100 - DNA, 986 bp, Homo sapiens
agctcagtggcatgatcgtggctcactgcagtctcgacctcctgggctcgggtggtcctcccgcctcagcctcctgagtggtgggaccacaggtgtgcaccaccgtgtccagctaatttttgtagagatggggtctcatcatgctgcccaggctggtctcaaactccagggctcgagtgatccgccatccttggcctcccaaagtgctggattacagacctgagccaccacaccaggctgccccacacattgtaaagtttcgcttccctctaatgtcagattccaaagacagcagccttcatgagtcagaaagaaacatcggtcattttgaaatcaacatccaactgaagtgtagaaaggcctctggatttttgaaacggcaacaacagatgatgtaatacaaagacgcccccaccccactgctttcccactgcatgctttacatgacatggcacagcttccacgccagcagcttcaatcatgtaaagcgaatgcagtcccatcaagaccacagcattggctgagcagctactccatgctgggcaccgtcctgggcactggaagtacagcagagaacgaaaccaagaccacaccctccagaagcctgcattccagcaggacagacagacttccatacacagagcaggaaaatgcacagcgtgtcagatgatgatgattactatgagaaaaataaagcaggcaaagagaacaggactatttggatgagggtggtgcaaattcaaataatcagacagcctttgctgggaaggtgatatctgagcaaagattcgagaaggtggggagagccccggagccttccccgcagagcagaggagagcatagcacctgcagcaagatggatgtgggcagcaaagaggtcctgatggagagcccaccggactactccgcagctccccggggccgatttggcattccctgctgcccagtgcacctgaaacgccttcttatcgtggtggtggtggtgg

SEQ ID NO: 63101 - DNA, 1971 bp, Homo sapiens
ttatcacaactgatcactccgtggggtcaccgctgctctggcgtctacctcccccaacaggttggggtttctaggagggcagctccagaggttgcagaacactccgctgcctctccagagccaggcacacagcaggcgctccataaatgttcgttggtcttttctccttgctcagcttcaatgtgttccggagtggggacggggtggctgaacctcgcaggtggcagagaggctcccctggggctgtggggctctacgtggatccgatggagccgctggtgacctgggtggtccccctcctcttcctcttcctgctgtccaggcagggcgctgcctgcagaaccagtgagtgctgttttcaggacccgccatatccggatgcagactcaggctcggcctcgggccctagggacctgagatgctatcggatatccagtgatcgttacgagtgctcctggcagtatgagggtcccacagctggggtcagccacttcctgcggtgttgccttagctccgggcgctgctgctacttcgccgccggctcagccaccaggctgcagttctccgaccaggctggggtgtctgtgctgtacactgtcacactctgggtggaatcctgggccaggaaccagacagagaagtctcctgaggtgaccctgcagctctacaactcagttaaatatgagcctcctctgggagacatcaaggtgtccaagttggccgggcagctgcgtatggagtgggagaccccggataaccaggttggtgctgaggtgcagttccggcaccggacacccagcagcccatggaagttgggcgactgcggacctcaggatgatgatactgagtcctgcctctgccccctggagatgaatgtggcccaggaattccagctccgacgacggcagctggggagccaaggaagttcctggagcaagtggagcagccccgtgtgcgttccccctgaaaaccccccacagcctcaggtgagattctcggtggagcagctgggccaggatgggaggaggcggctgaccctgaaagagcagccaacccagctggagcttccagaaggctgtcaagggctggcgcctggcacggaggtcacttaccgactacagctccacatgctgtcctgcccgtgtaaggccaaggccaccaggaccctgcacctggggaagatgccctatctctcgggtgctgcctacaacgtggctgtcatctcctcgaaccaatttggtcctggcctgaaccagacgtggcacattcctgccgacacccacacagatggcatgatctcagctcactgcaacctccgccttccagattcaagagattctcctgctcagcctctggagtagctgggactacagacatgcaccaccacacctggttaattttttatttttattttttgtagagacaggtgtctctctacgttgcccaggctggtctcgaactcctgggctcaagtgatccacccatctccacctcccaaagtgctaggattacaggcgtgagccaccgtacccagcctggtcccatatcatagtgaaatggtgcctgtaaagctctcagcattggcttggcacatgcagttggtactcaataaacggctgttggtgaatggcaagttatgtattcggcccgaatggggttcatgggcaattccctctaaggggggatataaaaacagggccggttttaaaacggcgaatgggaaacctggtccccaatatagttgtggaaaacctttttcccacgggaaatagaaggccccctcatggcttccaaatgggccctcagcgcgtgaatcaagcgctatttctctaaagcggcctaatttacactctttttttcaacgcgtcgggtgactctttaatcctctccctcgcgtgtgttcttatacacttcttgtgctccttctcatcctcctctgcttccatctttctctcttcttctctcttctcg

SEQ ID NO: 63102 - DNA, 2878 bp, Homo sapiens
ttatcacaactgatcactccgtggggtcaccgctgctctggcgtctacctcccccaacaggttggggtttctaggagggcagctccagaggttgcagaacactccgctgcctctccagagccaggcacacagcaggcgctccataaatgttcgttggtcttttctccttgctcagcttcaatgtgttccggagtggggacggggtggctgaacctcgcaggtggcagagaggctcccctggggctgtggggctctacgtggatccgatggagccgctggtgacctgggtggtccccctcctcttcctcttcctgctgtccaggcagggcgctgcctgcagaaccagtgagtgctgttttcaggacccgccatatccggatgcagactcaggctcggcctcgggccctagggacctgagatgctatcggatatccagtgatcgttacgagtgctcctggcagtatgagggtcccacagctggggtcagccacttcctgcggtgttgccttagctccgggcgctgctgctacttcgccgccggctcagccaccaggctgcagttctccgaccaggctggggtgtctgtgctgtacactgtcacactctgggtggaatcctgggccaggaaccagacagagaagtctcctgaggtgaccctgcagctctacaactcagttaaatatgagcctcctctgggagacatcaaggtgtccaagttggccgggcagctgcgtatggagtgggagaccccggataaccaggttggtgctgaggtgcagttccggcaccggacacccagcagcccatggaagttgggcgactgcggacctcaggatgatgatactgagtcctgcctctgccccctggagatgaatgtggcccaggaattccagctccgacgacggcagctggggagccaaggaagttcctggagcaagtggagcagccccgtgtgcgttccccctgaaaaccccccacagcctcaggtgagattctcggtggagcagctgggccaggatgggaggaggcggctgaccctgaaagagcagccaacccagctggagcttccagaaggctgtcaagggctggcgcctggcacggaggtcacttaccgactacagctccacatgctgtcctgcccgtgtaaggccaaggccaccaggaccctgcacctggggaagatgccctatctctcgggtgctgcctacaacgtggctgtcatctcctcgaaccaatttggtcctggcctgaaccagacgtggcacattcctgccgacacccacacagaaccagtggctctgaatatcagcgtcggaaccaacgggaccaccatgtattggccagcccgggctcagagcatgacgtattgcattgaatggcagcctgtgggccaggacgggggccttgccacctgcagcctgactgcgccgcaagacccggatccggctggaatggcaacctacagctggagtcgagagtctggggcaatggggcaggaaaagtgttactacattaccatctttgcctctgcgcaccccgagaagctcaccttgtggtctacggtcctgtccacctaccactttgggggcaatgcctcagcagctgggacaccgcaccacgtctcggtgaagaatcatagcttggactctgtgtctgtggactgggcaccatccctgctgagcacctgtcccggcgtcctaaaggagtatgttgtccgctgccgagatgaagacagcaaacaggtgtcagagcatcccgtgcagcccacagagacccaagttaccctcagtggcctgcgggctggtgtagcctacacggtgcaggtgcgagcagacacagcgtggctgaggggtgtctggagccagccccagcgcttcagcatcgaagtgcaggtttctgattggctcatcttcttcgcctccctggggagcttcctgagcatccttctcgtgggcgtccttggctaccttggcctgaacagggccgcacggcacctgtgcccgccgctgcccacaccctgtgccagctccgccattgagttccctggagggaaggagacttggcagtggatcaacccagtggacttccaggaagaggcatccctgcaggaggccctggtggtagagatgtcctgggacaaaggcgagaggactgagcctctcgagaagacagagctacctgagggtgcccctgagctggccctggatacagagttgtccttggaggatggagacaggtgcaaggccaagatgtgatcgttgaggctcagagagggtgagtgactcgcccgaggctacgtagcacacacaggagtcacatttggacccaaataacccagagctcctccaggctccagtgcacctgcctcctctctgccccgtgcctgttgccacccatcctgcgggggaaccctagatgctgccatgaaatggaagctgctgcaccctgctgggcctggcatccgtggggcaggagcagaccctgccatttacctgttctggcgtagaatggactgggaatgggggcaaggggggctcagatggatccctggaccctgggctgggcatccacccccaggagcactggatggggagtctggactcaagggctccctgcagcattgcggggtcttgtagcttggaggatccaggcatatagggaagggggctgtaaactttgtgggaaaaatgacggtcctcccatcccaccccccaccccaccctcacccccctataaaatgggggtggtgataatgaccttacacagctgttcaaaatcatcgtaaatgagcctcctcttgggtatttttttcctgtttgaagcttgaatgtcctgctcaaaatctcaaaacacgagccttggaattcaaaaaaacatt

SEQ ID NO: 63103 - DNA, 294 bp, Homo sapiens
cctggtggtagagatgtcctgggacaaaggcgagaggactgagcctctcgagaagacagagctacctgagggtgcccctgagctggccctggatacagagttgtccttggaggatggagacaggtgcaaggccaaggtcctggggcccagtgggccagacggtcaggggtgcaaccctgcccggggggtgggggggctagacatccatcgctcctgggatatcagggcctggaggcctgagggagaaacgaaaacatccactttgtcttacagacacgaagagcgactatctca

SEQ ID NO: 63104 - DNA, 4559 bp, Homo sapiens
  misc_feature (1126)..(1126): n is a, c, g, or t
  misc_feature (1132)..(1132): n is a, c, g, or t
  misc_feature (1135)..(1135): n is a, c, g, or t
  misc_feature (1152)..(1152): n is a, c, g, or t
  misc_feature (1157)..(1157): n is a, c, g, or t
  misc_feature (1162)..(1162): n is a, c, g, or t
  misc_feature (1181)..(1181): n is a, c, g, or t
  misc_feature (1188)..(1189): n is a, c, g, or t
  misc_feature (1220)..(1220): n is a, c, g, or t
  misc_feature (1230)..(1230): n is a, c, g, or t
gcttcaggtcaaattagggctttgggtcaaatcagggctacctggtctgggagaggcacacttctaactgctgatgccaccctcaaagggtctccagaagcttccactgactgctgttggctgcaccaggcagtgagtatcagtacatttaatcatcacaaaaaccgggcaggcagatgttggcggattgtctgtgggctgctgaagagctggtagagctcagcgcgtctgtgactggaccacagtgcgagtagctggggctgacagtggaccctgggctgctgcacccgctgcaacccccaggtggagggatccacgcagcctggtgacgatttggccctggccctgagccatgccccgcgtgacgcagtgctgtctgccagcctgggaggctcctcacctgtctttgcctgagccagggcctgggagtttcaggactgggaaaggaaagaaaaccccaaggctggggtcaggaagaggagggctattttgctgctcagtcctgctcccccaaaccagaccttcagctctttgcaaacgaaagagggggcaaggccaaagcggggttccttatgcaagtttgcttcctgccctgaaaaaccaaaaaaacggaaaacttttccaagcaagtgtaagcactgtgtgaggacagagtgggcgtttccttctgaaataggagactaggcccccagtgggcaaagagaccctgacccgcttctccatctgtgcgggggaatgaatgagcaggctcaccctgttgtcatcctgcctgctgctgtggggcccccctagatcttaggaattgctgggtacttccggacagtgaggttgtctgagctgcctgcaggttccctgagtctgggtactcaggggctgggcaggagatgcccattaagcaggtgttactctaatgagtgagcttttcaatgagatgaacaggaaaattagcaaaatcatgttcctaatcattcctcctgcggcggccccaattttgctaactgttaacattatatgatgcataagtaggggaatgcatttttaaaattatggtaaagcctatgtaacattttataaaattgaccattttattttattattaatttttttttttttaagacagggtctngctctntcncccaggctggagtgcantggtntgatntcggctcactgcaacctcngcctccnnggttcaagcgattctcctgcctcagcctccngagtagctgngattacagcctgtgttggaacatccttccttcttaaggctgaagaacattccattgtccagctgggagctccccgacctccaggagggcaagatccaagccatcagcgactcggacggggtgaactacccctggtacggcaacaccacagagacctgcaccatcgtgggccccaccaagagggactccaagttcatcatcagcatgaatgacaacttttaccccagcgtcacatgggccgtgcccgtcagcgagagcaacgtggccaagctcaccaacatctaccgggaccagagcttcaccacctggctggtggccaccaacacctccaccaacgacatgatcatcctgcagacgctgcactggcgcatgcagctcagcatcgaggtgaaccccaaccggcccctgggccagcgcgcccggctgcgggagcccatcgcccaggaccagcccaaaatcctgagcaagaatgagcccatcccgcccagcgccctggtcaagcccaatgccaacgatgcccaggtcctcatgtggcggcccaagtatgggcagccgctggtggtgatcccgcccaagcaccggtgacagccaggaccacccgctaggttagactcacaaataataataccgctgaaaacaaaactcagactcactcttcagtcattcagcaagatacaaccattctaccctctccagcgggcggatctcactgtgctgatgcccccgggaaggcctccccggctctcggcacctgcttcctttcagggagaggggagatctaagcaggacagacagaccccacgtgcgccctcagggtgacctctggtctccttgcctctcctttttctcagtttcagtcgctcacttgtaacagattccctgaaacactgctttttccgttttttaaaaaaactcctcttttgggggctcaggggcaggaggagggggagctgattaggagggaagctccagcccccgatcaaagagacagatccacactgctgccgatttgtggcgctggccggccttccccccaggtccctccgccctctgtcatgcggccttatgtagacttgctttgccaaacttttgccttaagctgaattgaaaggaagaaaaccaatcggagaaagaaagcaggatctcttttctaccggacttttcctcttctgccagaggtggagggagggttggggtcgcccgcgagagtctcttgagcccttcttcccggttgtcttgggagaagggtgaggatgggcatttagacccgaaaccagctgctcactctttctttttggcagaaataaaaccacaggtagattctgcctgaacagccccttctctccctccacccccaggtcgtatccctgcacctgcggagaggggctgtgagctctggcggggggtggctccaccagtcgcctggcctcttctcccctctcttcccagcagccttaacttcccttgggcggctctaggaggagagaggcaggctcctgtgagcccagggaattttcaccctctcagtcctcaggacccacccccagttgagtccctggcccttcctccaggtgtgtggctttttccttctccatccacactggtcccaaatgcctgggggccggccacctggaccgccgacacacagcctcaatgttagtctcaaaggtaaggaaggcattcacgtcccttcttgcagggcattttaagacttgaatcgggtgggccccggcccctgtggctggctggcccctggtgtactgtaaaagggccaagacagggctcgttctcaggggcgcccctcccaggccctcagggcagcgggacggtgcagtcaggctctgggtgccacagtgatggaggtggaaggcacccaagctctagggaagtcttgggaggcagtcggccgagcccctgcttcctgtcctcaaataagtgaatccaggccaagggctgggagggctgggtgggcttatcgtcgagagggttcagagccactctggaggctgggctggcacagtggagagcgacaggtgaggacagacgtctggaagcccatccctgggacctgccctcccttggtcccaggtcactggagctccagggcttacttagtcctgacccattgtgccagggttctgagcagtgtcggccttgtggccacttgcaggggctattaggggacatcccgctgaagccacgctccttccagcttgccaaacccacagctacccgcccgggacccacactcagcctaataattatcaagcacagaaaaccgtccatttagaaaaataatccatttctgctgcagatgagccacttgtaagagtctccgtgacagcgtgggacggtgtgggaaccaaagtccctgccctgctcctttgtccacgggctattgcgtttattcaaggggtgcttaatgaccgtttagccactgccgtcggtctccgggcccagctcgtgccaggaggctgtcctgggacacactgggctggagctgccggctggcacggtgctcagggggcccctgatgggggccaggacctccccgcagaaactgcaggttctcttgtgaggatggaggccgtgccaccccgaaaggcagtagccttaggggaacagtgggtcccagctgcatgtctgaggatgggtggggacagggctgggactcagctttcattcactggagacttctccactcaggtctttgttgcactaaagcagggacaggaccctgggggttcaggaagcgggtctcaggccgctggtttattcctggaggtggggctggagaccagaatggaaaggggcttcctgagctgctagggggtgaaggacccccgaacccgcatttcttgagtgagagcaaacactcgaggcaggagccagcacccctcccactgcatgcccggcccccagcccaccttgccccctgacccaccttcacccgtgccccttctttctgcccttcctcaccgaagaagggctaggaacaccctggagaggctgcaggtccggccacggacgctcagctgagccccggtctgctccttcagcctccttgctcttgttggagcacaggccccaggcttcctgccagggccccgattcttcttatgtcctccagccccgccctggcgtggacatccactcactccttccagcaataagaaccgtccttggtcgtggagagtactgtgaaacaaaccaatgcacttaccaggaggcacaagactcttgaagaagatgtaaaatgaaccttttttttttttacaaaaaacaaaaagcaaatattcataaagagaaataaaatgtaattttaaagta

SEQ ID NO: 63105 - DNA, 3322 bp, Homo sapiens
ggcgtgcagccacatggagttctacaaccagtacggcgagcagggcatgtccagctgggagctccccgacctccaggagggcaagatccaagccatcagcgactcggacggggtgaactacccctggtacggcaacaccacagagacctgcaccatcgtgggccccaccaagagggactccaagttcatcatcagcatgaatgacaacttttaccccagcgtcacatgggccgtgcccgtcagcgagagcaacgtggccaagctcaccaacatctaccgggaccagagcttcaccacctggctggtggccaccaacacctccaccaacgacatgatcatcctgcagacgctgcactggcgcatgcagctcagcatcgaggtgaaccccaaccggcccctgggccagcgcgcccggctgcgggagcccatcgcccaggaccagcccaaaatcctgagcaagaatgagcccatcccgcccagcgccctggtcaagcccaatgccaacgatgcccaggtcctcatgtggcggcccaagtatgggcagccgctggtggtgatcccgcccaagcaccggtgacagccaggaccacccgctaggttagactcacaaataataataccgctgaaaacaaaactcagactcactcttcagtcattcagcaagatacaaccattctaccctctccagcgggcggatctcactgtgctgatgcccccgggaaggcctccccggctctcggcacctgcttcctttcagggagaggggagatctaagcaggacagacagaccccacgtgcgccctcagggtgacctctggtctccttgcctctcctttttctcagtttcagtcgctcacttgtaacagattccctgaaacactgctttttccgttttttaaaaaaactcctcttttgggggctcaggggcaggaggagggggagctgattaggagggaagctccagcccccgatcaaagagacagatccacactgctgccgatttgtggcgctggccggccttccccccaggtccctccgccctctgtcatgcggccttatgtagacttgctttgccaaacttttgccttaagctgaattgaaaggaagaaaaccaatcggagaaagaaagcaggatctcttttctaccggacttttcctcttctgccagaggtggagggagggttggggtcgcccgcgagagtctcttgagcccttcttcccggttgtcttgggagaagggtgaggatgggcatttagacccgaaaccagctgctcactctttctttttggcagaaataaaaccacaggtagattctgcctgaacagccccttctctccctccacccccaggtcgtatccctgcacctgcggagaggggctgtgagctctggcggggggtggctccaccagtcgcctggcctcttctcccctctcttcccagcagccttaacttcccttgggcggctctaggaggagagaggcaggctcctgtgagcccagggaattttcaccctctcagtcctcaggacccacccccagttgagtccctggcccttcctccaggtgtgtggctttttccttctccatccacactggtcccaaatgcctgggggccggccacctggaccgccgacacacagcctcaatgttagtctcaaaggtaaggaaggcattcacgtcccttcttgcagggcattttaagacttgaatcgggtgggccccggcccctgtggctggctggcccctggtgtactgtaaaagggccaagacagggctcgttctcaggggcgcccctcccaggccctcagggcagcgggacggtgcagtcaggctctgggtgccacagtgatggaggtggaaggcacccaagctctagggaagtcttgggaggcagtcggccgagcccctgcttcctgtcctcaaataagtgaatccaggccaagggctgggagggctgggtgggcttatcgtcgagagggttcagagccactctggaggctgggctggcacagtggagagcgacaggtgaggacagacgtctggaagcccatccctgggacctgccctcccttggtcccaggtcactggagctccagggcttacttagtcctgacccattgtgccagggttctgagcagtgtcggccttgtggccacttgcaggggctattaggggacatcccgctgaagccacgctccttccagcttgccaaacccacagctacccgcccgggacccacactcagcctaataattatcaagcacagaaaaccgtccatttagaaaaataatccatttctgctgcagatgagccacttgtaagagtctccgtgacagcgtgggacggtgtgggaaccaaagtccctgccctgctcctttgtccacgggctattgcgtttattcaaggggtgcttaatgaccgtttagccactgccgtcggtctccgggcccagctcgtgccaggaggctgtcctgggacacactgggctggagctgccggctggcacggtgctcagggggcccctgatgggggccaggacctccccgcagaaactgcaggttctcttgtgaggatggaggccgtgccaccccgaaaggcagtagccttaggggaacagtgggtcccagctgcatgtctgaggatgggtggggacagggctgggactcagctttcattcactggagacttctccactcaggtctttgttgcactaaagcagggacaggaccctgggggttcaggaagcgggtctcaggccgctggtttattcctggaggtggggctggagaccagaatggaaaggggcttcctgagctgctagggggtgaaggacccccgaacccgcatttcttgagtgagagcaaacactcgaggcaggagccagcacccctcccactgcatgcccggcccccagcccaccttgccccctgacccaccttcacccgtgccccttctttctgcccttcctcaccgaagaagggctaggaacaccctggagaggctgcaggtccggccacggacgctcagctgagccccggtctgctccttcagcctccttgctcttgttggagcacaggccccaggcttcctgccagggccccgattcttcttatgtcctccagccccgccctggcgtggacatccactcactccttccagcaataagaaccgtccttggtcgtggagagtactgtgaaacaaaccaatgcacttaccaggaggcacaagactcttgaagaagatgtaaaatgaaccttttttttttttacaaaaaacaaaaagcaaatattcataaagagaaataaaatgtaattttaaagta

SEQ ID NO: 63106 - DNA, 644 bp, Homo sapiens
cggtcccacaggcaggtgtactgtaagcgtggctggggaggctcaggaaactgacaatcacggcagaaggcgaaggggaagcaggcacgtctggccatgttggacaggctgatctcgaactcctgacctcaagtgatccacccgccctagcctcccagagtgctgggattacagacgtgagccaccgtgcccagccaatttttaatttttttaagaaatgaaatcttgctctgttgctcaggctggagtggagtagtgccatctttgttcactgcagccttgaacccctgggctcaagtgatcctcctgcctcagcctcccgagtagctggaaccacaggcgtgagccactatacccggccctattcctctgaaaagcttagtaaacagcagttctttataccagggaagaggaagagacattttaatgatgtgatagtttattcagtgaagagtacagaaatgagttagggcccctgctctctaagaattacagaccttacaaggtaggcctgggccgggcgtggtggtggcgcctggattcccagcactgtgggagcatgaggcaggagaatcgctggacctgggaaggcggaggttgcagtgagccgagatcctgccattgcactccagcccgggcgacga

SEQ ID NO: 63107 - DNA, 501 bp, Homo sapiens
ccatacatgtacatttccacccactatctgaatgaatctgttccaaggtgcccaaagaggaaggactaattattcatttactgaaatatggatagttcatcttttaagaacctagtaaggcttttattatctatcattttacatttttttcttattaaataaacatcctttaaaggaaaaaggatttgagcagacatcatgaagtgaagccaactgtttagactagaatgttatgagattaaacccacaggagattattcatagacataaaccctcattttaattagtggatctggatttttgtcatatgtggaatcataatttaaacaaaatcaactaagatgatccaagttccacacaactgcacttcaatattcaagtcggtgtgaagatgcctgactactgcgtcacaagattctgagctgtcgtaaaaagcctggctcgtggtttctatttatagtgtacacatgttgggttataatcacaaacctggaactctgt

SEQ ID NO: 63108 - DNA, 194 bp, Homo sapiens
aaaaaaagaacattccactggggaaaaaggactaacaaagaacaaagaattaaaaggaaaacaaacagcaaataagcattaaaatattcatttttttagtaatcaaagaagtgaacttaaaatagcaactagataccattttctaccatcaaaatgggaaaaatatgtatgtataataagcaatatttgtgaga

SEQ ID NO: 63109 - DNA, 429 bp, Homo sapiens
tgcagtggcacgatctcagctcactgcaacctctgcctcccaggttcaagcaattctcctgcctcagcctcccaagtagctgagaatacaggcgcacaccaccacgcccagttaattttttgtattttagtagagacggggtttcacagtgttgcccaggctggtctccaactcctgagctcaggcaatccacctgcctcggcctcccaaagtgttgggattacaggcatgagccattgcaccagttgtaacctatctcttttgactcaatctaaaagtttctgtcttttaatacaaaaccataatccatatgaattcattaattcacaactgacatttagcatcttatttctgttatcctatttcatattttatgattccttgtttctgctcttttgatatatatactatgttttatttgcacttatc

SEQ ID NO: 63110 - DNA, 507 bp, Homo sapiens
tttttcttctcctttgggcaactgcttaaattcagaggcagctaccaaaaggaaacgtctctctaccccctactgtttcttctgtgcaaaagaatgtaaaatatgaggcttctctttcgcatagaaaacagaagaaaagttgcaacagagtgaaaaatcaggaaaacctcatcgagatagatattctgccagagacaaaacgaaacctcatcgagatagatattctgccagagaaaaatgagacatcagatatgtgtgatcacaggtcatagactcagtgaagtgccactgtcacaatgctctcatgccaaaccttgactgcaaagctgagatgttaatatggaacacctgagagggctggcacttcagcgtccttattcctccagaaccacaccacaaaagtcaccttctccccagacagattctctacaaaatgccttgcagccgaggtgtggtggaaagaatattgtatttggaataaaaaatttttgattttgcaccatcatg

SEQ ID NO: 63111 - DNA, 652 bp, Homo sapiens
tttttcttctcctttgggcaactgcttaaattcagaggcagctaccaaaaggaaacgtctctctaccccctactgtttcttctgtgcaaaagaatgtaaaatatgaggcttctctttcgcatgtaggcctgagaagttttgacaagaatgtgtatgcagggagaaatgactggtgaaagaatttagaaagaatgtatggggacaaaaaggaatcacatgagctgatttaaattcttcttgtgacaaggggtgtgtgcaaacatgaaggaactagggttttgtttgtaaatgtttatcggtttgggagaggcaaagatcacagactgtgatattcttgggataaacagctcaatatgttggtcccaagcgacaccatgtggaattgagaagagggccattctcatctaaacacccatcggagcccaggtttggcgttctgaagatcagggacttccatttgtttataagctcatttgattgacaagtatttattgagcaactactttatgatagtccctgtttttgctgttggtaatgtaaaaatgaaaaagacacgtttttctgttcttaaggcagttaccgagttaaaaaaaaatagtatgtaatcatcttatatggtacatgtatatttatataaaaatatgttataatg

SEQ ID NO: 63112 - DNA, 1021 bp, Homo sapiens
tgacgcatggactataataggatgaactccttcttagagtacccactctgtaaccggggacccagcgcctacagcgcccacagcgccccaacctcctttcccccaagctcggctcaggcggttgacagctatgcaagcgagggccgctacggtggggggctgtccagccctgcgtttcagcagaactccggctatcccgcccagcagccgccttcgaccctgggggtgcccttccccagctccgcgccctcggggtatgctcctgccgcctgcagccccagctacgggccttctcagtactaccctctgggtcaatcagaaggagacggaggctattttcatccctcgagctacggggcccagctagggggcttgtccgatggctacggagcaggtggagccggtccggggccatatcctccgcagcatcccccttatgggaacgagcagaccgcgagctttgcaccggcctatgctgatctcctctccgaggacaaggaaacaccctgcccttcagaacctaacacccccacggcccggaccttcgactggatgaaggttaagagaaacccacccaagacagcgaaggtgtcagagccaggcctgggctcgcccagtggcctccgcaccaacttcaccacaaggcagctgacagaactggaaaaggagttccatttcaacaagtacctgagccgggcccggagggtggagattgccgccaccctggagctcaatgaaacacaggtcaagatttggttccagaaccgacgaatgaagcagaagaagcgcgagcgagagggaggtcgggtccccccagccccaccaggctgccccaaggaggcagctggagatgcctcagaccagtcgacatgcacctccccggaagcctcacccagctctgtcacctcctgaactgaacctagccaccaatggggcttccaggcactggagcgccccagtccagccctatcccaggctctcccaacccaggcctggcttcactgcctgggatctctaggct

SEQ ID NO: 63113 - DNA, 389 bp, Homo sapiens
catactaaatgacactgtcgctttccaaaatataatataataattataggcattggtcaggtactaaactgggtgctgcacatatactatttgcattctcaaaacaattcagtaggcattatttatacaattttacatataaatacagtgttagagatgattgctgcccaacatccattttcttcttctttagcagcataattctgattatatttgtaactgacaatgtacctagttaaaagcctaaatctctaccctctcttatttagctaggtgaggtcatgtgaccacattctgttcactgagatgtaagtgaatgtattgtttgagatttctgggagtctattgaaggaacttaactgggcttctgactgtctcctttttattct

SEQ ID NO: 63114 - DNA, 331 bp, Homo sapiens
aaaacctctcccagctctcacctggagaatcaccccacagaagcatcagagcccaaaggatttttgaatgggaggtggaggaaatttcttcctgagatggggaaactgaggcacagatgtggtcttctggaggtcgggaagccatcagtggagagtggtctctggctctacccctctacccacctttgtccagggcccctgcccactgttaatgttctggtatatttccctccaggctttttctccgtgtgtgtgtgtgtgtgtgtgtgtgtgtgtgtgtgtgtgtgtgtgtgtgtgtgtgtgtattttaaataacattgagatggtgcag

SEQ ID NO: 63115 - DNA, 220 bp, Homo sapiens
  misc_feature (1)..(1): n is a, c, g, or t
  misc_feature (3)..(5): n is a, c, g, or t
  misc_feature (164)..(164): n is a, c, g, or t
ncnnngtcagaggccagggaaagaggcaccaaggggattaaaggtgaccatgacctgtgcacacgcagaaccatgaagagtgcccgtcccaccagcccagctgggaaaactcgtttttcaccacacatggggttaatacgcagaaggctcttagctcactagtngaggataattagctctggaccaagcactatctgattcccagctaacaaatcttaaa

SEQ ID NO: 63116 - DNA, 3450 bp, Homo sapiens
aggcatcgaactgcggtagtacgggttacggaatcactgtcgatgccctagctggatcaatgtttcgatctgatacgccagcttggcacgaggctgcctcaggaagcttggcttccctcccatgggaagtgctggaatccactcttgcctgaccctcccataagaaacaagggaaattcctttacgtgagccgccttgctcagaacaaagcttggcgtgtttcttattcctcatcaatctgacaaaatgggtatttatttgtgcctctcaagcgtgtggcttggacatgatgttccgcatcgtggaagtggccgtgcaccaagtggaatatctgttactatagtaacagttcctttttattgataccagaataaacaggaatgcaaaggctgtctcacttgttggcacatttcagcagcctccgttcccaggggtttaagaaccgccctctagaggcagccctccttgctagtctgggacttcccggtggagtgaggaacccagcaacacgctcctgacttcccttcccaaggactcgacctgagaaccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagctggaaaaaccaccagagaaggaagaggatcacgcccccgagtttattaaagtcagggaaaacctgcggagaattgccacactgaccagcgaagagagagagctgtagggccagctgccgggctcaggccactgcccaccctggcctggacagcctccttcagcccttctgtacctggcaggccctgggacgtctgtgatgttcccacctgcttctgtagaaatgtgtcaccccagagggcctggctctccctgggaggctggggcccctaagctcctaggttttccttccaagcacccagccctcctgctccaagagggataacctgcacccctccctgcaaggggttcagagcccagcacaggagctttctctggcagaattgaggaggaagaggtggccctctgacttgacaagccttctgttctgcccaggccttcccaccaggaatctccgaggctccccagggccccgcttctccgtacaccccagctcctaggtctcagagaactcccccacctgtggttttacctgcagccagcagagcttagcttcaaggacacctgccttcaaagccactgaggggaggaagggcagggcagactgcaggtggccttgttgctggcatcccggccaggtgggcggggactaacaaagacagctgtttagggtcttctcccctcacccatgctttcatcatcccctccgcacagcctccccgtccaggccttctaaccacacctacccagggctgccgcattcctgcactcagaagtctgcagcggtgcctcacaaacttgattgtgcataaaaatcactggggatcttgttaatacagcttctaactcaatagatctgggagatcctgcatttctaacaagctcccaggtaaggcggaggctgctggtgtgaggaccatgctgtgagcagcagggcgagagtgcccagggctgatatatattggaaatatcacccctgaagccatcgctggcccccacctcctgtggactgatgccccagggattcccaccccacttctgcaaccccaggtatccttcattatccaccccatcccagactcccaccccagggattgcccgtgaagactttggcctagcaaattgtgttggttatgtgagtgttgttttaatcagagatgtacatgattgccaatctgcatttcttaccagtgtgaccacactgttacgatgcaattctagccaaaaaaaaaaaaaaaaaaaaaaaaaaattttttttttttactttttcctagtcttatggaaagcaaatatacaatgattttcagtaggcttctggaatagaaacagtggtttgaagaccccactgccacctttatggactggcccctttgagtctgaatccccggcctctgtcacctgagacccaacccctagctgggccaactccagtgaattcacccatttttcttcttcagaaggcctttcctgtgtgagacccacatattttaaccttttgctcctatcccatttttaaagaattagagaataaaccaggcctgtttcttttcccctgaaatccctgcctctggcttcctaaacccatcatctaaggtgacagagcagtgctggaatagcatctcctttcactttcccaaaactgccacagatagctgccactggcatgctctttgattcctggaagcaaacgtgggactgtcggaggaaagggattgttctggtcttactcataactgggtggtttgagggtgactgaagtcgtgcttttcctgtgtgtgctgccagcacagggctgtaaatgcagatattgcgcctgtgtgcgtgtgtataagtcaagctccaagaggctcctgaatgtgactggcgtgctgagaatgtgtttacgctgtttaatgtctgccaggtgagggttacactgaagatgcacaatccctaaaataaagatcaccacttccccaaagaagcagccctcgggtccatgtgttgttcagacatgtgaagagaagcaagacagagggtctcagatggacgagggctctccaagggaatgcctggggattcacccagtggtccccagaggtgctccatggaggcaacaagtcattccatgaagccccagaggtagaagggacctcaagcaccacgccctccagggcagccgtgcagacgaccttggttcacttttcaggggtcgtcccaactctgtatctccagccactccaactgtggaggctgtaaatccagattttcactgttccagtctcctttgcagcttaggatggctatgtgatcaggtgtggccaatgaaattgaagaggaagtctacctgggcttctgggaaagcttttccaataaaagacacaggcatggctaacacctccctgggcctcttcttcctaccttgattgagggtgtgatgcctggagccacagcagccactttgctaccatgacaaaaaggccaagagaatcacagagtcattgaccctatcattatttcaccaagccaataccagccgccatccttctccagaattcttgtaaataaaataaatccctctttgtttaaacca

SEQ ID NO: 63117 - DNA, 1011 bp, Homo sapiens
ggagtctgctctcagagtatctgctgtgggagagccccggaccccaagcatcttcaaaggtctattattaatggggctgtccagctgaagctgacatccgcacgcagccctcccagagctctgcacctcagccagcccacggcctccaccgtctggccctgtcggctgagtggtgcccagcaaggtgagaaggccaagtcctgcccgctgggccaggcagaggtcacccgccgcgcctgagctaccggtgtgtgatgagaggactgccccacgtcttccctcatttcccagctgcctcagtttcccttcctgagagaggcagggttctgggaggtgaggagctgcagggacccaagaagggcatagaagccgcctggggacactggcccctctgtcaggatcaatcgccctaagcctgtctgaggcgctccgggcttaggagcagctgtgaaagccgcctttgtgcctgggagaatgagccgcaagaggacagggggccctcgccccgggagccccttgggtcctggctcctgagatcaacgccagcagggaggaccccagcctggcccctgcagcccacccaggcctggtgcccacttcgtgccatgggagcagcccagggaagaagaaaaagaaatgaaggcccagacacgttacgccatttgcccaagaccacacagccagaagagagtggctgggatggacctatacctgccatctcttcacctgcatctgctgggaaccccatccctcagcactggggccatttccagctcctgcatcatagggcctccttgtcccctttcccatgaccaggccctgaaaatgctcccaccccaatcctgccagctcccccatctcctgagaaagtcccctctgagagccaagagtccctgcagatctcaggaaggtgtccaggggaaagagatgcatgcaaagccccattccagctctgccgactcactgcttattcattaataaaagaatgcccaggctattttgggcacctgt

SEQ ID NO: 63118 - DNA, 785 bp, Homo sapiens
agcggctttccccggcggcgtctcctcgcccgcccctccggccgccgccgtaacttgaccctcagcggggtttgggacttggggccgcgtcaccgtcgcggaggcgcttcggctccggactacgctcctgctgtgcgctcgcggggccagcagtgctggctctgcagtaggaggcgcgggggcatggcgcagaggctgggcgagtgggcccgggggccctccgatgccaccgggctctaccgggctgtgctgctccggtcggccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagctggaaaaaccaccagagaaggaagaggatcacgcccccgagtttattaaagtcagggaaaacctgcggagaattgccacactgaccagcgaagagagagagctgtagggccagctgccgggctcaggccactgcccaccctggcctggacagcctccttcagcccttctgtacctggcagccctgggccc

SEQ ID NO: 63119 - DNA, 397 bp, Homo sapiens
ctcaatagatctgggagatcctgcatttctaacaagctcccaggtaaggcggaggctgctggtgtgaggaccatgctgtgagcagcagggcgagagtgcccagggctgatatatattggaaatatcacccctgaagccatcgctggcccccacctcctgtggactgatgccccagggattcccaccccacttctgcaaccccaggtatccttcattatccaccccatcccagactcccaccccagggattgcccgtgaagactttggcctagcaaattgtgttggttatgtgagtgttgttttaatcagagatgtacatgattgccaatctgcatttcttaccagtgtgaccacactgttacgatgcaattctagccaaaaaaaaaaaaaaaaaaaa

SEQ ID NO: 63120 - DNA, 689 bp, Homo sapiens
gtaaagttccttgtgagaacttttcccccaaggttgtgaaggtttgcagggaaaacctcgaaggcaacacgctcctgacttcccttcccaaggactcgacctgagaaccgccatgtactcggagatccagagggagcgggcagacattgggggcctgatggcccggccagaatacagagagtggaatccggagctcatcaagcccaagaagctgctgaaccccgtgaaggcctctcggagtcaccacacccaagtgaaagtctttctccaaccctggggaggaaggccttttggctttccaattggaaaagccaaaccaggtaaagggggggccccttttgtggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagctggaaaaaccaccagagaaggaagaggatcacgcccccgagtttattaaagtcagggaaaacctgcggagaattgccacactgaccagcgaagagagagagctgtagggccagctgccgggctcaggccactgcccaccctggcctggacagcctccttcagcccttctgtacctggcagccctgggccc

SEQ ID NO: 63121 - DNA, 366 bp, Homo sapiens
ctgggctggggaagagggctgggctggggaagagggggaagaggtggccctctgacttgacaagccttctgttctgcccaggccttcccaccaggaatctccgaggctccccagggccccgcttctccgtacaccccagctcctaggtctcagagaactcccccacctgtggttttacctgcagccagcagagcttagcttcaaggacacctgccttcaaagccactgaggggaggaagggcagggcagactgcagatggccttgttgctggcatcccggccaggtgggcggggactaacaaagacagctgtttagggtcttctcccctcacccatgctttcatcatcccctccgcacagcctccc

SEQ ID NO: 63122 - DNA, 4067 bp, Homo sapiens
aggcatcgaactgcggtagtacgggttacggaatcactgtcgatgccctagctggatcaatgtttcgatctgatacgccagcttggcacgaggctgcctcaggaagcttggcttccctcccatgggaagtgctggaatccactcttgcctgaccctcccataagaaacaagggaaattcctttacgtgagccgccttgctcagaacaaagcttggcgtgtttcttattcctcatcaatctgacaaaatgggtatttatttgtgcctctcaagcgtgtggcttggacatgatgttccgcatcgtggaagtggccgtgcaccaagtggaatatctgttactatagtaacagttcctttttattgataccagaataaacaggaatgcaaaggctgtctcacttgttggcacatttcagcagcctccgttcccaggggtttaagaaccgccctctagaggcagccctccttgctagtctgggacttcccggtggagtgaggaacccagcaacacgctcctgacttcccttcccaaggactcgacctgagaaccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagctggaaaaaccaccagagaaggaagaggatcacgcccccgagtttattaaagtcagggaaaacctgcggagaattgccacactgaccagcgaagagagagagctgtagggccagctgccgggctcaggccactgcccaccctggcctggacagcctccttcagcccttctgtacctggcaggccctgggacgtctgtgatgttcccacctgcttctgtagaaatgtgtcaccccagagggcctggctctccctgggaggctggggcccctaagctcctaggttttccttccaagcacccagccctcctgctccaagagggataacctgcacccctccctgcaaggggttcagagcccagcacaggagctttctctggcagaattgaggaggaagaggtggccctctgacttgacaagccttctgttctgcccaggccttcccaccaggaatctccgaggctccccagggccccgcttctccgtacaccccagctcctaggtctcagagaactcccccacctgtggttttacctgcagccagcagagcttagcttcaaggacacctgccttcaaagccactgaggggaggaagggcagggcagactgcaggtggccttgttgctggcatcccggccaggtgggcggggactaacaaagacagctgtttagggtcttctcccctcacccatgctttcatcatcccctccgcacagcctccccgtccaggccttctaaccacacctacccagggctgccgcattcctgcactcagaagtctgcagcggtgcctcacaaacttgattgtgcataaaaatcactggggatcttgttaatacagcttctaactcaatagatctgggagatcctgcatttctaacaagctcccaggtaaggcggaggctgctggtgtgaggaccatgctgtgagcagcagggcgagagtgcccagggctgatatatattggaaatatcacccctgaagccatcgctggcccccacctcctgtggactgatgccccagggattcccaccccacttctgcaaccccaggtatccttcattatccaccccatcccagactcccaccccagggattgcccgtgaagactttggcctagcaaattgtgttggttatgtgagtgttgttttaatcagagatgtacatgattgccaatctgcatttcttaccagtgtgaccacactgttacgatgcaattctagccaaaaaaaaaaaaaaaaaaaaaaaaaaattttttttttttactttttcctagtcttatggaaagcaaatatacaatgattttcagtaggcttctggaatagaaacagtggtttgaagaccccactgccacctttatggactggcccctttgagtctgaatccccggcctctgtcacctgagacccaacccctagctgggccaactccagtgaattcacccatttttcttcttcagaaggcctttcctgtgtgagacccacatattttaaccttttgctcctatcccatttttaaagaattagagaataaaccaggcctgtttcttttcccctgaaatccctgcctctggcttcctaaacccatcatctaaggtgacagagcagtgctggaatagcatctcctttcactttcccaaaactgccacagatagctgccactggcatgctctttgattcctggaagcaaacgtgggactgtcggaggaaagggattgttctggtcttactcataactgggtggtttgagggtgactgaagtcgtgcttttcctgtgtgtgctgccagcacagggctgtaaatgcagatattgcgcctgtgtgcgtgtgtataagtcaagctccaagaggctcctgaatgtgactggcgtgctgagaatgtgtttacgctgtttaatgtctgccaggtgagggttacactgaagatgcacaatccctaaaataaagatcaccacttccccaaagaagcagccctcgggtccatgtgttgttcagacatgtgaagagaagcaagacagagggtctcagatggacgagggctctccaagggaatgcctggggattcacccagtggtccccagaggtgctccatggaggcaacaagtcattccatgaagccccagaggtagaagggacctcaagcaccacgccctccagggcagccgtgcagacgaccttggttcacttttcaggggtcgtcccaactctgtatctccagccactccaactgtggaggctgtaaatccagattttcactgttccagtctcctttgcagcttaggatggctatgtgatcaggtgtggccaatgaaattgaagaggaagtctacctgggcttctgggaaagcttttccaataaaagacacaggcatggctaacacctccctgggcctcttcttcctaccttgattgagggtgtgatgcctggagccacagcagccactttgctaccatgacaaaaaggccaagagaatcacagagtcattgaccctatcattatttcaccaagccaataccagccgccatccttctccagaattcttgtaaataaaataaatccctctttgtttaaaccaaaaaaaaaaaaaaaaaaaaaaaaaaaagaaaaaagaaaaaaaacgaaaaagaagaaaaagaaaaaaaagaggggggcggcggcgcaaaaaagtagtatcaccaggggggcgaccacacgacagacgcgaccgcagccacgttttcgctagcagaaagggcggcgcccacatgtgtggaggcgacacactaattagcaccgagaagcacatggcgcggccgtcatttttaacagagcgagcgtgggatgagggttggaaacaacgttgctgaccggggcgaaacttctatggtggaggaggaggaacacccttctatagtgcgctgagggcgcacacaacctaattgtggggaaaaaacctactccatcagagagagtaataatatagaggactccctggtagggcggcgaaagacctaaacaacaagcccaccaacggatgaggtctaacgtgcggtgttaaccacaacacgaggagcgaagaataatctgattgcatgggcgtgagcgtaaaaaaatgcatctttgtcgccgccaccaggaaggagtaagtaatgatgaagggaccacatttttttctaccaacggcggacagggagcagtaaataaagggggggg

SEQ ID NO: 63123 - DNA, 3425 bp, Homo sapiens
aggcatcgaactgcggtagtacgggttacggaatcactgtcgatgccctagctggatcaatgtttcgatctgatacgccagcttggcacgaggctgcctcaggaagcttggcttccctcccatgggaagtgctggaatccactcttgcctgaccctcccataagaaacaagggaaattcctttacgtgagccgccttgctcagaacaaagcttggcgtgtttcttattcctcatcaatctgacaaaatgggtatttatttgtgcctctcaagcgtgtggcttggacatgatgttccgcatcgtggaagtggccgtgcaccaagtggaatatctgttactatagtaacagttcctttttattgataccagaataaacaggaatgcaaaggctgtctcacttgttggcacatttcagcagcctccgttcccaggggtttaagaaccgccctctagaggcagccctccttgctagtctgggacttcccggtggagtgaggaacccagcaacacgctcctgacttcccttcccaaggactcgacctgagaaccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagctggaaaaaccaccagagaaggaagaggatcacgcccccgagtttattaaagtcagggaaaacctgcggagaattgccacactgaccagcgaagagagagagctgtagggccagctgccgggctcaggccactgcccaccctggcctggacagcctccttcagcccttctgtacctggcaggccctgggacgtctgtgatgttcccacctgcttctgtagaaatgtgtcaccccagagggcctggctctccctgggaggctggggcccctaagctcctaggttttccttccaagcacccagccctcctgctccaagagggataacctgcacccctccctgcaaggggttcagagcccagcacaggagctttctctggcagaattgaggaggaagaggtggccctctgacttgacaagccttctgttctgcccaggccttcccaccaggaatctccgaggctccccagggccccgcttctccgtacaccccagctcctaggtctcagagaactcccccacctgtggttttacctgcagccagcagagcttagcttcaaggacacctgccttcaaagccactgaggggaggaagggcagggcagactgcaggtggccttgttgctggcatcccggccaggtgggcggggactaacaaagacagctgtttagggtcttctcccctcacccatgctttcatcatcccctccgcacagcctccccgtccaggccttctaaccacacctacccagggctgccgcattcctgcactcagaagtctgcagcggtgcctcacaaacttgattgtgcataaaaatcactggggatcttgttaatacagcttctaactcaatagatctgggagatcctgcatttctaacaagctcccaggtaaggcggaggctgctggtgtgaggaccatgctgtgagcagcagggcgagagtgcccagggctgatatatattggaaatatcacccctgaagccatcgctggcccccacctcctgtggactgatgccccagggattcccaccccacttctgcaaccccaggtatccttcattatccaccccatcccagactcccaccccagggattgcccgtgaagactttggcctagcaaattgtgttggttatgtgagtgttgttttaatcagagatgtacatgattgccaatctgcatttcttaccagtgtgaccacactgttacgatgcaattctagccaaaaaaaaaaaaaaaaaaaaaaaaaaattttttttttttactttttcctagtcttatggaaagcaaatatacaatgattttcagtaggcttctggaatagaaacagtggtttgaagaccccactgccacctttatggactggcccctttgagtctgaatccccggcctctgtcacctgagacccaacccctagctgggccaactccagtgaattcacccatttttcttcttcagaaggcctttcctgtgtgagacccacatattttaaccttttgctcctatcccatttttaaagaattagagaataaaccaggcctgtttcttttcccctgaaatccctgcctctggcttcctaaacccatcatctaaggtgacagagcagtgctggaatagcatctcctttcactttcccaaaactgccacagatagctgccactggcatgctctttgattcctggaagcaaacgtgggactgtcggaggaaagggattgttctggtcttactcataactgggtggtttgagggtgactgaagtcgtgcttttcctgtgtgtgctgccagcacagggctgtaaatgcagatattgcgcctgtgtgcgtgtgtataagtcaagctccaagaggctcctgaatgtgactggcgtgctgagaatgtgtttacgctgtttaatgtctgccaggtgagggttacactgaagatgcacaatccctaaaataaagatcaccacttccccaaagaagcagccctcgggtccatgtgttgttcagacatgtgaagagaagcaagacagagggtctcagatggacgagggctctccaagggaatgcctggggattcacccagtggtccccagaggtgctccatggaggcaacaagtcattccatgaagccccagaggtagaagggacctcaagcaccacgccctccagggcagccgtgcagacgaccttggttcacttttcaggggtcgtcccaactctgtatctccagccactccaactgtggaggctgtaaatccagattttcactgttccagtctcctttgcagcttaggatggctatgtgatcaggtgtggccaatgaaattgaagaggaagtctacctgggcttctgggaaagcttttccaataaaagacacaggcatggctaacacctccctgggcctcttcttcctaccttgattgagggtgtgatgcctggagccacagcagccactttgctaccatgacaaaaagtcacacaggatcaaagaatgaccgacgactaccgaatacggcccggaccataccccgccgccaacatcggacgagattgttgtgaatt

SEQ ID NO: 63124 - DNA, 3398 bp, Homo sapiens
aggcatcgaactgcggtagtacgggttacggaatcactgtcgatgccctagctggatcaatgtttcgatctgatacgccagcttggcacgaggctgcctcaggaagcttggcttccctcccatgggaagtgctggaatccactcttgcctgaccctcccataagaaacaagggaaattcctttacgtgagccgccttgctcagaacaaagcttggcgtgtttcttattcctcatcaatctgacaaaatgggtatttatttgtgcctctcaagcgtgtggcttggacatgatgttccgcatcgtggaagtggccgtgcaccaagtggaatatctgttactatagtaacagttcctttttattgataccagaataaacaggaatgcaaaggctgtctcacttgttggcacatttcagcagcctccgttcccaggggtttaagaaccgccctctagaggcagccctccttgctagtctgggacttcccggtggagtgaggaacccagcaacacgctcctgacttcccttcccaaggactcgacctgagaaccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagctggaaaaaccaccagagaaggaagaggatcacgcccccgagtttattaaagtcagggaaaacctgcggagaattgccacactgaccagcgaagagagagagctgtagggccagctgccgggctcaggccactgcccaccctggcctggacagcctccttcagcccttctgtacctggcaggccctgggacgtctgtgatgttcccacctgcttctgtagaaatgtgtcaccccagagggcctggctctccctgggaggctggggcccctaagctcctaggttttccttccaagcacccagccctcctgctccaagagggataacctgcacccctccctgcaaggggttcagagcccagcacaggagctttctctggcagaattgaggaggaagaggtggccctctgacttgacaagccttctgttctgcccaggccttcccaccaggaatctccgaggctccccagggccccgcttctccgtacaccccagctcctaggtctcagagaactcccccacctgtggttttacctgcagccagcagagcttagcttcaaggacacctgccttcaaagccactgaggggaggaagggcagggcagactgcaggtggccttgttgctggcatcccggccaggtgggcggggactaacaaagacagctgtttagggtcttctcccctcacccatgctttcatcatcccctccgcacagcctccccgtccaggccttctaaccacacctacccagggctgccgcattcctgcactcagaagtctgcagcggtgcctcacaaacttgattgtgcataaaaatcactggggatcttgttaatacagcttctaactcaatagatctgggagatcctgcatttctaacaagctcccaggtaaggcggaggctgctggtgtgaggaccatgctgtgagcagcagggcgagagtgcccagggctgatatatattggaaatatcacccctgaagccatcgctggcccccacctcctgtggactgatgccccagggattcccaccccacttctgcaaccccaggtatccttcattatccaccccatcccagactcccaccccagggattgcccgtgaagactttggcctagcaaattgtgttggttatgtgagtgttgttttaatcagagatgtacatgattgccaatctgcatttcttaccagtgtgaccacactgttacgatgcaattctagccaaaaaaaaaaaaaaaaaaaaaaaaaaattttttttttttactttttcctagtcttatggaaagcaaatatacaatgattttcagtaggcttctggaatagaaacagtggtttgaagaccccactgccacctttatggactggcccctttgagtctgaatccccggcctctgtcacctgagacccaacccctagctgggccaactccagtgaattcacccatttttcttcttcagaaggcctttcctgtgtgagacccacatattttaaccttttgctcctatcccatttttaaagaattagagaataaaccaggcctgtttcttttcccctgaaatccctgcctctggcttcctaaacccatcatctaaggtgacagagcagtgctggaatagcatctcctttcactttcccaaaactgccacagatagctgccactggcatgctctttgattcctggaagcaaacgtgggactgtcggaggaaagggattgttctggtcttactcataactgggtggtttgagggtgactgaagtcgtgcttttcctgtgtgtgctgccagcacagggctgtaaatgcagatattgcgcctgtgtgcgtgtgtataagtcaagctccaagaggctcctgaatgtgactggcgtgctgagaatgtgtttacgctgtttaatgtctgccaggtgagggttacactgaagatgcacaatccctaaaataaagatcaccacttccccaaagaagcagccctcgggtccatgtgttgttcagacatgtgaagagaagcaagacagagggtctcagatggacgagggctctccaagggaatgcctggggattcacccagtggtccccagaggtgctccatggaggcaacaagtcattccatgaagccccaccttggttcacttttcaggggtcgtcccaactctgtatctccagccactccaactgtggaggctgtaaatccagattttcactgttccagtctcctttgcagcttaggatggctatgtgatcaggtgtggccaatgaaattgaagaggaagtctacctgggcttctgggaaagcttttccaataaaagacacaggcatggctaacacctccctgggcctcttcttcctaccttgattgagggtgtgatgcctggagccacagcagccactttgctaccatgacaaaaaggccaagagaatcacagagtcattgaccctatcattatttcaccaagccaataccagccgccatccttctccagaattcttgtaaataaaataaatccctctttgtttaaacca

SEQ ID NO: 63125 - DNA, 734 bp, Homo sapiens
gatgtgacaggcgctgcaacagtggtgccggcagcagtgcgagggctaccgcgacgtgaatatctagcaacatggccacgtcgttccgcgacggcctggctttctgcgccatcctgcaccgccaccggcccgacctcataaacttcagtgctctcaagaaggaaaatatttatgaaaacaataaactggccttccgcgtggccgaggagcacttgggcatcccagccttgctggatgccgaggacatggtggccttgaaggtgcctgaccggctgagcatcttgacctacgtgtcccagtattacaactacttccacggctgccatagacgaccttggttcacttttcaggggtcgtcccaactctgtatctccagccactccaactgtggaggctgtaaatccagattttcactgttccagtctcctttgcagcttaggatggctatgtgatcaggtgtggccaatgaaattgaagaggaagtctacctgggcttctgggaaagcttttccaataaaagacacaggcatggctaacacctccctgggcctcttcttcctaccttgattgagggtgtgatgcctggagccacagcagccactttgctaccatgacaaaaaggccaagagaatcacagagtcattgaccctatcattatttcaccaagccaataccagccgccatccttctccagaattcttgtaaataaaataaatccctctttgtttaaacca

SEQ ID NO: 63126 - DNA, 1192 bp, Homo sapiens
ggagtctgctctcagagtatctgctgtgggagagccccggaccccaagcatcttcaaaggtctattattaatggggctgtccagctgaagctgacatccgcacgcagccctcccagagctctgcacctcagccagcccacggcctccaccgtctggccctgtcggctgagtggtgcccagcaaggtgagaaggccaagtcctgcccgctgggccaggcagaggtcacccgccgcgcctgagctaccggtgtgtgatgagaggactgccccacgtcttccctcatttcccagctgcctcagtttcccttcctgagagaggcagggttctgggaggtgaggagctgcagggacccaagaagggcatagaagccgcctggggacactggcccctctgtcaggatcaatcgccctaagcctgtctgaggcgctccgggcttaggagcagctgtgaaagccgcctttgtgcctgggagaatgagccgcaagaggacagggggccctcgccccgggagccccttgggtcctggctcctgagatcaacgccagcagggaggaccccagcctggcccctgcagcccacccaggcctggtgcccacttcgtgccatgggagcagcccagggaagaagaaaacatactctcctcaggccagatttcatagtgaaaatgagaagcagagacgaaatggctcagccgccatgtactcggagatccagagggagcgggcagacattgggggcctgatggcccggccagaatacagagagtggaatccggagctcatcaagcccaagaagctgctgaaccccgtgaaggcctctcggagtcaccactcccaggtaaggcggaggctgctggtgtgaggaccatgctgtgagcagcagggcgagagtgcccagggctgatatatattggaaatatcacccctgaagccatcgctggcccccacctcctgtggactgatgccccagggattcccaccccacttctgcaaccccaggtatccttcattatccaccccatcccagactcccaccccagggattgcccgtgaagactttggcctagcaaattgtgttggttatgtgagtgttgttttaatcagagatgtacatgattgccaatctgcatttcttaccagtgtgaccacactgttacgatgcaattctagccaaaaaaaaaaaaaaaaaaaa

SEQ ID NO: 63127 - DNA, 3548 bp, Homo sapiens
aggcatcgaactgcggtagtacgggttacggaatcactgtcgatgccctagctggatcaatgtttcgatctgatacgccagcttggcacgaggctgcctcaggaagcttggcttccctcccatgggaagtgctggaatccactcttgcctgaccctcccataagaaacaagggaaattcctttacgtgagccgccttgctcagaacaaagcttggcgtgtttcttattcctcatcaatctgacaaaatgggtatttatttgtgcctctcaagcgtgtggcttggacatgatgttccgcatcgtggaagtggccgtgcaccaagtggaatatctgttactatagtaacagttcctttttattgataccagaataaacaggaatgcaaaggctgtctcacttgttggcacatttcagcagcctccgttcccaggggtttaagaaccgccctctagaggcagccctccttgctagtctgggacttcccggtggagtgaggaacccagcaacacgctcctgacttcccttcccaaggactcgacctgagaaggacacagcagtctctgaatttcatgctctcctctttgatgtgaagaaaatgaaaagctgaacagttgtggaactgtggatagagttagacaataaggccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagctggaaaaaccaccagagaaggaagaggatcacgcccccgagtttattaaagtcagggaaaacctgcggagaattgccacactgaccagcgaagagagagagctgtagggccagctgccgggctcaggccactgcccaccctggcctggacagcctccttcagcccttctgtacctggcaggccctgggacgtctgtgatgttcccacctgcttctgtagaaatgtgtcaccccagagggcctggctctccctgggaggctggggcccctaagctcctaggttttccttccaagcacccagccctcctgctccaagagggataacctgcacccctccctgcaaggggttcagagcccagcacaggagctttctctggcagaattgaggaggaagaggtggccctctgacttgacaagccttctgttctgcccaggccttcccaccaggaatctccgaggctccccagggccccgcttctccgtacaccccagctcctaggtctcagagaactcccccacctgtggttttacctgcagccagcagagcttagcttcaaggacacctgccttcaaagccactgaggggaggaagggcagggcagactgcaggtggccttgttgctggcatcccggccaggtgggcggggactaacaaagacagctgtttagggtcttctcccctcacccatgctttcatcatcccctccgcacagcctccccgtccaggccttctaaccacacctacccagggctgccgcattcctgcactcagaagtctgcagcggtgcctcacaaacttgattgtgcataaaaatcactggggatcttgttaatacagcttctaactcaatagatctgggagatcctgcatttctaacaagctcccaggtaaggcggaggctgctggtgtgaggaccatgctgtgagcagcagggcgagagtgcccagggctgatatatattggaaatatcacccctgaagccatcgctggcccccacctcctgtggactgatgccccagggattcccaccccacttctgcaaccccaggtatccttcattatccaccccatcccagactcccaccccagggattgcccgtgaagactttggcctagcaaattgtgttggttatgtgagtgttgttttaatcagagatgtacatgattgccaatctgcatttcttaccagtgtgaccacactgttacgatgcaattctagccaaaaaaaaaaaaaaaaaaaaaaaaaaattttttttttttactttttcctagtcttatggaaagcaaatatacaatgattttcagtaggcttctggaatagaaacagtggtttgaagaccccactgccacctttatggactggcccctttgagtctgaatccccggcctctgtcacctgagacccaacccctagctgggccaactccagtgaattcacccatttttcttcttcagaaggcctttcctgtgtgagacccacatattttaaccttttgctcctatcccatttttaaagaattagagaataaaccaggcctgtttcttttcccctgaaatccctgcctctggcttcctaaacccatcatctaaggtgacagagcagtgctggaatagcatctcctttcactttcccaaaactgccacagatagctgccactggcatgctctttgattcctggaagcaaacgtgggactgtcggaggaaagggattgttctggtcttactcataactgggtggtttgagggtgactgaagtcgtgcttttcctgtgtgtgctgccagcacagggctgtaaatgcagatattgcgcctgtgtgcgtgtgtataagtcaagctccaagaggctcctgaatgtgactggcgtgctgagaatgtgtttacgctgtttaatgtctgccaggtgagggttacactgaagatgcacaatccctaaaataaagatcaccacttccccaaagaagcagccctcgggtccatgtgttgttcagacatgtgaagagaagcaagacagagggtctcagatggacgagggctctccaagggaatgcctggggattcacccagtggtccccagaggtgctccatggaggcaacaagtcattccatgaagccccagaggtagaagggacctcaagcaccacgccctccagggcagccgtgcagacgaccttggttcacttttcaggggtcgtcccaactctgtatctccagccactccaactgtggaggctgtaaatccagattttcactgttccagtctcctttgcagcttaggatggctatgtgatcaggtgtggccaatgaaattgaagaggaagtctacctgggcttctgggaaagcttttccaataaaagacacaggcatggctaacacctccctgggcctcttcttcctaccttgattgagggtgtgatgcctggagccacagcagccactttgctaccatgacaaaaaggccaagagaatcacagagtcattgaccctatcattatttcaccaagccaataccagccgccatccttctccagaattcttgtaaataaaataaatccctctttgtttaaacca

SEQ ID NO: 63128 - DNA, 534 bp, Homo sapiens
gacgggagtctatctccaagactcgacctgagaaccgccatgtactcggagatccagagggagcgggcagacattgggggcctgatggcccggccagaatacagagagtggaatccggagctcatcaagcccaagaagctgctgaaccccgtgaaggcctctcggagtcaccactcccaggtaaggcggaggctgctggtgtgaggaccatgctgtgagcagcagggcgagagtgcccagggctgatatatattggaaatatcacccctgaagccatcgctggcccccacctcctgtggactgatgccccagggattcccaccccacttctgcaaccccaggtatccttcattatccaccccatcccagactcccaccccagggattgcccgtgaagactttggcctagcaaattgtgttggttatgtgagtgttgttttaatcagagatgtacatgattgccaatctgcatttcttaccagtgtgaccacactgttacgatgcaattctagccaaaaaaaaaaaaaaaaaaaa

SEQ ID NO: 63129 - DNA, 3396 bp, Homo sapiens
aggcatcgaactgcggtagtacgggttacggaatcactgtcgatgccctagctggatcaatgtttcgatctgatacgccagcttggcacgaggctgcctcaggaagcttggcttccctcccatgggaagtgctggaatccactcttgcctgaccctcccataagaaacaagggaaattcctttacgtgagccgccttgctcagaacaaagcttggcgtgtttcttattcctcatcaatctgacaaaatgggtatttatttgtgcctctcaagcgtgtggcttggacatgatgttccgcatcgtggaagtggccgtgcaccaagtggaatatctgttactatagtaacagttcctttttattgataccagaataaacaggaatgcaaaggctgtctcacttgttggcacatttcagcagcctccgttcccaggggtttaagaaccgccctctagaggcagccctccttgctagtctgggacttcccggtggagtgaggaacccagcaacacgctcctgacttcccttcccaaggactcgacctgagaaccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagctggaaaaaccaccagagaaggaagaggatcacgcccccgagtttattaaagtcagggaaaacctgcggagaattgccacactgaccagcgaagagagagagctgtagggccagctgccgggctcaggccactgcccaccctggcctggacagcctccttcagcccttctgtacctggcaggccctgggacgtctgtgatgttcccacctgcttctgtagaaatgtgtcaccccagagggcctggctctccctgggaggctggggcccctaagctcctaggttttccttccaagcacccagccctcctgctccaagagggataacctgcacccctccctgcaaggggttcagagcccagcacaggagctttctctggcagaattgaggaggaagaggtggccctctgacttgacaagccttctgttctgcccaggccttcccaccaggaatctccgaggctccccagggccccgcttctccgtacaccccagctcctaggtctcagagaactcccccacctgtggttttacctgcagccagcagagcttagcttcaaggacacctgccttcaaagccactgaggggaggaagggcagggcagactgcaggtggccttgttgctggcatcccggccaggtgggcggggactaacaaagacagctgtttagggtcttctcccctcacccatgctttcatcatcccctccgcacagcctccccgtccaggccttctaaccacacctacccagggctgccgcattcctgcactcagaagtctgcagcggtgcctcacaaacttgattgtgcataaaaatcactggggatcttgttaatacagcttctaactcaatagatctgggagatcctgcatttctaacaagctcccaggtaaggcggaggctgctggtgtgaggaccatgctgtgagcagcagggcgagagtgcccagggctgatatatattggaaatatcacccctgaagccatcgctggcccccacctcctgtggactgatgccccagggattcccaccccacttctgcaaccccaggtatccttcattatccaccccatcccagactcccaccccagggattgcccgtgaagactttggcctagcaaattgtgttggttatgtgagtgttgttttaatcagagatgtacatgattgccaatctgcatttcttaccagtgtgaccacactgttacgatgcaattctagccaaaaaaaaaaaaaaaaaaaaaaaaaaattttttttttttactttttcctagtcttatggaaagcaaatatacaatgattttcagtaggcttctggaatagaaacagtggtttgaagaccccactgccacctttatggactggcccctttgagtctgaatccccggcctctgtcacctgagacccaacccctagctgggccaactccagtgaattcacccatttttcttcttcagaaggcctttcctgtgtgagacccacatattttaaccttttgctcctatcccatttttaaagaattagagaataaaccaggcctgtttcttttcccctgaaatccctgcctctggcttcctaaacccatcatctaaggtgacagagcagtgctggaatagcatctcctttcactttcccaaaactgccacagatagctgccactggcatgctctttgattcctggaagcaaacgtgggactgtcggaggaaagggattgttctggtcttactcataactgggtggtttgagggtgactgaagtcgtgcttttcctgtgtgtgctgccagcacagggctgtaaatgcagatattgcgcctgtgtgcgtgtgtataagtcaagctccaagaggctcctgaatgtgactggcgtgctgagaatgtgtttacgctgtttaatgtctgccaggtgagggttacactgaagatgcacaatccttcagacatgtgaagagaagcaagacagagggtctcagatggacgagggctctccaagggaatgcctggggattcacccagtggtccccagaggtgctccatggaggcaacaagtcattccatgaagccccagaggtagaagggacctcaagcaccacgccctccagggcagccgtgcagacgaccttggttcacttttcaggggtcgtcccaactctgtatctccagccactccaactgtggaggctgtaaatccagattttcactgttccagtctcctttgcagcttaggatggctatgtgatcaggtgtggccaatgaaattgaagaggaagtctacctgggcttctgggaaagcttttccaataaaagacacaggcatggctaacacctccctgggcctcttcttcctaccttgattgagggtgtgatgcctggagccacagcagccactttgctaccatgacaaaaaggccaagagaatcacagagtcattgaccctatcattatttcaccaagccaataccagccgccatccttctccagaattcttgtaaataaaataaatccctctttgtttaaacca

SEQ ID NO: 63130 - DNA, 3431 bp, Homo sapiens
aggcatcgaactgcggtagtacgggttacggaatcactgtcgatgccctagctggatcaatgtttcgatctgatacgccagcttggcacgaggctgcctcaggaagcttggcttccctcccatgggaagtgctggaatccactcttgcctgaccctcccataagaaacaagggaaattcctttacgtgagccgccttgctcagaacaaagcttggcgtgtttcttattcctcatcaatctgacaaaatgggtatttatttgtgcctctcaagcgtgtggcttggacatgatgttccgcatcgtggaagtggccgtgcaccaagtggaatatctgttactatagtaacagttcctttttattgataccagaataaacaggaatgcaaaggctgtctcacttgttggcacatttcagcagcctccgttcccaggggtttaagaaccgccctctagaggcagccctccttgctagtctgggacttcccggtggagtgaggaacccagcaacacgctcctgacttcccttcccaaggactcgacctgagaaccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagctggaaaaaccaccagagaaggaagaggatcacgcccccgagtttattaaagtcagggaaaacctgcggagaattgccacactgaccagcgaagagagagagctgtagggccagctgccgggctcaggccactgcccaccctggcctggacagcctccttcagcccttctgtacctggcaggccctgggacgtctgtgatgttcccacctgcttctgtagaaatgtgtcaccccagagggcctggctctccctgggaggctggggcccctaagctcctaggttttccttccaagcacccagccctcctgctccaagagggataacctgcacccctccctgcaaggggttcagagcccagcacaggagctttctctggcagaattgaggaggaagaggtggccctctgacttgacaagccttctgttctgcccaggccttcccaccaggaatctccgaggctccccagggccccgcttctccgtacaccccagctcctaggtctcagagaactcccccacctgtggttttacctgcagccagcagagcttagcttcaaggacacctgccttcaaagccactgaggggaggaagggcagggcagactgcaggtggccttgttgctggcatcccggccaggtgggcggggactaacaaagacagctgtttagggtcttctcccctcacccatgctttcatcatcccctccgcacagcctccccgtccaggccttctaaccacacctacccagggctgccgcattcctgcactcagaagtctgcagcggtgcctcacaaacttgattgtgcataaaaatcactggggatcttgttaatacagcttctaactcaatagatctgggagatcctgcatttctaacaagctcccaggtaaggcggaggctgctggtgtgaggaccatgctgtgagcagcagggcgagagtgcccagggctgatatatattggaaatatcacccctgaagccatcgctggcccccacctcctgtggactgatgccccagggattcccaccccacttctgcaaccccaggtatccttcattatccaccccatcccagactcccaccccagggattgcccgtgaagactttggcctagcaaattgtgttggttatgtgagtgttgttttaatcagagatgtacatgattgccaatctgcatttcttaccagtgtgaccacactgttacgatgcaattctagccaaaaaaaaaaaaaaaaaaaaaaaaaaattttttttttttactttttcctagtcttatggaaagcaaatatacaatgattttcagtaggcttctggaatagaaacagtggtttgaagaccccactgccacctttatggactggcccctttgagtctgaatccccggcctctgtcacctgagacccaacccctagctgggccaactccagtgaattcacccatttttcttcttcagaaggcctttcctgtgtgagacccacatattttaaccttttgctcctatcccatttttaaagaattagagaataaaccaggcctgtttcttttcccctgaaatccctgcctctggcttcctaaacccatcatctaaggtgacagagcagtgctggaatagcatctcctttcactttcccaaaactgccacagatagctgccactggcatgctctttgattcctggaagcaaacgtgggactgtcggaggaaagggattgttctggtcttactcataactgggtggtttgagggtgactgaagtcgtgcttttcctgtgtgtgctgccagcacagggctgtaaatgcagatattgcgcctgtgtgcgtgtgtataagtcaagctccaagaggctcctgaatgtgactggcgtgctgagaatgtgtttacgctgtttaatgtctgccaggtgagggttacactgaagatgcacaatccctaaaataaagatcaccacttccccaaagaagcagccctcgggtccatgtgttgttcagacatgtgaagagaagcaagacagagggtctcagatggacgagggctctccaagggaatgcctggggattcacccagtggtccccagaggtgctccatggaggcaacaagtcattccatgaagccccagaggtagaagggacctcaagcaccacgccctccagggcagccgtgcagacgaccttggttcacttttcaggggtcgtcccaactctgtatctccagccactccaactgtggaggctgtaaatccagattttcactgttccagtctcctttgcagcttaggatggctatgtgatcaggtgtggccaatgaaattgaagaggaagtctacctgggcttctgggaaagcttttccaataaaagacacaggcatggctaacacctccctgggcctcttcttcctaccttgattgagggtgtgatgcctggagccacagcagccactttgctaccatgacaaaaaggccaagagaatcacagagtcattgaccctatcattatttcaccaagccaataccagccgccattgggctgccattcgggccggctgccattggg

SEQ ID NO: 63131 - DNA, 3595 bp, Homo sapiens
ggagtctgctctcagagtatctgctgtgggagagccccggaccccaagcatcttcaaaggtctattattaatggggctgtccagctgaagctgacatccgcacgcagccctcccagagctctgcacctcagccagcccacggcctccaccgtctggccctgtcggctgagtggtgcccagcaaggtgagaaggccaagtcctgcccgctgggccaggcagaggtcacccgccgcgcctgagctaccggtgtgtgatgagaggactgccccacgtcttccctcatttcccagctgcctcagtttcccttcctgagagaggcagggttctgggaggtgaggagctgcagggacccaagaagggcatagaagccgcctggggacactggcccctctgtcaggatcaatcgccctaagcctgtctgaggcgctccgggcttaggagcagctgtgaaagccgcctttgtgcctgggagaatgagccgcaagaggacagggggccctcgccccgggagccccttgggtcctggctcctgagatcaacgccagcagggaggaccccagcctggcccctgcagcccacccaggcctggtgcccacttcgtgccatgggagcagcccagggaagaagaaaacatactctcctcaggccagatttcatagtgaaaatgagaagcagagacgaaatggctcagccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagctggaaaaaccaccagagaaggaagaggatcacgcccccgagtttattaaagtcagggaaaacctgcggagaattgccacactgaccagcgaagagagagagctgtagggccagctgccgggctcaggccactgcccaccctggcctggacagcctccttcagcccttctgtacctggcaggccctgggacgtctgtgatgttcccacctgcttctgtagaaatgtgtcaccccagagggcctggctctccctgggaggctggggcccctaagctcctaggttttccttccaagcacccagccctcctgctccaagagggataacctgcacccctccctgcaaggggttcagagcccagcacaggagctttctctggcagaattgaggaggaagaggtggccctctgacttgacaagccttctgttctgcccaggccttcccaccaggaatctccgaggctccccagggccccgcttctccgtacaccccagctcctaggtctcagagaactcccccacctgtggttttacctgcagccagcagagcttagcttcaaggacacctgccttcaaagccactgaggggaggaagggcagggcagactgcaggtggccttgttgctggcatcccggccaggtgggcggggactaacaaagacagctgtttagggtcttctcccctcacccatgctttcatcatcccctccgcacagcctccccgtccaggccttctaaccacacctacccagggctgccgcattcctgcactcagaagtctgcagcggtgcctcacaaacttgattgtgcataaaaatcactggggatcttgttaatacagcttctaactcaatagatctgggagatcctgcatttctaacaagctcccaggtaaggcggaggctgctggtgtgaggaccatgctgtgagcagcagggcgagagtgcccagggctgatatatattggaaatatcacccctgaagccatcgctggcccccacctcctgtggactgatgccccagggattcccaccccacttctgcaaccccaggtatccttcattatccaccccatcccagactcccaccccagggattgcccgtgaagactttggcctagcaaattgtgttggttatgtgagtgttgttttaatcagagatgtacatgattgccaatctgcatttcttaccagtgtgaccacactgttacgatgcaattctagccaaaaaaaaaaaaaaaaaaaaaaaaaaattttttttttttactttttcctagtcttatggaaagcaaatatacaatgattttcagtaggcttctggaatagaaacagtggtttgaagaccccactgccacctttatggactggcccctttgagtctgaatccccggcctctgtcacctgagacccaacccctagctgggccaactccagtgaattcacccatttttcttcttcagaaggcctttcctgtgtgagacccacatattttaaccttttgctcctatcccatttttaaagaattagagaataaaccaggcctgtttcttttcccctgaaatccctgcctctggcttcctaaacccatcatctaaggtgacagagcagtgctggaatagcatctcctttcactttcccaaaactgccacagatagctgccactggcatgctctttgattcctggaagcaaacgtgggactgtcggaggaaagggattgttctggtcttactcataactgggtggtttgagggtgactgaagtcgtgcttttcctgtgtgtgctgccagcacagggctgtaaatgcagatattgcgcctgtgtgcgtgtgtataagtcaagctccaagaggctcctgaatgtgactggcgtgctgagaatgtgtttacgctgtttaatgtctgccaggtgagggttacactgaagatgcacaatccctaaaataaagatcaccacttccccaaagaagcagccctcgggtccatgtgttgttcagacatgtgaagagaagcaagacagagggtctcagatggacgagggctctccaagggaatgcctggggattcacccagtggtccccagaggtgctccatggaggcaacaagtcattccatgaagccccagaggtagaagggacctcaagcaccacgccctccagggcagccgtgcagacgaccttggttcacttttcaggggtcgtcccaactctgtatctccagccactccaactgtggaggctgtaaatccagattttcactgttccagtctcctttgcagcttaggatggctatgtgatcaggtgtggccaatgaaattgaagaggaagtctacctgggcttctgggaaagcttttccaataaaagacacaggcatggctaacacctccctgggcctcttcttcctaccttgattgagggtgtgatgcctggagccacagcagccactttgctaccatgacaaaaaggccaagagaatcacagagtcattgaccctatcattatttcaccaagccaataccagccgccatccttctccagaattcttgtaaataaaataaatccctctttgtttaaacca

SEQ ID NO: 63132 - DNA, 1288 bp, Homo sapiens
aggcatcgaactgcggtagtacgggttacggaatcactgtcgatgccctagctggatcaatgtttcgatctgatacgccagcttggcacgaggctgcctcaggaagcttggcttccctcccatgggaagtgctggaatccactcttgcctgaccctcccataagaaacaagggaaattcctttacgtgagccgccttgctcagaacaaagcttggcgtgtttcttattcctcatcaatctgacaaaatgggtatttatttgtgcctctcaagcgtgtggcttggacatgatgttccgcatcgtggaagtggccgtgcaccaagtggaatatctgttactatagtaacagttcctttttattgataccagaataaacaggaatgcaaaggctgtctcacttgttggcacatttcagcagcctccgttcccaggggtttaagaaccgccctctagaggcagccctccttgctagtctgggacttcccggtggagtgaggaacccagcaacacgctcctgacttcccttcccaaggactcgacctgagaaccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccaggtgggtgatgggcacccagcagggaccacgcatcctccagggctgtcctccagggaggagctctgctgtggccacagctagtaagagggaagaggatcggcggacagagcactggactgagagtccactcctggcctgagtcctccctctgccattcactttgctaggtccttagggcgagtgcttccctgaacctcagcttcctcactggcccagtgtactgcatgctgattctgatttcattcttataactgtcttgtgagccaggtggcattcccattttagagatggggaagctgaggcccagagggggtgagtgatttgaaccaggctgcacaaggagaactcagtctcatgctctgtgccccagctaccaggctgatagcaaaactcatccccaggttggttc

SEQ ID NO: 63133 - DNA, 485 bp, Homo sapiens
cctgactttaggtgatctgcccacctcggccttccaaagtgctaggattacaggtgtgagccaccgtgcccagcccaaatatacttattttttaaacattttttatttcttgtcattattttcaaatgtctgttttatttcttaaagcatattaagtatatttattgtatagtttacttctgatatttctagtatctgcaagtctgtgaaagtgtgatgttgttgtctgctatttcctctggctcttacttggtgtgccttttgcctagtatactttgtctttgtgtgttgggaggggagttcatgttctttagaatgttatctgcaggattttttgagaactggttaaagttggtgtccttcagaaaggattttcttttacttcgattgcctgggaggactaccagttctctctgtgattgtttttttttttttttcttgtcatgctttccacttccactgcatttctcactggctcaactata

SEQ ID NO: 63134 - DNA, 1011 bp, Homo sapiens
ggcagccaccgagccgagtcaccgccctgcgccgccagcccaggccccgcagcctacgtcgggcgcagacgctcccctggcggggcgggcgggggctgccaggagaatcaccagtacccgcctcctcgccccgcatcctcgggcctgagcgcccgcccaccggcacgcggaggggcttcctggaacgattaggcggaccgtcgcccccaggctcctttctcccctggcggagtttctgcccgctgcgatcttctctaactaccactctgcggtcgcagaagaccatccagaggggagatgaggactgggaagcccgcttgagtgatgcacatctgtggcttgttacgagagccgcgtgaattaaagcaaggcaggggacaccgccctgccactgctttctaaccttgattttcatctttccttctcggatggaatctagaagccgcaggagttttcacttgcgtctgtgatggagtttcccgctccccgcccccccgcaccaacccgagctcttttttcgcttggagcccgtaagttgctagagggcaccacgatggctctaggagcgctgtcggtgttttcttctggaggtgatcctgaaatttcctccccaaagcaagctctgttgcgaggagcaggctggggatatgtgcaagtgaatgtgtattccaagagggggatgatacgcagatcttttggtgtataggaattaatacttttagattatcagtaaaatgtatactttcactggactgagagagaacaaggcttacggttacatcaaccggatcaacaaatatttattgtacttgtaatgagtaatacttagtctattatataaacataaatggaaccataaaaaaaaaaaaaaaaaaaaaaaaaaaaagggggggggcaaaaaatcccagggggccaagttagggcccgtttttggaaagggggccaaagaggggtaaaaaaggagggcgcgtaaaaggggggggaaaggcagggattgggagaccatcgggg

SEQ ID NO: 63135 - DNA, 2052 bp, Homo sapiens
  misc_feature (405)..(405): n is a, c, g, or t
cgggattggtatcaaaggcttccactgccttctgctgaaggcatgatgtatgcggctccacttgagaccaggtatcaggatgttcagagggagccagctctttatgttggccccaggccagtactaagcaaattaaaaagaccgacatgggcttcctccctcatatcatttcattctaaagcagcaagcttgtcatacccatggggtcctatgttgatagaaatggagaggtagggatacagtttattctccaaaaatggactgcccacttccatgctgagtgatgctcagggaagtgatgcccgcagaaggcgtctgggcctaaggatccatggaagtcaggagcattaaatcccaaaccaaatcaactccagatatatcagtgtcaaaagcccaagaaaaganaaaaaagaaaaaaacaatccccaggggttctatgaccctattgactcctacagttctttcccttctcttggcaatggaagctccagtacccagattggagattaggatgagacaactttgtgtatatgtgcacgtgtgtggtgtgtgtgtgttttattaaggactaagatacacacttatctattctgtctccttctagcttttaggcagcctactcttggaaactggaggaaactgccctgagaattattagaatgctaataatagtaattggtaacattaacaatcagtgttagacaacagtgaggcatatcatgtgtttttattaaaaatgataaagatgtgtttcttctcatctaaaggaggtaactttgtgataattagtttgattaaaagtttgaagtatgaggactccttgttatgcctttaaggtaatttttaaaaaaaatctgagtagagatagtactaatattggcaagaaggtccccaggatagacctagcaaggagataagaatagatcattaaaaaataaatataaatggattggatagaattcccattcagctgttttaacacagaaattcaaaatagtgacttaacatggaagctatttctctcttacttaaaggcaaactggttttacagctctggtgtgtgatgttaccagacgcctaggccctctcctgttgctctgtcatcctaatgtgctgcatccacctcatggaccaagatggctgccacagctcctgccatcacatttacatttaagatagtagagaggaagtggagggaagttgcacatattgcttccagtcacatctcatgggttaaaacctagacatttgccacatctagctgcaaagaaggctagggaatgtctttattattgattgtcatgtgccttgataagcataggaggttctgttattaaagaaacaatgtgaaataatgtggaaattaatactgataaagactatcagtatctgatacaaaagggaaccaaacgatatttaagtgctttttaatgtcacttacttcatcatatgttttgcgaaagataagactaaaattcatcactttgtgtagcatttaatggttttcagaacatttttgcatgtgctgtctcatttggtcctcattacattcttgtgtgctaaataggacctctattcattacaccacttgctagtttgggatggagagtcagatatgttgaaagatttcccaacgactctaatttatgagcaagaaagttgcttagagccccagccttttgacttcatagtctttccgactactttatgcagctcagcatcagtactgggattgggaactgcaagaatatgaaatgtaaatctttattgatttatatccttccttaccttttttgacatggaaaatgccaaagacactggtcaagtttactctcagctccctacctccagtgagggggcctcttattaggaatgaaatatccaagagatgggcggtgctgcaggggagaccaaaactcagaggaggcattcaaacacttctagcaggttgtctactccatccaactcaaaacctattcaatatgaaggccgagggaatgtgctcacaactccctattaagggaaatcaatataaacccgcccccaccaacc

SEQ ID NO: 63136 - DNA, 3777 bp, Homo sapiens
  misc_feature (405)..(405): n is a, c, g, or t
cgggattggtatcaaaggcttccactgccttctgctgaaggcatgatgtatgcggctccacttgagaccaggtatcaggatgttcagagggagccagctctttatgttggccccaggccagtactaagcaaattaaaaagaccgacatgggcttcctccctcatatcatttcattctaaagcagcaagcttgtcatacccatggggtcctatgttgatagaaatggagaggtagggatacagtttattctccaaaaatggactgcccacttccatgctgagtgatgctcagggaagtgatgcccgcagaaggcgtctgggcctaaggatccatggaagtcaggagcattaaatcccaaaccaaatcaactccagatatatcagtgtcaaaagcccaagaaaaganaaaaaagaaaaaaacaatccccaggggttctatgaccctattgactcctacagttctttcccttctcttggcaatggaagctccagtacccagattggagattaggatgagacaactttgtgtatatgtgcacgtgtgtggtgtgtgtgtgttttattaaggactaagatacacacttatctattctgtctccttctagcttttaggcagcctactcttggaaactggaggaaactgccctgagaattattagaatgctaataatagtaattggtaacattaacaatcagtgttagacaacagtgaggcatatcatgtgtttttattaaaaatgataaagatgtgtttcttctcatctaaaggaggtaactttgtgataattagtttgattaaaagtttgaagtatgaggactccttgttatgcctttaaggtaatttttaaaaaaaatctgagtagagatagtactaatattggcaagaaggtccccaggatagacctagcaaggagataagaatagatcattaaaaaataaatataaatggattggatagaattcccattcagctgttttaacacagaaattcaaaatagtgacttaacatggaagctatttctctcttacttaaaggcaaactggttttacagctctggtgtgtgatgttaccagacgcctaggccctctcctgttgctctgtcatcctaatgtgctgcatccacctcatggaccaagatggctgccacagctcctgccatcacatttacatttaagatagtagagaggaagtggagggaagttgcacatattgcttccagtcacatctcatgggttaaaacctagacatttgccacatctagctgcaaagaaggctagggaatgtctttattattgattgtcatgtgccttgataagcataggaggttctgttattaaagaaacaatgtgaaataatgtggaaattaatactgataaagactatcagtatctgatacaaaagggaaccaaacgatatttaagtgctttttaatgtcacttacttcatcatatgttttgcgaaagataagactaaaattcatcactttgtgtagcatttaatggttttcagaacatttttgcatgtgctgtctcatttggtcctcattacattcttgtgtgctaaataggacctctattcattacaccacttgctagtttgggatggagagtcagatatgttgaaagatttcccaacgactctaatttatgagcaagaaagttgcttagagccccagccttttgacttcatagtctttccgactactttatgcagctcagcatcagtactgggattgggaactgcaagaatatgaaatgtaaatctttattgatttatatccttccttaccttttttgacatggaaaatgccaaagacactggtcaagtttactctcagctccctacctccagtgagggggcctcttattaggaatgaaatatccaagagatgggcggtgctgcaggggagaccaaaactcagaggaggcattcaaacacttctagcaggttgtctactccatccaactcaaaacctattcaatatgaaggccgagggaatgtgctcacaactccctattaagggaaatcaatataaacccgcccccaccaaccaaaaaaaaaaaaagaaagaaaactctccctttttaatgtcttcttccccaggctcctggtactttgtcagcaacatactgctttcattcttaaaggtttcattggctgttaaatgagtccctttgcatactcactggagagaggaaatgctttaagttgtcctaagataacatctgcacacagagagtttatctgattccttatcaaccatgatctctatctgaggtcctgtatagtgggatcatttagagatgggggttagggagagtaggagtaactctagagaaaattgtggctcctaaaggaggcagatctttccaaggtggaaaggtaatgaattaaatatatgacatgtaatactgaaaaaatagaaaaatgactaagatacagtctctgtcctctagaactagggcagcctggaaacatatggactataattattttagctatttaaaagaaatgaatgaagaggatcttgagacaggaccagagcattggaatggttgtagggactgaaagctgagttggaaggatcagatcaaagagaaagctgggttggacttacacaagaataccctgatctgatcgcagctgtgactccaaggttttcctttcccatagttgctgtgaccccattggtcaccagagcaactgcatgtcttcaggctgggtattagggctggctgggtctgatgattctacccattttgtgccatctgaggagcatgcgagggttctttctccaaggcactttcggccttccttcttctccccttccgccatctccactggacataagccaatgcctgctctcttctcaccacattcacctggacaaatctgaactaattccttgagacttcaaattagcccttctgagcaagtgggcaggttctgaaacctgtgtgttttgtagcctaatgaattgatggaatgcacatgaacccatcttcacagcatgtgaaagaaccaacctgcctggcagaggtgcagaaatttccagaggactggcctagctataaacaccagcaacatctgcaacacaaaagcccttgaacttctaggcaaggactcatgctaacctagcagtactccagattgagaacgcagatggacaggtgtctcttgagcctgtgttccaagatgtctgtggaaaggattgcaactgtcatcctttggcacactcagtggaacctgtgtgagctacatgttctgctgcattatgggaactcatcaaagggccagattgacatcttgccagaaaaaccagtgttttgaggagcaaaagttttgtgtacttcagtaattgtcacatgtgtcttccacctccttgacatttatttgttaatcatatgatcatttttttttcactttcctttttttctttctcagaagtacttctggggctttgattgcattatttctcttttaatgtatcatttcagtgttggaaagaaaaatctggatctttatgtggggacctattttacatgtagatagttattcagtagatagtaaattatttctcttaagagatatttccttttatttctgtacaataatatgtatgaactcagttactaggggactgtattgtgacattatcaacctttattgctatttaaaaatgatagtttgtagaactgaagatttccattgatgtgaagcacaatttaatgaataagttaaaatattaaactgttgtgatgtcaagagaaaaaaaat

SEQ ID NO: 63137 - DNA, 565 bp, Homo sapiens
atgatcatatgattaacaaataaatgtcaaggaggtggaagacacatgtgacaattactgaagatttccattaaattgtgcttcacatcaatggaaatcttcagttctacaaactatcatttttaaatagcaataaaggttgataattgtcacatgtgtcttccacctccttgacatttatttgttaatcatatgatcatttttttttcactttcctttttttctttctcagaagtacttctggggctttgattgcattatttctcttttaatgtatcatttcagtgttggaaagaaaaatctggatctttatgtggggacctattttacatgtagatagttattcagtagatagtaaattatttctcttaagagatatttccttttatttctgtacaataatatgtatgaactcagttactaggggactgtattgtgacattatcaacctttattgctatttaaaaatgatagtttgtagaactgaagatttccattgatgtgaagcacaatttaatgaataagttaaaatattaaactgttgtgatgtcaagagaaaaaaaat

SEQ ID NO: 63138 - DNA, 2802 bp, Homo sapiens
  misc_feature (1405)..(1405): n is a, c, g, or t
  misc_feature (1565)..(1567): n is a, c, g, or t
  misc_feature (1917)..(1917): n is a, c, g, or t
  misc_feature (1946)..(1946): n is a, c, g, or t
  misc_feature (1950)..(1950): n is a, c, g, or t
  misc_feature (1999)..(1999): n is a, c, g, or t
taggtttcaattgtaaagagagagaagtggataaatcagtgctgctttctttaggacgaaagaagtatggagcagtgggatcactttcacaatcaacaggaggacactgatagctgctccgaatctgtgaaatttgatgctcgctcaatgacagctttgcttcctccgaatcctaaaaacagcccttcccttcaagagaaactgaagtccttcaaagctgcactgattgccctttacctcctcgtgtttgcagttctcatccctctcattggaatagtggcagctcaactcctgaagtgggaaacgaagaattgctcagttagttcaactaatgcaaatgatataactcaaagtctcacgggaaaaggaaatgacagcgaagaggaaatgagatttcaagaagtctttatggaacacatgagcaacatggagaagagaatccagcatattttagacatggaagccaacctcatggacacagagcatttccaaaatttcagcatgacaactgatcaaagatttaatgacattcttctgcagctaagtaccttgttttcctcagtccagggacatgggaatgcaatagatgaaatctccaagtccttaataagtttgaataccacattgcttgatttgcagctcaacatagaaaatctgaatggcaaaatccaagagaataccttcaaacaacaagaggaaatcagtaaattagaggagcgtgtttacaatgtatcagcagaaattatggctatgaaagaagaacaagtgcatttggaacaggaaataaaaggagaagtgaaagtactgaataacatcactaatgatctcagactgaaagattgggaacattctcagaccttgagaaatatcactttaattcaaggtcctcctggacccccgggtgaaaaaggagatcgaggtcccactggagaaagtggtccacgaggatttccaggtccaataggtcctccgggtcttaaaggtgatcggggagcaattggctttcctggaagtcgaggactcccaggatatgccggaaggccaggaaattctggaccaaaaggccagaaaggggaaaaggggagtggaaacacattaagaccagtacaactcactgatcatattagggcagggccctcttaagatcaggtgggttgggcgggacatcctctgctaccatctcattaaaaggcccttcacctctggacaagtcatctgcaacaactgacttccaagatccttttgtgactcctccaaatgactttggttcccgtgttgtacctgacttccacatggccttctctcctggtccctggtgctgtttgggcctctgctcccatgctcatacctcttcttactccaattactccaccatcacctctctcccctatcacccccagcctgnacacctctcatgcacggactggagggctgctccaaccagtcctcagttctctgccacccattgacctagagtcttgaacccaatttaatttattgggttctaggagaactgctgtgttctcaccctaacttggaagagtgatgtttcagtcaagcaaagnnnttcctaccatacaatataacacttgtgtgaggctctgtcctaaatatctcaattaccaatatgtggtttggtagtatttctcgccatgctttgctcatgcgcaatgagactaccactagggtgtaaattttaagtatcccatctaaaactcatacaatgataggaaaaatccatttgtttttcatttgatttttactgaggaatcagctcaatcttcaatgaatactggtctctttccaaagcatttttgatcaaagtaaagactgagtcaagggctttttttttttctttttcttgttttaagagacagagccttgctctattgcacaggctggactacacgcattcanctagagtctagaacacaatttaatttatngggntctaggagaactgtcatgagtattgataatatgagagttctttatattnaaacattattctcaaccagagatagggatgtcatagaagaaaatccattcattcaatcattaattcattaattcacatgtccattatgtacctccatgagctggacataacagctaataagagataattgtctctggttttacagagctaattgtccctaagagatgtagacaaatgaacaagcaattacaatacatctaagctatactgggggaggaacagggctggataggtatgcagaggagataaaaaaattttaattccttagaatattttttaaaaattgattcttattttaccttctcatcttcttattttccaaattacagcatatatatatatttttttaagttttgaagtgtagtcgagcttgggcaatttatccaacccatttaaaccaaaaataaaacttttcatgtattacctggtcatttcaaacaaaaatattttgatcatgaaaaagaataccaatattcttttgttctaaaaatctcttatgggattacatgttatatttttggtttctctctactgatcaacagactacattttcacaactcttctttcctttacgttttaacacacagacccaagattcatactattaagattctagtagaactctagatggtatgcctctgtgtatctcagcatttttattcccactcttgtataatgaacatgttaacacctacctcacagggttgttgtgaggatcaagtaagatattgtgtgtgtgaagatgctctgtgaaatcataaagtcctttaaagatgtaaggtatgcttcgcagtgatctctct

SEQ ID NO: 63139 - DNA, 3639 bp, Homo sapiens
  misc_feature (15)..(15): n is a, c, g, or t
  misc_feature (66)..(66): n is a, c, g, or t
  misc_feature (149)..(149): n is a, c, g, or t
  misc_feature (2301)..(2301): n is a, c, g, or t
gcacgagctcagggntatagaacagccgccttcagctattctcccccagggctctgcagaaccttnccacctttcagcaggctggagtgcagtggcatgatcgtgactcactgcagccttccactcctgggctcaagcaatcctactgnctcaggctcccagaagtatggagcagtgggatcactttcacaatcaacaggaggacactgatagctgctccgaatctgtgaaatttgatgctcgctcaatgacagctttgcttcctccgaatcctaaaaacagcccttcccttcaagagaaactgaagtccttcaaagctgcactgattgccctttacctcctcgtgtttgcagttctcatccctctcattggaatagtggcagctcaactcctgaagtgggaaacgaagaattgctcagttagttcaactaatgcaaatgatataactcaaagtctcacgggaaaaggaaatgacagcgaagaggaaatgagatttcaagaagtctttatggaacacatgagcaacatggagaagagaatccagcatattttagacatggaagccaacctcatggacacagagcatttccaaaatttcagcatgacaactgatcaaagatttaatgacattcttctgcagctaagtaccttgttttcctcagtccagggacatgggaatgcaatagatgaaatctccaagtccttaataagtttgaataccacattgcttgatttgcagctcaacatagaaaatctgaatggcaaaatccaagagaataccttcaaacaacaagaggaaatcagtaaattagaggagcgtgtttacaatgtatcagcagaaattatggctatgaaagaagaacaagtgcatttggaacaggaaataaaaggagaagtgaaagtactgaataacatcactaatgatctcagactgaaagattgggaacattctcagaccttgagaaatatcactttaattcaaggtcctcctggacccccgggtgaaaaaggagatcgaggtcccactggagaaagtggtccacgaggatttccaggtccaataggtcctccgggtcttaaaggtgatcggggagcaattggctttcctggaagtcgaggactcccaggatatgccggaaggccaggaaattctggaccaaaaggccagaaaggggaaaaggggagtggaaacacattaagtactggtccaatatggctgaatgaagtgttttgttttgggagagaatcatctattgaagaatgtaaaattcggcaatgggggacaagagcctgttcacattctgaagatgctggagtcacttgcactttataatgcatcatattttcattcacaactatgaaatcgctgctcaaaaatgattttattaccttgttcctgtaaaatccatttaatcaatatttaagagattaagaatattgcccaaataatattttagattacaggattaatatattgaacaccttcatgcttactattttatgtctatatttaaatcattttaacttctataggtttttaaatggaattttctaatataatgacttatatgctgaattgaacattttgaagtttatagcttccagattacaaaggccaagggtaatagaaatgcataccagtaattggctccaattcataatatgttcaccaggagattacaattttttgctcttcttgtctttgtaatctatttagttgattttaattactttctgaataacggaagggatcagaagatatcttttgtgcctagattgcaaaatctccaatccacacatattgttttaaaataagaatgttatccaactattaagatatctcaatgtgcaataacttgtgtattagatatcaatgttaatgatatgtcttggccactatggaccagggagcttatttttcttgtcatgtactgacaactgtttaattgaatcatgaagtaaattgaaagcaggacatatgagaaaactgaccatcagtatatttgtccagataattggtggatcaaaaatgccacttaacaggaagtttagtttgttatgcactttaaatggaataattagcttgttacaattctaggacatggtgtttaaaatttaaatctgattaatccattttaacaaacaatgcaaacatcttcagtgcagaaggaagagtggtttcaactgtttggagtcttttatgaagtcagtcaacatttacaaccaaagggcgggggggggggggggtgcgtctttagtcctaaagggacaataactctgagcatgccccaaaaaagtagnttagcaaccttttgttggtagtcaacccatccccagggccatagtgtagagtgtgaaaagctaccctgaaacccagtaattctaccctgaaagtgactgcctgcagaaagaccagcagttgatattaaagcgcaaatgaattcaacctcagccctgaaaataacagaattctgaagtttcctatgactaattcacaaaaaaagtaattgtaaactagtactattatggaattactctactgttctttctttaatagtggcaaatgaaagcataagcttaagcattttttcatattctgaagtctcaccacacataataaccaagtggtagactcacagccgtccaacttaaaaaggcaaaaccttaccttggaattggaattactgtaaacagcctactgaaaatgcatttttatcatgtaacattcttctacttgtttaacattgctgattttctctggcagcataattttgtggttaagagaatgaattctgaatgtacactttctgtctcaaaccctggctgtaatttcagctagttaataattctttgtgttcagttccactatctaggtattttcttcaaaaggtaaatacaatggtttctgaaagaatcatttgcattatcagcctgtttgggatgtctgagatcagtgcctctgggttgttaatactgtattgctgtatggtatatgtatgctgatttactacttatgcgtaagtggtatgcatgggatgtctgaaatcagtgcctatgggttgtcaatagtattaactattagtgttaactgttagtattaactattagtattattaacactaataatagtactattactattactatttttattttaaaataaaatttacctttaaaataataatagtactattgctagtactagtactattgctattactagtactattactagtactagtactatgacactgttaatagtactattaacaacccataggcacttgggatgtctgagatcagtgcctatgggttgttaatactatattgctgtatggtatatgcatgctgatttaccacttatgcatagatatatctttaataagtaatctaaaaatcctttttgtatttgagagaatctactaagttcagtccagtcaagaaaagaacctaatagcaccaatacaaattgaggacttaatttactttggaatgttgaattgcatttgttccattaaaaaaaacagaaatttgcgatttggtttttttgaaaaaatagctcagctgaccagaatgaatgtattctacttgttgagccatccagcatcacgttaaatgcaaaatgtatatataaataaa

SEQ ID NO: 63140 - DNA, 3002 bp, Homo sapiens
  misc_feature (2390)..(2390): n is a, c, g, or t
taggtttcaattgtaaagagagagaagtggataaatcagtgctgctttctttaggacgaaagaagtatggagcagtgggatcactttcacaatcaacaggaggacactgatagctgctccgaatctgtgaaatttgatgctcgctcaatgacagctttgcttcctccgaatcctaaaaacagcccttcccttcaagagaaactgaagtccttcaaagctgcactgattgccctttacctcctcgtgtttgcagttctcatccctctcattggaatagtggcagctcaactcctgaagtgggaaacgaagaattgctcagttagttcaactaatgcaaatgatataactcaaagtctcacgggaaaaggaaatgacagcgaagaggaaatgagatttcaagaagtctttatggaacacatgagcaacatggagaagagaatccagcatattttagacatggaagccaacctcatggacacagagcatttccaaaatttcagcatgacaactgatcaaagatttaatgacattcttctgcagctaagtaccttgttttcctcagtccagggacatgggaatgcaatagatgaaatctccaagtccttaataagtttgaataccacattgcttgatttgcagctcaacatagaaaatctgaatggcaaaatccaagagaataccttcaaacaacaagaggaaatcagtaaattagaggagcgtgtttacaatgtatcagcagaaattatggctatgaaagaagaacaagtgcatttggaacaggaaataaaaggagaagtgaaagtactgaataacatcactaatgatctcagactgaaagattgggaacattctcagaccttgagaaatatcactttaattcaaggtcctcctggacccccgggtgaaaaaggagatcgaggtcccactggagaaagtggtccacgaggatttccaggtccaataggtcctccgggtcttaaaggtgatcggggagcaattggctttcctggaagtcgaggactcccaggatatgccggaaggccaggaaattctggaccaaaaggccagaaaggggaaaaggggagtggaaacacattaactccatttacgaaagttcgactggtcggtgggagcggccctcacgaggggagagtggagatactccacagcggccagtggggtacaatttgtgacgatcgctgggaagtgcgcgttggacaggtcgtctgtaggagcttgggatacccaggtgttcaagccgtgcacaaggcagctcactttggacaaggtactggtccaatatggctgaatgaagtgttttgttttgggagagaatcatctattgaagaatgtaaaattcggcaatgggggacaagagcctgttcacattctgaagatgctggagtcacttgcactttataatgcatcatattttcattcacaactatgaaatcgctgctcaaaaatgattttattaccttgttcctgtaaaatccatttaatcaatatttaagagattaagaatattgcccaaataatattttagattacaggattaatatattgaacaccttcatgcttactattttatgtctatatttaaatcattttaacttctataggtttttaaatggaattttctaatataatgacttatatgctgaattgaacattttgaagtttatagcttccagattacaaaggccaagggtaatagaaatgcataccagtaattggctccaattcataatatgttcaccaggagattacaattttttgctcttcttgtctttgtaatctatttagttgattttaattactttctgaataacggaagggatcagaagatatcttttgtgcctagattgcaaaatctccaatccacacatattgttttaaaataagaatgttatccaactattaagatatctcaatgtgcaataacttgtgtattagatatcaatgttaatgatatgtcttggccactatggaccagggagcttatttttcttgtcatgtactgacaactgtttaattgaatcatgaagtaaattgaaagcaggacatatgagaaaactgaccatcagtatatttgtccagataattggtggatcaaaaatgccacttaacaggaagtttagtttgttatgcactttaaatggaataattagcttgttacaattctaggacatggtgtttaaaatttaaatctgattaatccattttaacaaacaatgcaaacatcttcagtgcagaaggaagagtggtttcaactgtttggagtcttttatgaagtcagtcaacatttacaaccaaagggcgggggggggggggggtgcgtctttagtcctaaagggacaataactctgagcatgccccaaaaaagtagnttagcaaccttttgttggtagtcaacccatccccagggccatagtgtagagtgtgaaaagctaccctgaaacccagtaattctaccctgaaagtgactgcctgcagaaagaccagcagttgatattaaagcgcaaatgaattcaacctcagccctgaaaataacagaattctgaagtttcctatgactaattcacaaaaaaagtaattgtaaactagtactattatggaattactctactgttctttctttaatagtggcaaatgaaagcataagcttaagcattttttcatattctgaagtctcaccacacataataaccaagtggtagactcacagccgtccaacttaaaaaggcaaaaccttaccttggaattggaattactgtaaacagcctactgaaaatgcatttttatcatgtaacattcttctacttgtttaacattgctgattttctctggcagcataattttgtggttaagagaatgaattctgaatgtacactttctgtctcaaaccctggctgtaatttcagctagttaataattctttgtgttcagttccactatctaggtattttcttcaaaaggtaaatacaatggtttctgaaaga

SEQ ID NO: 63141 - DNA, 2699 bp, Homo sapiens
  misc_feature (1405)..(1405): n is a, c, g, or t
  misc_feature (1565)..(1567): n is a, c, g, or t
  misc_feature (1917)..(1917): n is a, c, g, or t
  misc_feature (1946)..(1946): n is a, c, g, or t
  misc_feature (1950)..(1950): n is a, c, g, or t
  misc_feature (1999)..(1999): n is a, c, g, or t
taggtttcaattgtaaagagagagaagtggataaatcagtgctgctttctttaggacgaaagaagtatggagcagtgggatcactttcacaatcaacaggaggacactgatagctgctccgaatctgtgaaatttgatgctcgctcaatgacagctttgcttcctccgaatcctaaaaacagcccttcccttcaagagaaactgaagtccttcaaagctgcactgattgccctttacctcctcgtgtttgcagttctcatccctctcattggaatagtggcagctcaactcctgaagtgggaaacgaagaattgctcagttagttcaactaatgcaaatgatataactcaaagtctcacgggaaaaggaaatgacagcgaagaggaaatgagatttcaagaagtctttatggaacacatgagcaacatggagaagagaatccagcatattttagacatggaagccaacctcatggacacagagcatttccaaaatttcagcatgacaactgatcaaagatttaatgacattcttctgcagctaagtaccttgttttcctcagtccagggacatgggaatgcaatagatgaaatctccaagtccttaataagtttgaataccacattgcttgatttgcagctcaacatagaaaatctgaatggcaaaatccaagagaataccttcaaacaacaagaggaaatcagtaaattagaggagcgtgtttacaatgtatcagcagaaattatggctatgaaagaagaacaagtgcatttggaacaggaaataaaaggagaagtgaaagtactgaataacatcactaatgatctcagactgaaagattgggaacattctcagaccttgagaaatatcactttaattcaaggtcctcctggacccccgggtgaaaaaggagatcgaggtcccactggagaaagtggtccacgaggatttccaggtccaataggtcctccgggtcttaaaggtgatcggggagcaattggctttcctggaagtcgaggactcccaggatatgccggaaggccaggaaattctggaccaaaaggccagaaaggggaaaaggggagtggaaacacattaagaccagtacaactcactgatcatattagggcagggccctcttaagatcaggtgggttgggcgggacatcctctgctaccatctcattaaaaggcccttcacctctggacaagtcatctgcaacaactgacttccaagatccttttgtgactcctccaaatgactttggttcccgtgttgtacctgacttccacatggccttctctcctggtccctggtgctgtttgggcctctgctcccatgctcatacctcttcttactccaattactccaccatcacctctctcccctatcacccccagcctgnacacctctcatgcacggactggagggctgctccaaccagtcctcagttctctgccacccattgacctagagtcttgaacccaatttaatttattgggttctaggagaactgctgtgttctcaccctaacttggaagagtgatgtttcagtcaagcaaagnnnttcctaccatacaatataacacttgtgtgaggctctgtcctaaatatctcaattaccaatatgtggtttggtagtatttctcgccatgctttgctcatgcgcaatgagactaccactagggtgtaaattttaagtatcccatctaaaactcatacaatgataggaaaaatccatttgtttttcatttgatttttactgaggaatcagctcaatcttcaatgaatactggtctctttccaaagcatttttgatcaaagtaaagactgagtcaagggctttttttttttctttttcttgttttaagagacagagccttgctctattgcacaggctggactacacgcattcanctagagtctagaacacaatttaatttatngggntctaggagaactgtcatgagtattgataatatgagagttctttatattnaaacattattctcaaccagagatagggatgtcatagaagaaaatccattcattcaatcattaattcattaattcacatgtccattatgtacctccatgagctggacataacagctaataagagataattgtctctggttttacagagctaattgtccctaagagatgtagacaaatgaacaagcaattacaatacatctaagctatactgggggaggaacagggctggataggtatgcagaggagataaaaaaattttaattccttagaatattttttaaaaattgattcttattttaccttctcatcttcttattttccaaattacagcatatatatatatttttttaagttttgaagtgtagtcgagcttgggcaatttatccaacccatttaaaccaaaaataaaacttttcatgtattacctggtcatttcaaacaaaaatattttgatcatgaaaaagaataccaatattcttttgttctaaaaatctcttatgggattacatgttatatttttggtttctctctactgatcaacagactacattttcacaactcttctttcctttacgttttaacacacagacccaagattcatactattaagattctagtagaactctagatggtatgcctctgtgtatctcagctctgttagacaataaaatcttgaaattgccaggtaacgggagatcctc

SEQ ID NO: 63142 - DNA, 1865 bp, Homo sapiens
  misc_feature (468)..(468): n is a, c, g, or t
  misc_feature (628)..(630): n is a, c, g, or t
  misc_feature (980)..(980): n is a, c, g, or t
  misc_feature (1009)..(1009): n is a, c, g, or t
  misc_feature (1013)..(1013): n is a, c, g, or t
  misc_feature (1062)..(1062): n is a, c, g, or t
gattttttccttagtgactggaggccagtttcaatccactgaagcacagattccaaattttcaatctggttttcttgagtagtgactgagtgccaaaaatgaagcaatgacacaacatcaccatcaagacactccccagcgatgggagtggaaacacattaagaccagtacaactcactgatcatattagggcagggccctcttaagatcaggtgggttgggcgggacatcctctgctaccatctcattaaaaggcccttcacctctggacaagtcatctgcaacaactgacttccaagatccttttgtgactcctccaaatgactttggttcccgtgttgtacctgacttccacatggccttctctcctggtccctggtgctgtttgggcctctgctcccatgctcatacctcttcttactccaattactccaccatcacctctctcccctatcacccccagcctgnacacctctcatgcacggactggagggctgctccaaccagtcctcagttctctgccacccattgacctagagtcttgaacccaatttaatttattgggttctaggagaactgctgtgttctcaccctaacttggaagagtgatgtttcagtcaagcaaagnnnttcctaccatacaatataacacttgtgtgaggctctgtcctaaatatctcaattaccaatatgtggtttggtagtatttctcgccatgctttgctcatgcgcaatgagactaccactagggtgtaaattttaagtatcccatctaaaactcatacaatgataggaaaaatccatttgtttttcatttgatttttactgaggaatcagctcaatcttcaatgaatactggtctctttccaaagcatttttgatcaaagtaaagactgagtcaagggctttttttttttctttttcttgttttaagagacagagccttgctctattgcacaggctggactacacgcattcanctagagtctagaacacaatttaatttatngggntctaggagaactgtcatgagtattgataatatgagagttctttatattnaaacattattctcaaccagagatagggatgtcatagaagaaaatccattcattcaatcattaattcattaattcacatgtccattatgtacctccatgagctggacataacagctaataagagataattgtctctggttttacagagctaattgtccctaagagatgtagacaaatgaacaagcaattacaatacatctaagctatactgggggaggaacagggctggataggtatgcagaggagataaaaaaattttaattccttagaatattttttaaaaattgattcttattttaccttctcatcttcttattttccaaattacagcatatatatatatttttttaagttttgaagtgtagtcgagcttgggcaatttatccaacccatttaaaccaaaaataaaacttttcatgtattacctggtcatttcaaacaaaaatattttgatcatgaaaaagaataccaatattcttttgttctaaaaatctcttatgggattacatgttatatttttggtttctctctactgatcaacagactacattttcacaactcttctttcctttacgttttaacacacagacccaagattcatactattaagattctagtagaactctagatggtatgcctctgtgtatctcagcatttttattcccactcttgtataatgaacatgttaacacctacctcacagggttgttgtgaggatcaagtaagatattgtgtgtgtgaagatgctctgtgaaatcataaagtcctttaaagatgtaaggtatgcttcgcagtgatctctct

SEQ ID NO: 63143 - DNA, 408 bp, Homo sapiens
taggtttcaattgtaaagagagagaagtggataaatcagtgctgctttctttaggacgaaagaagtatggagcagtgggatcactttcacaatcaacaggaggacactgatagctgctccgaatctgtgaaatttgatgctcgctcaatgacagctttgcttcctccgaatcctaaaaacagcccttcccttcaagagaaactgaagtccttcaaagctgcactgattgccctttacctcctcgtgtttgcagttctcatccctctcattggaatagtggcagctcaactcctgaagtgggaaacgaagaattgctcagttattcgagaccagtctggccaacatagtgaaaccccatctctacaaaattaaacacttgaacccaggaggtggaggttgcagggagcc

SEQ ID NO: 63144 - DNA, 3728 bp, Homo sapiens
  misc_feature (2390)..(2390): n is a, c, g, or t
taggtttcaattgtaaagagagagaagtggataaatcagtgctgctttctttaggacgaaagaagtatggagcagtgggatcactttcacaatcaacaggaggacactgatagctgctccgaatctgtgaaatttgatgctcgctcaatgacagctttgcttcctccgaatcctaaaaacagcccttcccttcaagagaaactgaagtccttcaaagctgcactgattgccctttacctcctcgtgtttgcagttctcatccctctcattggaatagtggcagctcaactcctgaagtgggaaacgaagaattgctcagttagttcaactaatgcaaatgatataactcaaagtctcacgggaaaaggaaatgacagcgaagaggaaatgagatttcaagaagtctttatggaacacatgagcaacatggagaagagaatccagcatattttagacatggaagccaacctcatggacacagagcatttccaaaatttcagcatgacaactgatcaaagatttaatgacattcttctgcagctaagtaccttgttttcctcagtccagggacatgggaatgcaatagatgaaatctccaagtccttaataagtttgaataccacattgcttgatttgcagctcaacatagaaaatctgaatggcaaaatccaagagaataccttcaaacaacaagaggaaatcagtaaattagaggagcgtgtttacaatgtatcagcagaaattatggctatgaaagaagaacaagtgcatttggaacaggaaataaaaggagaagtgaaagtactgaataacatcactaatgatctcagactgaaagattgggaacattctcagaccttgagaaatatcactttaattcaaggtcctcctggacccccgggtgaaaaaggagatcgaggtcccactggagaaagtggtccacgaggatttccaggtccaataggtcctccgggtcttaaaggtgatcggggagcaattggctttcctggaagtcgaggactcccaggatatgccggaaggccaggaaattctggaccaaaaggccagaaaggggaaaaggggagtggaaacacattaactccatttacgaaagttcgactggtcggtgggagcggccctcacgaggggagagtggagatactccacagcggccagtggggtacaatttgtgacgatcgctgggaagtgcgcgttggacaggtcgtctgtaggagcttgggatacccaggtgttcaagccgtgcacaaggcagctcactttggacaaggtactggtccaatatggctgaatgaagtgttttgttttgggagagaatcatctattgaagaatgtaaaattcggcaatgggggacaagagcctgttcacattctgaagatgctggagtcacttgcactttataatgcatcatattttcattcacaactatgaaatcgctgctcaaaaatgattttattaccttgttcctgtaaaatccatttaatcaatatttaagagattaagaatattgcccaaataatattttagattacaggattaatatattgaacaccttcatgcttactattttatgtctatatttaaatcattttaacttctataggtttttaaatggaattttctaatataatgacttatatgctgaattgaacattttgaagtttatagcttccagattacaaaggccaagggtaatagaaatgcataccagtaattggctccaattcataatatgttcaccaggagattacaattttttgctcttcttgtctttgtaatctatttagttgattttaattactttctgaataacggaagggatcagaagatatcttttgtgcctagattgcaaaatctccaatccacacatattgttttaaaataagaatgttatccaactattaagatatctcaatgtgcaataacttgtgtattagatatcaatgttaatgatatgtcttggccactatggaccagggagcttatttttcttgtcatgtactgacaactgtttaattgaatcatgaagtaaattgaaagcaggacatatgagaaaactgaccatcagtatatttgtccagataattggtggatcaaaaatgccacttaacaggaagtttagtttgttatgcactttaaatggaataattagcttgttacaattctaggacatggtgtttaaaatttaaatctgattaatccattttaacaaacaatgcaaacatcttcagtgcagaaggaagagtggtttcaactgtttggagtcttttatgaagtcagtcaacatttacaaccaaagggcgggggggggggggggtgcgtctttagtcctaaagggacaataactctgagcatgccccaaaaaagtagnttagcaaccttttgttggtagtcaacccatccccagggccatagtgtagagtgtgaaaagctaccctgaaacccagtaattctaccctgaaagtgactgcctgcagaaagaccagcagttgatattaaagcgcaaatgaattcaacctcagccctgaaaataacagaattctgaagtttcctatgactaattcacaaaaaaagtaattgtaaactagtactattatggaattactctactgttctttctttaatagtggcaaatgaaagcataagcttaagcattttttcatattctgaagtctcaccacacataataaccaagtggtagactcacagccgtccaacttaaaaaggcaaaaccttaccttggaattggaattactgtaaacagcctactgaaaatgcatttttatcatgtaacattcttctacttgtttaacattgctgattttctctggcagcataattttgtggttaagagaatgaattctgaatgtacactttctgtctcaaaccctggctgtaatttcagctagttaataattctttgtgttcagttccactatctaggtattttcttcaaaaggtaaatacaatggtttctgaaagaatcatttgcattatcagcctgtttgggatgtctgagatcagtgcctctgggttgttaatactgtattgctgtatggtatatgtatgctgatttactacttatgcgtaagtggtatgcatgggatgtctgaaatcagtgcctatgggttgtcaatagtattaactattagtgttaactgttagtattaactattagtattattaacactaataatagtactattactattactatttttattttaaaataaaatttacctttaaaataataatagtactattgctagtactagtactattgctattactagtactattactagtactagtactatgacactgttaatagtactattaacaacccataggcacttgggatgtctgagatcagtgcctatgggttgttaatactatattgctgtatggtatatgcatgctgatttaccacttatgcatagatatatctttaataagtaatctaaaaatcctttttgtatttgagagaatctactaagttcagtccagtcaagaaaagaacctaatagcaccaatacaaattgaggacttaatttactttggaatgttgaattgcatttgttccattaaaaaaaacagaaatttgcgatttggtttttttgaaaaaatagctcagctgaccagaatgaatgtattctacttgttgagccatccagcatcacgttaaatgcaaaatgtatatataaataaa

SEQ ID NO: 63145 - DNA, 3672 bp, Homo sapiens
  misc_feature (2390)..(2390): n is a, c, g, or t
taggtttcaattgtaaagagagagaagtggataaatcagtgctgctttctttaggacgaaagaagtatggagcagtgggatcactttcacaatcaacaggaggacactgatagctgctccgaatctgtgaaatttgatgctcgctcaatgacagctttgcttcctccgaatcctaaaaacagcccttcccttcaagagaaactgaagtccttcaaagctgcactgattgccctttacctcctcgtgtttgcagttctcatccctctcattggaatagtggcagctcaactcctgaagtgggaaacgaagaattgctcagttagttcaactaatgcaaatgatataactcaaagtctcacgggaaaaggaaatgacagcgaagaggaaatgagatttcaagaagtctttatggaacacatgagcaacatggagaagagaatccagcatattttagacatggaagccaacctcatggacacagagcatttccaaaatttcagcatgacaactgatcaaagatttaatgacattcttctgcagctaagtaccttgttttcctcagtccagggacatgggaatgcaatagatgaaatctccaagtccttaataagtttgaataccacattgcttgatttgcagctcaacatagaaaatctgaatggcaaaatccaagagaataccttcaaacaacaagaggaaatcagtaaattagaggagcgtgtttacaatgtatcagcagaaattatggctatgaaagaagaacaagtgcatttggaacaggaaataaaaggagaagtgaaagtactgaataacatcactaatgatctcagactgaaagattgggaacattctcagaccttgagaaatatcactttaattcaaggtcctcctggacccccgggtgaaaaaggagatcgaggtcccactggagaaagtggtccacgaggatttccaggtccaataggtcctccgggtcttaaaggtgatcggggagcaattggctttcctggaagtcgaggactcccaggatatgccggaaggccaggaaattctggaccaaaaggccagaaaggggaaaaggggagtggaaacacattaactccatttacgaaagttcgactggtcggtgggagcggccctcacgaggggagagtggagatactccacagcggccagtggggtacaatttgtgacgatcgctgggaagtgcgcgttggacaggtcgtctgtaggagcttgggatacccaggtgttcaagccgtgcacaaggcagctcactttggacaaggtactggtccaatatggctgaatgaagtgttttgttttgggagagaatcatctattgaagaatgtaaaattcggcaatgggggacaagagcctgttcacattctgaagatgctggagtcacttgcactttataatgcatcatattttcattcacaactatgaaatcgctgctcaaaaatgattttattaccttgttcctgtaaaatccatttaatcaatatttaagagattaagaatattgcccaaataatattttagattacaggattaatatattgaacaccttcatgcttactattttatgtctatatttaaatcattttaacttctataggtttttaaatggaattttctaatataatgacttatatgctgaattgaacattttgaagtttatagcttccagattacaaaggccaagggtaatagaaatgcataccagtaattggctccaattcataatatgttcaccaggagattacaattttttgctcttcttgtctttgtaatctatttagttgattttaattactttctgaataacggaagggatcagaagatatcttttgtgcctagattgcaaaatctccaatccacacatattgttttaaaataagaatgttatccaactattaagatatctcaatgtgcaataacttgtgtattagatatcaatgttaatgatatgtcttggccactatggaccagggagcttatttttcttgtcatgtactgacaactgtttaattgaatcatgaagtaaattgaaagcaggacatatgagaaaactgaccatcagtatatttgtccagataattggtggatcaaaaatgccacttaacaggaagtttagtttgttatgcactttaaatggaataattagcttgttacaattctaggacatggtgtttaaaatttaaatctgattaatccattttaacaaacaatgcaaacatcttcagtgcagaaggaagagtggtttcaactgtttggagtcttttatgaagtcagtcaacatttacaaccaaagggcgggggggggggggggtgcgtctttagtcctaaagggacaataactctgagcatgccccaaaaaagtagnttagcaaccttttgttggtagtcaacccatccccagggccatagtgtagagtgtgaaaagctaccctgaaacccagtaattctaccctgaaagtgactgcctgcagaaagaccagcagttgatattaaagcgcaaatgaattcaacctcagccctgaaaataacagaattctgaagtttcctatgactaattcacaaaaaaagtaattgtaaactagtactattatggaattactctactgttctttctttaatagtggcaaatgaaagcataagcttaagcattttttcatattctgaagtctcaccacacataataaccaagtggtagactcacagccgtccaacttaaaaaggcaaaaccttaccttggaattggaattactgtaaacagcctactgaaaatgcatttttatcatgtaacattcttctacttgtttaacattgctgattttctctggcagcataattttgtggttaagagaatgaattctgaatgtacactttctgtctcaaaccctggctgtaatttcagctagttaataattctttgtgttcagttccactatctaggtattttcttcaaaaggtaaatacaatggtttctgaaagaatcatttgcattatcagcctgtttgggatgtctgagatcagtgcctctgggttgttaatactgtattgctgtatggtatatgtatgctgatttactacttatgcgtaagtggtatgcatgggatgtctgaaatcagtgcctatgggttgtcaatagtattaactattagtgttaactgttagtattaactattagtattattaacactaataatagtactattactattactatttttattttaaaataaaatttacctttaaaataataatagtactattgctagtactagtactattgctattactagtactattactagtactagtactatgacactgttaatagtactattatattgctgtatggtatatgcatgctgatttaccacttatgcatagatatatctttaataagtaatctaaaaatcctttttgtatttgagagaatctactaagttcagtccagtcaagaaaagaacctaatagcaccaatacaaattgaggacttaatttactttggaatgttgaattgcatttgttccattaaaaaaaacagaaatttgcgatttggtttttttgaaaaaatagctcagctgaccagaatgaatgtattctacttgttgagccatccagcatcacgttaaatgcaaaatgtatatataaataaa

SEQ ID NO: 63146 - DNA, 3489 bp, Homo sapiens
  misc_feature (2390)..(2390): n is a, c, g, or t
taggtttcaattgtaaagagagagaagtggataaatcagtgctgctttctttaggacgaaagaagtatggagcagtgggatcactttcacaatcaacaggaggacactgatagctgctccgaatctgtgaaatttgatgctcgctcaatgacagctttgcttcctccgaatcctaaaaacagcccttcccttcaagagaaactgaagtccttcaaagctgcactgattgccctttacctcctcgtgtttgcagttctcatccctctcattggaatagtggcagctcaactcctgaagtgggaaacgaagaattgctcagttagttcaactaatgcaaatgatataactcaaagtctcacgggaaaaggaaatgacagcgaagaggaaatgagatttcaagaagtctttatggaacacatgagcaacatggagaagagaatccagcatattttagacatggaagccaacctcatggacacagagcatttccaaaatttcagcatgacaactgatcaaagatttaatgacattcttctgcagctaagtaccttgttttcctcagtccagggacatgggaatgcaatagatgaaatctccaagtccttaataagtttgaataccacattgcttgatttgcagctcaacatagaaaatctgaatggcaaaatccaagagaataccttcaaacaacaagaggaaatcagtaaattagaggagcgtgtttacaatgtatcagcagaaattatggctatgaaagaagaacaagtgcatttggaacaggaaataaaaggagaagtgaaagtactgaataacatcactaatgatctcagactgaaagattgggaacattctcagaccttgagaaatatcactttaattcaaggtcctcctggacccccgggtgaaaaaggagatcgaggtcccactggagaaagtggtccacgaggatttccaggtccaataggtcctccgggtcttaaaggtgatcggggagcaattggctttcctggaagtcgaggactcccaggatatgccggaaggccaggaaattctggaccaaaaggccagaaaggggaaaaggggagtggaaacacattaactccatttacgaaagttcgactggtcggtgggagcggccctcacgaggggagagtggagatactccacagcggccagtggggtacaatttgtgacgatcgctgggaagtgcgcgttggacaggtcgtctgtaggagcttgggatacccaggtgttcaagccgtgcacaaggcagctcactttggacaaggtactggtccaatatggctgaatgaagtgttttgttttgggagagaatcatctattgaagaatgtaaaattcggcaatgggggacaagagcctgttcacattctgaagatgctggagtcacttgcactttataatgcatcatattttcattcacaactatgaaatcgctgctcaaaaatgattttattaccttgttcctgtaaaatccatttaatcaatatttaagagattaagaatattgcccaaataatattttagattacaggattaatatattgaacaccttcatgcttactattttatgtctatatttaaatcattttaacttctataggtttttaaatggaattttctaatataatgacttatatgctgaattgaacattttgaagtttatagcttccagattacaaaggccaagggtaatagaaatgcataccagtaattggctccaattcataatatgttcaccaggagattacaattttttgctcttcttgtctttgtaatctatttagttgattttaattactttctgaataacggaagggatcagaagatatcttttgtgcctagattgcaaaatctccaatccacacatattgttttaaaataagaatgttatccaactattaagatatctcaatgtgcaataacttgtgtattagatatcaatgttaatgatatgtcttggccactatggaccagggagcttatttttcttgtcatgtactgacaactgtttaattgaatcatgaagtaaattgaaagcaggacatatgagaaaactgaccatcagtatatttgtccagataattggtggatcaaaaatgccacttaacaggaagtttagtttgttatgcactttaaatggaataattagcttgttacaattctaggacatggtgtttaaaatttaaatctgattaatccattttaacaaacaatgcaaacatcttcagtgcagaaggaagagtggtttcaactgtttggagtcttttatgaagtcagtcaacatttacaaccaaagggcgggggggggggggggtgcgtctttagtcctaaagggacaataactctgagcatgccccaaaaaagtagnttagcaaccttttgttggtagtcaacccatccccagggccatagtgtagagtgtgaaaagctaccctgaaacccagtaattctaccctgaaagtgactgcctgcagaaagaccagcagttgatattaaagcgcaaatgaattcaacctcagccctgaaaataacagaattctgaagtttcctatgactaattcacaaaaaaagtaattgtaaactagtactattatggaattactctactgttctttctttaatagtggcaaatgaaagcataagcttaagcattttttcatattctgaagtctcaccacacataataaccaagtggtagactcacagccgtccaacttaaaaaggcaaaaccttaccttggaattggaattactgtaaacagcctactgaaaatgcatttttatcatgtaacattcttctacttgtttaacattgctgattttctctggcagcataattttgtggttaagagaatgaattctgaatgtacactttctgtctcaaaccctggctgtaatttcagctagttaataattctttgtgttcagttccactatctaggtattttcttcaaaaggtaaatacaatggtttctgaaagaatcatttgcattatcagcctgtttgggatgtctgagatcagtgcctctgggttgttaatactgtattgctgtatggtatatgtatgctgatttactacttatgcgtaagtggtattaacaacccataggcacttgggatgtctgagatcagtgcctatgggttgttaatactatattgctgtatggtatatgcatgctgatttaccacttatgcatagatatatctttaataagtaatctaaaaatcctttttgtatttgagagaatctactaagttcagtccagtcaagaaaagaacctaatagcaccaatacaaattgaggacttaatttactttggaatgttgaattgcatttgttccattaaaaaaaacagaaatttgcgatttggtttttttgaaaaaatagctcagctgaccagaatgaatgtattctacttgttgagccatccagcatcacgttaaatgcaaaatgtatatataaataaa

SEQ ID NO: 63147 - DNA, 555 bp, Homo sapiens
actatatacccaatagaactgaacacacatgttcacaccaaaatttgcatataaatgtccacagcagcattatccacaaggtagaaatcacccacatgtccatcaatggataaacaaaatgtggtatatccatttcatggaatattattcagccatatccaaaggtagaaaccacgcaaatgtccatcaatggatacacaaaatgtgatatatccatacagtggaatattattcagcaataaaaagtaacgaagcactgacatatgctacaacatggataaccttgaaaacattatgctcagtgaaagaagtcagtcgtaaaaagacacaaattgtatgattccatctttatgaaatgtccagaactgggaaatctatggagacaaagactattggttgcctagagctggggatcatgggaatggggaaagtgagaagtaactgctaatgggtatatggtttcttttttggagtaatgaaaatgttccaaaattgactgtggtgatggttgtacaaatgcaaaaacactaagtactattaaattgtatactttag

SEQ ID NO: 63148 - DNA, 557 bp, Homo sapiens
gttaaaaaaagggagaaggactcatcaacacattgctgcctgcaaacccagggaaagaccaccttacaccacattatatggcatctgtaaatcaacatgggccagcgggagacaccaaggccctaccaggagctgctctttgatcacgaggttcacgctgcatcttttcgggaaggttaaaaaataataaatgaccaccaggatcacagaaggaaagagctcgtgatgtccatggaattcacgcagatcacatccaggaatctttggaacaaaaaattcacaacaccatggcctcatacaaaaatgctgggctgcaggaaacctgaggcagagagctccatcatcacagtgaagtccccgccttcagcagatcccaccaacagccacagtgcttcccatcacctgaaaaaaactcatgtatcaaactattacacttcttcagaatattggaaaatggtgcatagttcatatgttctcatttgtttatcttgtgtctaaagtgtcttgtcattccaggccactctatttcttgtgtattaataaaaagtttgaggtat

SEQ ID NO: 63149 - DNA, 457 bp, Homo sapiens
tgtagagtgaatttccatatgtattccattctactagtctgtttacctaattcatgtgtgtcatactattttaattatggaggcattatagtatttttaaatgcctgcttggacctgtcttcccctgtagcttttctttctcagttttcctagctatttttagagaacattgttttgaatcacaaaaactatcaaatagaggggaaaattggatttatcttttgaaattcagcttcttaacagctaatctttccacaaggagctattacttcatttctttgataaaagtacatatcaacatgatttattacaaaagtaaaaaaaattctgtatattataaatatttttatatgaaattgtattctctcattttccatgggttattctgaacacaaaatagttcaaaggtgtttctattaaagttgtttctattcaaaaaacaaaggaaagaaaatat

SEQ ID NO: 63150 - DNA, 553 bp, Homo sapiens
atatatcctaagatcaaagagcctcattactgagaaatgaccttatgaatacttgatttttttaaatttaatgaagaattaaattggtgctctcttttaaaactatattcagattctcaaatagaagttgaagaaatactttccctatctcagtggagccagaattaataagaaattcattccctgtgttttcttaagttaaaatagtcaaactttcagcctttcagatttcggatgtgatacatacacataaacgttgtgtctgaaacagtgctgaaactaatccatgataagaaaactttatttttagatcctgtttgacccatttattaattatttgatagacatgagatactttgctgccatatttttaggttagtggctagatttagtagaactagagtaggaaaggaaatcaatctgatgttgaaccttagtgtcagctacagagatggctatattaagattaccacgttgaaagattgccggatagcctctgtgtctaatatgaagccattaattttgttttttataactcattaaaaaaaagaaa

SEQ ID NO: 63151 - DNA, 349 bp, Homo sapiens
gtatttttagtagagacggagtttcagcatgttggtcaggctggtctcgaactcccgacctcaagtgatctgccgccttgacctcccaaagtgttgggaaaacaagcatgagccaccctgcccagccccaattaataattttaacagaggcacaagacactatgttgctgatattatgttgaatagtttacattttctcattttatttagcatttcataaatattaaatcattatgttctgtacttgtacactaaagagcagtttttgttttataaaaagaaaacattgcagatcacttataaaactatttatttaaagcatatttctgtatttttcaagcactacagg

SEQ ID NO: 63152 - DNA, 1771 bp, Homo sapiens
  misc_feature (939)..(939): n is a, c, g, or t
  misc_feature (1164)..(1165): n is a, c, g, or t
  misc_feature (1168)..(1168): n is a, c, g, or t
agactcagcttaatctgacccaagggctcctaccctgaaccagtagctgggactatccccagggtacccctgagagctgccccagcctggggtgagggtaaggggtagggggctttgtcttggctgagccacatctctcacacccctgtggcctgggcatcataatcagccccaactatataaccaggtgggctgccagggcctctgtaaagctaggcctgctgggagaggatgaggaggagccctgccctcaaacgtggcctcctatggacacccagactcacagccttcctatcacccacactcagctccatagcaactctcagccccaaagccgcacctgcacccgccattgccaaaccttcagccagagttgcagacagagccatcgtggcagccggagccagagctccagccagagcccggccagccaccgcaacccaactggagcccacagctcatccggccaccagagccagagtcccaacactagtccaccaccaaagcgccacaaaaagactatgaactcccaccactctcccatgcggcccaccatcctgcactgccgctgccccaagaacagaaagaacttggaaggcaagctgaaaaagaaaaaaatggccaagaggatccagcaggtgtacaaaaccaagacgcggagctcaggtaccctttaaggaggtggggaagggccaccgagccacagatgatggagagcagaccttgggggcagtgagaggaaggctgcagccaggtcacaaaggaaccacaggcaagaaggaagagggagaagagaaacaatggcagttggctagctgaatgtatgatacgttgacggaaagtctctttgaaattggatgggttgattaggaggatggaaagatggacagatagcagataagctagatgaaagcatgaatggagttgagaggttgggtngatgactgggtgggtaaacaataaataggttatagaaaggatagttggaagaatgcattggctgaatgataggaagtttggatacgattagctggatggatggataaatggatgaatgcactggctggctagttatttggttggttaggtagatgatcagtttgaagattgtggttggtggatgaattggttagaaatagagttaaatagttgtagaagttttgnnggnttggtttgattggttaaatattatcttaatagagtaatatagagtaattgaataaacagagagaagaatagatatctagactaatggatagaatggaaagaaatgttgaataaatgaatggaatgagtgaactaatgaatgggtggatgacaaatggaagggataaatggatggatacctggattcacataggtcaaaaggacactgacggtagtctaaactctatctatgtcccatatcaatcacaaatgagtagttgtaagaccttacaggaggtcaaggaggtcactgacttcatgaagtgctcagctattaaaggttcctttcccactcttatcccttaggatggaaatccaactaatgagaccgcactccttggcttgttcctgcgtgtttcacccaaaggagaaaatgctaggatgaagtcaatcttcttgcaggaacatgttactatggtgatttctacgcaacactaattaaagcttgtacctggaagactatccctgagtagtcattttgatttcactaataaaggtgttatgtgttttgggggcctgcacaggggcagaaatgaatgggggtaggatgccaagaagcctgcag

SEQ ID NO: 63153 - DNA, 925 bp, Homo sapiens
agactcagcttaatctgacccaagggctcctaccctgaaccagtagctgggactatccccagggtacccctgagagctgccccagcctggggtgagggtaaggggtagggggctttgtcttggctgagccacatctctcacacccctgtggcctgggcatcataatcagccccaactatataaccaggtgggctgccagggcctctgtaaagctaggcctgctgggagaggatgaggaggagccctgccctcaaacgtggcctcctatggacacccagactcacagccttcctatcacccacactcagctccatagcaactctcagccccaaagccgcacctgcacccgccattgccaaaccttcagccagagttgcagacagagccatcgtggcagccggagccagagctccagccagagcccggccagccaccgcaacccaactggagcccacagctcatccggccaccagagccagagtcccaacactagtccaccaccaaagcgccacaaaaagactatgaactcccaccactctcccatgcggcccaccatcctgcactgccgctgccccaagaacagaaagaacttggaaggcaagctgaaaaagaaaaaaatggccaagaggatccagcaggtgtacaaaaccaagacgcggagctcaggatggaaatccaactaatgagaccgcactccttggcttgttcctgcgtgtttcacccaaaggagaaaatgctaggatgaagtcaatcttcttgcaggaacatgttactatggtgatttctacgcaacactaattaaagcttgtacctggaagactatccctgagtagtcattttgatttcactaataaaggtgttatgtgttttgggggcctgcacaggggcagaaatgaatgggggtaggatgccaagaagcctgcag

SEQ ID NO: 63154 - DNA, 370 bp, Homo sapiens
aacatttcagaggacgctgtcccccaagtctgggtcctggcatgagaagatacagagcagaccctggggtttgagttaccttgcttctcctgatcatgttttctcattggcaaaaagagatggatgatttgagatttttttttcttctggggcaatctcagattgtgtctaactccaaagaatgatgtaaatctgttctgttcacaaatgctttgtgagaggccatgtagtcttagtgtttttactgacaagagaattgccttgcgcagaagaattgctacagttgcagtttcagagctcctggaagaccaccatttctaccttagtgagagctccccacattaccaagaatgggactacattactgata

SEQ ID NO: 63155 - DNA, 394 bp, Homo sapiens
cttaagtgaactagtgagtaaactagaaaagggaggtgaaatatgttgcatttatcttaggtccctgaattatttcatctaagtaaaacctcaatatgattttcctctacatgacattttccttagccaattaatggcatccatttgtccgcagggatgcgttgcacatgagagtgagaacaaattgttacaatgaaattaaaaacattcagaacagtattgtgcatcaggaagacagatttgaaaggctttccgtatatggagaagatcttctgtattccatttgctgtgtacctcagcatactggtggattaggaatgggttataggcatgtgaaaaggtttatttgctcagaattgctgggtgtcaggagcacaggggttaaagtaagacc

SEQ ID NO: 63156 - DNA, 736 bp, Homo sapiens
ttaagagtacacaagtccttttattaaaagtttgctcctagcctgggcaacataatgagatcccatctctgcaaaaaaatttgtacatgggcatacacctgtagtcccagctacttgggaggctgagacgggaggatcgcttaagctcaggagttcaaggctgcagtgagctatgactgctgactgtacctgcactccagcctgggcaacagagtgagatcctgtctcaaaaacaaagtgtgctctccacatacctgcaacacaactagtcttatttctaaaatgttataatcttttttccaagtagctacattaatatagtctagaaaaaaatggacttgaatagctggtagaatattaaaatatagaaatgaaataaaagaattatatctaaaaacctcaactcagaagacagaaaaagagaaaataggccctgatatcaacagaattaacaatacataaaaggagtaacttttgaggggagaggatataaaatattttgaggaattaccaaggggaataaaacaatgttaccttgaaatgattatatatatattacatattggtatatatgtccatacctacctatatcccctgctacccttctgtctgaaatatacaaataatgataatgttgaagatatcgataaacatagctaatgtctgttcatagaggacttactaagtgccagccaccatgataagctaaagttaattattttatttgttcattcca

SEQ ID NO: 63157 - DNA, 801 bp, Homo sapiens
ccccgcatcccaggcgcacttctcactagctgtcacttggtctgctctgcgccaggtcctcagcatgcgttgtctttattccgcgtgacaatcctatgggaaggggcctccacctacgtaacagaaatgcggctcagaaagaccaagtgacagctagtgagtagtgctgggcctgaaccccaaagtccacactcttgctatagccgctgaggcaggcagaagagctccttgggaggaaagtaaggggcattcaaagccttctctgaatcactccccaagccagagtagacctggttccagttgtcccccccttgtttccgggcagagtcaggcaggtgtcataccatccctccccgcccaaccagtgctggccagactcccattcaccgaccttgactagacagcgaacagccaccttttagtattcatcccaacaggtccaggcggtcagtgtgatagccacgcagttcctaagggactgtaggtctaggaatcattaggacactcactcagccaccctcgatgcccccatcttccccacactgcccttggcctccccgctctgcacgcctggagtatttgcactggtctagcctactccaggtcagactcattaggaactcaagattctcgtaaagaaagttgtttccaaagttgtcttgtcactctatttgggggttgggagagagcccgtgggggccagcgttggcgaatacaggaaaaagggagaatgctggagaaactggactcgtgagagcttaaagacatcccaagaatccaaagaaaaagtgagtggtgaca

SEQ ID NO: 63158 - DNA, 3921 bp, Homo sapiens
gtggtgatctagaggatccctcgctatcatcggcactcgctattcatcggcacccagcccaggcaatagtgttgaggaggggagcaaggctgctaagtggaagacagagatggcagagccatccaccctgaggagtgacgggcaaggggccaggaaggggacaggattgtctgctgcctccaagtcatgggagaagaggggtataggacaaggggtggaagggcaggagctcacaccgcaccgggctggcctgacacaatggtagctctgaagggaggggaagagagaggcctgggtgtgacctgacacctgccgctgcttgagtggacagcagctggactgggtgggccccacagtggtcagcgattcctgccaagtagggtttagccgggccccatggtcacagacccctgggggaggcttccagctcagtcccacagccccttgcttctaagggatccagagacctgctccagatcctctttccccactgaagaattctgcaccctctggacttccctcttcttccttcctttctcaggctcaaggtgtggggggcaaggctgagtattaggggagcttctgagttctgaatctttgggtgacctgcttggagtctcaggtccaaatacttgaaatctgtgagaagtccaagttcatgggcttttggaactggaagaactttgtacagccatggattccaacataagccatgttgcagatgaagaaactgacccacacggtgagacaagcacaggtgggtctgactcttcctccctgccctgagatccatctgtcgagtgccctgttttttccccactttgaactgactggttactctaaggaagtgaactgaggatgttagctttaagccaacccagcctctttgtccacagcagagctgaggtgaacagctggaaccctgctacatccgtgctgctccagtctgttctgctcatggctccatccttctggctgtcactcttcctcttccccttcccaaccaaacctgagcagctttgaagcagaacttgggaaggacagggctgctgctgccagcgacacctcagaaagcatagcctcggcttcctgccccatgtgtccctggaagctgtaccctgactctgcttccagaggccagcagatggtgggttacagacgggtcagcctgccaagtgcacctgagggacctgacctgacacaagccattttgtccctagagcccagctgggactcctgcttctctaggcagggcagagggaggagacacagcacaggcacagagcatgggacagggacccccgagtctggattcaagtcctggccctgctagtaactcatgtgagccagcttgagcaagtcccttcatcttgctagagctcagcttccttgcctataaaacgtaggtggcaatgccctcttcctgaggttgctgggaggataaggcagtgcttgtgaaaaagtctagcgctgtacctggcacagagtagatgcttcatgaatgttgagtctgacaggcaactggagctggtgagaatggggtcccctgactgtcatgccagcctccctcccaggcccactcttcccccctcttccctgaggaaaccaagtctcccttatcaggaagagctgggggagctgggaggaacattacaggaacaccagagggagtctagcgggtgggcaggcttctctctgcagccccctcagcagtttcattccattcctgggctgaacccttgccctggccctgcctcccttctgggtcagcacctcctgacacaggtgtgtgctcagggaccccaggctctagtcctgtactggctgtggaagcctatcactgggacaggaagccagtggctgcaggagacaggcctcagcgcatctcgtctgtcaggatgggctcacggacaccttttcttggtagcagggagtgtctctgcactatggaaactttccctcttctagagcggattgggagttgcctgtattatgcctgaaccctccttgaactcatggtcctggggaaggcgtcttggaaccagaaacagcaacaggaaaggagcctccctctgaagggtaggatgccggcctgaggccctccctcttggctctcccagggcctgggctaccccgaggccccagcagctgctgctgtggctgtacttgcttttaatatttcccatacatggctgttgtccaagttaagtcaccaaatggtgctagaggggatggcagagagcagcttgtccagctcctctccatgacccggttaacacacgagttaaacaggcctagagcttgtctgctgtttgacctcttttaagacccggctgtgctgcatctacaaaatgaagatgacagagctagccgaggtcttcagcaaggaagaaaggggtcagtgtatatgaaagggttacctgggcagtgtcattccctccatctctgtacgcagccctttgggaaccatcacaataaggaagaggtgagggcagaggtgaaggatccactgcccaggcaaggtgctaccatgtggtgggagagtgtgaaccctcaagtgcactgggaagctttggggaaccacagtctcttccacccttgggtcgtgtgtcgtcctcttctcttgatgtcagggaagcccctatgcctccttcccgtggtggggctatctctgcagagaatcgggtgcccagcttaatgctgggcaaggactggaggaagctccagatctggaggtggcagagatactggatggaaacctggagcaagggtttgggaggggaagtgaggaaacaggttgagactatctccatcagagatggcaaggccacaggtgatctgagaactatttttgtctgaaaagaaggcatgcacaggctctctgcttttgacaggtggcgttgcagtgggaggaaggcagcttcctggcggggagatagaaatactagaacagctggtaccaagttattgaaaatttaaaagcaaacaagacacagcagcccccaggtggtgtgttctactgaggaaggctacggcagaggaagggcaagaccgtttcccccaatggtcttgaaacggaagaggaaacagggagggctctttggatggtttggggacctggggctgtttgtatcccagtattagctcctgttactaagggtctgctctgcgccaggtcctcagcatgcgttgtctttattccgcgtgacaatcctatgggaaggggcctccacctacgtaacagaaatgcggctcagaaagaccaagtgacagctagtgagtagtgctgggcctgaaccccaaagtccacactcttgctatagccgctgaggcaggcagaagagctccttgggaggaaagtaaggggcattcaaagccttctctgaatcactccccaagccagagtagacctggttccagttgtcccccccttgtttccgggcagagtcaggcaggtgtcataccatccctccccgcccaaccagtgctggccagactcccattcaccgaccttgactagacagcgaacagccaccttttagtattcatcccaacaggtccaggcggtcagtgtgatagccacgcagttcctaagggactgtaggtctaggaatcattaggacactcactcagccaccctcgatgcccccatcttccccacactgcccttggcctccccgctctgcacgcctggagtatttgcactggtctagcctactccaggtcagactcattaggaactcaagattctcgtaaagaaagttgtttccaaagttgtcttgtcactctatttgggggttgggagagagcccgtgggggccagcgttggcgaatacaggaaaaagggagaatgctggagaaactggactcgtgagagcttaaagacatcccaagaatccaaagaaaaagtgagtggtgaca

SEQ ID NO: 63159 - DNA, 5868 bp, Homo sapiens
ctcctccccctcaccgtcccaattgtattccctggaagagcagccggaaaagcctccgcctgctcataccaggataggcaagaagctggtttctcctcgcagccggctccctgaggcccaggaaccaccgcggcggccggcaccacctggacccagctccaggcgggcgcggcttcagcaccacggacagcgccccacccgcggccctccccccggcggcgcgctccagccggtgtaggcgaggcagcgagctatgcccgcggcatggcccggcgctgcggccccgtggcgctgctccttggcttcggcctcctccggctgtgctcaggggtgtggggtacggatacagaggagcggctggtggagcatctcctggatccttcccgctacaacaagcttatccgcccagccaccaatggctctgagctggtgacagtacagcttatggtgtcactggcccagctcatcagtgtgcatgagcgggagcagatcatgaccaccaatgtctggctgacccaggagtgggaagattatcgcctcacctggaagcctgaagagtttgacaacatgaagaaagttcggctcccttccaaacacatctggctcccagatgtggtcctgtacaacaatgctgacggcatgtacgaggtgtccttctattccaatgccgtggtctcctatgatggcagcatcttctggctgccgcctgccatctacaagagcgcatgcaagattgaagtaaagcacttcccatttgaccagcagaactgcaccatgaagttccgttcgtggacctacgaccgcacagagatcgacttggtgctgaagagtgaggtggccagcctggacgacttcacacctagtggtgagtgggacatcgtggcgctgccgggccggcgcaacgagaaccccgacgactctacgtacgtggacatcacgtatgacttcatcattcgccgcaagccgctcttctacaccatcaacctcatcatcccctgtgtgctcatcacctcgctagccatccttgtcttctacctgccatccgactgtggcgagaagatgacgttgtgcatctcagtgctgctggcgctcacggtcttcctgctgctcatctccaagatcgtgcctcccacctccctcgacgtgccgctcgtcggcaagtacctcatgttcaccatggtgcttgtcaccttctccatcgtcaccagcgtgtgcgtgctcaacgtgcaccaccgctcgcccaccacgcacaccatggcgccctgggtgaaggtcgtcttcctggagaagctgcccgcgctgctcttcatgcagcagccacgccatcattgcgcccgtcagcgcctgcgcctgcggcgacgccagcgtgagcgcgagggcgctggagccctcttcttccgcgaagccccaggggccgactcctgcacgtgcttcgtcaaccgcgcgtcggtgcaggggttggccggggccttcggggctgagcctgcaccagtggcgggccccgggcgctcaggggagccgtgtggctgtggcctccgggaggcggtggacggcgtgcgcttcatcgcagaccacatgcggagcgaggacgatgaccagagcgtgagtgaggactggaagtacgtcgccatggtgatcgaccgcctcttcctctggatctttgtctttgtctgtgtctttggcaccatcggcatgttcctgcagcctctcttccagaactacaccaccaccaccttcctccactcagaccactcagcccccagctccaagtgaggcccttcctcatctccatgctctttcaccctgccaccctctgctgcacagtagtgttgggtggaggatggacgagtgagctaccaggaagaggggcgctgcccccacagatccatccttttgcttcatctggagtccctcctcccccacgcctccatccacacacagcagctccaacctggaggctggaccaactgctttgttttggctgctctccatctcttgtaccagcccaggcaatagtgttgaggaggggagcaaggctgctaagtggaagacagagatggcagagccatccaccctgaggagtgacgggcaaggggccaggaaggggacaggattgtctgctgcctccaagtcatgggagaagaggggtataggacaaggggtggaagggcaggagctcacaccgcaccgggctggcctgacacaatggtagctctgaagggaggggaagagagaggcctgggtgtgacctgacacctgccgctgcttgagtggacagcagctggactgggtgggccccacagtggtcagcgattcctgccaagtagggtttagccgggccccatggtcacagacccctgggggaggcttccagctcagtcccacagccccttgcttctaagggatccagagacctgctccagatcctctttccccactgaagaattctgcaccctctggacttccctcttcttccttcctttctcaggctcaaggtgtggggggcaaggctgagtattaggggagcttctgagttctgaatctttgggtgacctgcttggagtctcaggtccaaatacttgaaatctgtgagaagtccaagttcatgggcttttggaactggaagaactttgtacagccatggattccaacataagccatgttgcagatgaagaaactgacccacacggtgagacaagcacaggtgggtctgactcttcctccctgccctgagatccatctgtcgagtgccctgttttttccccactttgaactgactggttactctaaggaagtgaactgaggatgttagctttaagccaacccagcctctttgtccacagcagagctgaggtgaacagctggaaccctgctacatccgtgctgctccagtctgttctgctcatggctccatccttctggctgtcactcttcctcttccccttcccaaccaaacctgagcagctttgaagcagaacttgggaaggacagggctgctgctgccagcgacacctcagaaagcatagcctcggcttcctgccccatgtgtccctggaagctgtaccctgactctgcttccagaggccagcagatggtgggttacagacgggtcagcctgccaagtgcacctgagggacctgacctgacacaagccattttgtccctagagcccagctgggactcctgcttctctaggcagggcagagggaggagacacagcacaggcacagagcatgggacagggacccccgagtctggattcaagtcctggccctgctagtaactcatgtgagccagcttgagcaagtcccttcatcttgctagagctcagcttccttgcctataaaacgtaggtggcaatgccctcttcctgaggttgctgggaggataaggcagtgcttgtgaaaaagtctagcgctgtacctggcacagagtagatgcttcatgaatgttgagtctgacaggcaactggagctggtgagaatggggtcccctgactgtcatgccagcctccctcccaggcccactcttcccccctcttccctgaggaaaccaagtctcccttatcaggaagagctgggggagctgggaggaacattacaggaacaccagagggagtctagcgggtgggcaggcttctctctgcagccccctcagcagtttcattccattcctgggctgaacccttgccctggccctgcctcccttctgggtcagcacctcctgacacaggtgtgtgctcagggaccccaggctctagtcctgtactggctgtggaagcctatcactgggacaggaagccagtggctgcaggagacaggcctcagcgcatctcgtctgtcaggatgggctcacggacaccttttcttggtagcagggagtgtctctgcactatggaaactttccctcttctagagcggattgggagttgcctgtattatgcctgaaccctccttgaactcatggtcctggggaaggcgtcttggaaccagaaacagcaacaggaaaggagcctccctctgaagggtaggatgccggcctgaggccctccctcttggctctcccagggcctgggctaccccgaggccccagcagctgctgctgtggctgtacttgcttttaatatttcccatacatggctgttgtccaagttaagtcaccaaatggtgctagaggggatggcagagagcagcttgtccagctcctctccatgacccggttaacacacgagttaaacaggcctagagcttgtctgctgtttgacctcttttaagacccggctgtgctgcatctacaaaatgaagatgacagagctagccgaggtcttcagcaaggaagaaaggggtcagtgtatatgaaagggttacctgggcagtgtcattccctccatctctgtacgcagccctttgggaaccatcacaataaggaagaggtgagggcagaggtgaaggatccactgcccaggcaaggtgctaccatgtggtgggagagtgtgaaccctcaagtgcactgggaagctttggggaaccacagtctcttccacccttgggtcgtgtgtcgtcctcttctcttgatgtcagggaagcccctatgcctccttcccgtggtggggctatctctgcagagaatcgggtgcccagcttaatgctgggcaaggactggaggaagctccagatctggaggtggcagagatactggatggaaacctggagcaagggtttgggaggggaagtgaggaaacaggttgagactatctccatcagagatggcaaggccacaggtgatctgagaactatttttgtctgaaaagaaggcatgcacaggctctctgcttttgacaggtggcgttgcagtgggaggaaggcagcttcctggcggggagatagaaatactagaacagctggtaccaagttattgaaaatttaaaagcaaacaagacacagcagcccccaggtggtgtgttctactgaggaaggctacggcagaggaagggcaagaccgtttcccccaatggtcttgaaacggaagaggaaacagggagggctctttggatggtttggggacctggggctgtttgtatcccagtattagctcctgttactaagggtctgctctgcgccaggtcctcagcatgcgttgtctttattccgcgtgacaatcctatgggaaggggcctccacctacgtaacagaaatgcggctcagaaagaccaagtgacagctagtgagtagtgctgggcctgaaccccaaagtccacactcttgctatagccgctgaggcaggcagaagagctccttgggaggaaagtaaggggcattcaaagccttctctgaatcactccccaagccagagtagacctggttccagttgtcccccccttgtttccgggcagagtcaggcaggtgtcataccatccctccccgcccaaccagtgctggccagactcccattcaccgaccttgactagacagcgaacagccaccttttagtattcatcccaacaggtccaggcggtcagtgtgatagccacgcagttcctaagggactgtaggtctaggaatcattaggacactcactcagccaccctcgatgcccccatcttccccacactgcccttggcctccccgctctgcacgcctggagtatttgcactggtctagcctactccaggtcagactcattaggaactcaagattctcgtaaagaaagttgtttccaaagttgtcttgtcactctatttgggggttgggagagagcccgtgggggccagcgttggcgaatacaggaaaaagggagaatgctggagaaactggactcgtgagagcttaaagacatcccaagaatccaaagaaaaagtgagtggtgaca

SEQ ID NO: 63160 - DNA, 408 bp, Homo sapiens
atcctctatttacttttctgatcctctcagttgccctatgtcatattcttcttgtgatcctgacttagtagggttcatgtacttagttggccagctctatatttcaaatcgtgtcatctgagttacggtatccgtgtgaatgaaatgagtgacagtgagaaatgatagggataaaaacttgcttcacagctaaacataagaatcactaaattcaaaactgattttagtatccatccattaacacttctaatttcttcatttgcttatagaataacaattcttttggtatgcagaggtcatcattctctttgaattataattgcatacatgtcacgtaagatgtcagctggagtaatttcttcttcaccattgtctctcaaatctatctattaaatctgtatctatcta

SEQ ID NO: 63161 - DNA, 367 bp, Homo sapiens
aaaatgaagccaacatactttaaaaaaaaaacatagtctacattttcgaccctttcaaatgccctgtgaggtgcagccaggtttagaatcgctggtggggcgagtcttcctgaaacacggcttgtggttcagaagagtcagtgagggagtttccaatactttgaaacttcagagcaatccaaaatgactctcacttttccaaggggtgatttcggagaaaaccaaattttatattttatatttttgttttaaactttatatttgtgcatataaatagcattaccgtggagctttaaaacaatgtatattaaggctcatgtatggttcatgaaaatattttaaaaaaaaaaaaagaagtagaaaagaa

SEQ ID NO: 63162 - DNA, 342 bp, Homo sapiens
atccaaccccatgatccaatcacctctcaccaagaccctcctccaacactgaggatgacaatttgacatgagatttgggcggggacacaaatttcaaaccataaaaatccaatataattttctttttaatctaggcagtctcattattttatgtttccaaataagacccaggaacactgatagtttacagatccaagaatcttttgagaatttttacttggtttggttttgcagattaagaggtaagttcttattttcattgttgtttgctgtttcactagagaaaactatgtcaaataacccttatgaatgcaattaaaaataaaagcactgttggcagca

SEQ ID NO: 63163 - DNA, 349 bp, Homo sapiens
ccgccccggcctcccaaagtactggaattacagacatgagccactgcacccagcctttatgttaaaccttgaatatacatcatctcatgggatagatgccattattattacacacatgcccattttataaatgaggaaaccgagatgcagagaggccaagaaactggcccaacgtcatgcaattagggagtggtgagaccaggatttaaacctaggtaatttggttccagagctttagccactgtgctttattgcttcattaagtagatagctggctaaattcaaagaaaccagatttttcccagccttcagagctgtacaaataaatttctgttgtttagcccaaatt

SEQ ID NO: 63164 - DNA, 1073 bp, Homo sapiens
  misc_feature (368)..(368): n is a, c, g, or t
  misc_feature (415)..(415): n is a, c, g, or t
agcgggccggctgcgagactggggccgtggctgctggtcccgggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggagatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaagtctggccttaccnaggcagtgaagaagagtacaattacattgcagcaggcagagtatgantttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaatgcaaaaaaaaaata

SEQ ID NO: 63165 - DNA, 1042 bp, Homo sapiens
aattgatgtttattatgatgactgagtcatgacttatgttcaagtgtgtcagtctgttttgttcagggacatcatcaagtattgggcaatgtttctcaaactgtgttccatgaactgtttataagtattctacaaatgtggtcgattaagttttagaaatactaaaatttattaattttagaaaattaataaatatattagaaatataggacagcttccttttgggaattcataatacacattagtatattaaatgctttgcaactttttatttcagtaaaaagtttactctagtttttctaaacttatttgaccgtggaattattttttctccctgtggaacatgtcgccatcttttggaacaatttgggaaactttaatcttctatattttacaaatttttttgtcaaaagtttttaaaaaacaaagcatttaaagaaaattgcttttctgaaatgttctacttttgatgatgctagacagtgacacttacagtaacatccattgttcttaagtcgttttttaaaagttgtacttttaaaatgattttcatctcctggttttggacagttcattcattgtggtatgtttgcttatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaatgcaaaaaaaaaata

SEQ ID NO: 63166 - DNA, 499 bp, Homo sapiens
  misc_feature (45)..(45): n is a, c, g, or t
gtcacatctgtataacatcatgaattccgcgcaccgagacgcgangcgcgcgtaacggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaatgcaaaaaaaaaata

SEQ ID NO: 63167 - DNA, 1393 bp, Homo sapiens
aattgatgtttattatgatgactgagtcatgacttatgttcaagtgtgtcagtctgttttgttcagggacatcatcaagtattgggcaatgtttctcaaactgtgttccatgaactgtttataagtattctacaaatgtggtcgattaagttttagaaatactaaaatttattaattttagaaaattaataaatatattagaaatataggacagcttccttttgggaattcataatacacattagtatattaaatgctttgcaactttttatttcagtaaaaagtttactctagtttttctaaacttatttgaccgtggaattattttttctccctgtggaacatgtcgccatcttttggaacaatttgggaaactttaatcttctatattttacaaatttttttgtcaaaagtttttaaaaaacaaagcatttaaagaaaattgcttttctgaaatgttctacttttgatgatgctagacagtgacacttacagtaacatccattgttcttaagtcgttttttaaaagttgtacttttaaaatgattttcatctcctggttttggacagttcattcattgtggtatgtttgcttatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttccatgtaacaacaacaaacaaacaaaaaaaaaaaaaaaacttgttgtggggcgcgcccccgcgcggccccctcgaaaagagcttttttaaaaccacttcccgtgtggggcgcgcccgccggaccccagttaggttagacgagagaccaagtggggctaaatatagagcggttccccaaagggaaaaacgccggggcaagccgacaataggcgcgttcggagttctctctcccccagttataaaaaacccgcccggggcgaaacccgagagggtttttgaagacaaattctcaagatggggagttctcaagggaccactaccgggagctctatacaccaggggtctcacgagagcggcccaaatattcaatttgca

SEQ ID NO: 63168 - DNA, 1069 bp, Homo sapiens
  misc_feature (1021)..(1021): n is a, c, g, or t
  misc_feature (1028)..(1028): n is a, c, g, or t
aattgatgtttattatgatgactgagtcatgacttatgttcaagtgtgtcagtctgttttgttcagggacatcatcaagtattgggcaatgtttctcaaactgtgttccatgaactgtttataagtattctacaaatgtggtcgattaagttttagaaatactaaaatttattaattttagaaaattaataaatatattagaaatataggacagcttccttttgggaattcataatacacattagtatattaaatgctttgcaactttttatttcagtaaaaagtttactctagtttttctaaacttatttgaccgtggaattattttttctccctgtggaacatgtcgccatcttttggaacaatttgggaaactttaatcttctatattttacaaatttttttgtcaaaagtttttaaaaaacaaagcatttaaagaaaattgcttttctgaaatgttctacttttgatgatgctagacagtgacacttacagtaacatccattgttcttaagtcgttttttaaaagttgtacttttaaaatgattttcatctcctggttttggacagttcattcattgtggtatgtttgcttatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttccngatgcgnccgttctattactaacatcaattattagttaacatagatgg

SEQ ID NO: 63169 - DNA, 292 bp, Homo sapiens
  misc_feature (51)..(51): n is a, c, g, or t
  misc_feature (94)..(94): n is a, c, g, or t
ggtttttttttctcacgctgatggcttggcagagcacctctctccgcggtntaaaccttgtggacatttcctctcacacgaagtgtgaagtttnaacctcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaatgcaaaaaaaaaata

SEQ ID NO: 63170 - DNA, 1000 bp, Homo sapiens
  misc_feature (368)..(368): n is a, c, g, or t
  misc_feature (415)..(415): n is a, c, g, or t
agcgggccggctgcgagactggggccgtggctgctggtcccgggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggagatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaagtctggccttaccnaggcagtgaagaagagtacaattacattgcagcaggcagagtatgantttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagcatcaaagagcttcagttttaccgaaataacatcttcaagaaaaaaatagatgaaaagaagaggaaaattatagaaaatggggaaaatgagaagaccgtgaggctgccactacatcgttatctggaggcaacttctggtggtttttttttctcacgctgatggcttggcagagcaccttcggttaacttgcatctccagattgattaagcacacgaaatactatttttctcctaatatgctgtttccattatgacacagcagctcctttgtaagtaccaggtcatgtccatcccttggtaaccatttcttttgtttaaataaataaataagtaaataaagctagttctattgaaatgcaaaaaaaaaata

SEQ ID NO: 63171 - DNA, 791 bp, Homo sapiens
  misc_feature (368)..(368): n is a, c, g, or t
  misc_feature (415)..(415): n is a, c, g, or t
agcgggccggctgcgagactggggccgtggctgctggtcccgggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggagatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaagtctggccttaccnaggcagtgaagaagagtacaattacattgcagcaggcagagtatgantttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagtgggttaaaaatgccacacttaatataaacccatcctccccaagaggtaccttatttcttttaggtacctttgggg

SEQ ID NO: 63172 - DNA, 619 bp, Homo sapiens
tgggattttttacccggaatacctattttcccccaggaacccagtttttgccattttttcggatttttatccgcctccctattgggagatttgggccctcgagggccaagaattcggcacgaggatacatgtgccaccatgcctggataatttttgtaaagaccagggtttcaccatattggccaggctggtctcgaactcctggcctcaagtgatccacccaccttggccccccacagtgctgggattacaggtgtgggccactgcccctggcctagactgggcaattctagctgggtttggggaggccattgaggaggctggcattggaaacctgagccagggaagggcccggaggctggagtccagtatgtttagtaggtagaatcctcagaatgcggtgcctggcgcttagtactgagcgtggtccagaggagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaatgcaaaaaaaaaata

SEQ ID NO: 63173 - DNA, 870 bp, Homo sapiens
  misc_feature (368)..(368): n is a, c, g, or t
  misc_feature (415)..(415): n is a, c, g, or t
agcgggccggctgcgagactggggccgtggctgctggtcccgggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggagatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaagtctggccttaccnaggcagtgaagaagagtacaattacattgcagcaggcagagtatgantttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagagtttgagttctaccaagcgttttccagtctgacacacacttaactcccaaattcctgactgcttgaaataatgtcccttaactcttttttctcggggaaaagataaagttcaactagcataaacataacattcttttactgttaggaattctggtcaggattccagtgttccattctgagagggttatatagcctttattgctgtttcaaaactcttagatagcttggtttataggaat

SEQ ID NO: 63174 - DNA, 2369 bp, Homo sapiens
gctcagggcacatgcctcccctccccaggccgcggcccagctgaccctcggggctcccccggcagcggacagggaagggttaaaggcccccggctccctgccccctgccctggggaacccctggccctgtggggacatgaactgtgtttgccgcctggtcctggtcgtgctgagcctgtggccagatacagctgtcgcccctgggccaccacctggcccccctcgagtttccccagaccctcgggccgagctggacagcaccgtgctcctgacccgctctctcctggcggacacgcggcagctggctgcacagctgagggacaaattcccagctgacggggaccacaacctggattccctgcccaccctggccatgagtgcgggggcactgggagctctacagctcccaggtgtgctgacaaggctgcgagcggacctactgtcctacctgcggcacgtgcagtggctgcgccgggcaggtggctcttccctgaagaccctggagcccgagctgggcaccctgcaggcccgactggaccggctgctgcgccggctgcagctcctgatgtcccgcctggccctgccccagccacccccggacccgccggcgcccccgctggcgcccccctcctcagcctgggggggcatcagggccgcccacgccatcctgggggggctgcacctgacacttgactgggccgtgaggggactgctgctgctgaagactcggctgtgacccggggcccaaagccaccaccgtccttccaaagccagatcttatttatttatttatttcagtactgggggcgaaacagccaggtgatccccccgccattatctccccctagttagagacagtccttccgtgaggcctggggggcatctgtgccttatttatacttatttatttcaggagcaggggtgggaggcaggtggactcctgggtccccgaggaggaggggactggggtcccggattcttgggtctccaagaagtctgtccacagacttctgccctggctcttccccatctaggcctgggcaggaacatatattatttatttaagcaattacttttcatgttggggtggggacggaggggaaagggaagcctgggtttttgtacaaaaatgtgagaaacctttgtgagacagagaacagggaattaaatgtgtcatacatatccacttgagggcgatttgtctgagagctggggctggatgcttgggtaactggggcagggcaggtggaggggagacctccattcaggtggaggtcccgagtgggcggggcagcgactgggagatgggtcggtcacccagacagctctgtggaggcagggtctgagccttgcctggggccccgcactgcatagggccgtttgtttgttttttgagatggagtctcgctctgttgcctaggctggagtgcagtgaggcaatctaaggtcactgcaagctccacctcccgggttcaagcaattctcctgcctcagcctcccgattagctgggatcacaggtgtgcaccaccatgcccagctaattatttatttcttttgtatttttagtagagacagggtttcaccatgttggccaggctggtttcgaactcctgacctcaggtgatcctcctgcctcggcctcccaaagtgctgggattacaggtgtgagccaccacacctgacccataggtcttcaataaatatttaatggaaggttccacaagtcaccctgtgatcaacagtacccgtatgggacaaagctgcaaggtcaagatggttcattatggctgtgttcaccatagcaaactggaaagaatctagatatccaacagtgagggttaagcaacatggtgcatctgtggatagaacgccacccagccgcccggagcagggactgtcattcagggaggctaaggagagaggcttgcttgggatatagaaagatatcctgacattggccaggcatggtggctcacgcctgtaatcctggcactttgggaggacgaagcgagtggatcactgaagtccaagagtttgagaccggcctgcgagacatggcaaaaccctgtctcaaaaaagaaagaatgatgtcctgacatgaaacagcaggctacaaaaccactgcatgctgtgatcccaattttgtgtttttctttctatatatggattaaaacaaaaatcctaaagggaaatacgccaaaatgttgacaatgactgtctccaggtcaaaggagagaggtgggattgtgggtgacttttaatgtgtatgattgtctgtattttacagaatttctgccatgactgtgtattttgcatgacacattttaaaaataataaacactatttttagaataacagaaaaaaaacc

SEQ ID NO: 63175 - DNA, 1901 bp, Homo sapiens
gctcagggcacatgcctcccctccccaggccgcggcccagctgaccctcggggctcccccggcagcggacagggaagggttaaaggcccccggctccctgccccctgccctggggaacccctggccctgtggggacatgaactgtgtttgccgcctggtcctggtcgtgctgagcctgtggccagatacagctgtcgcccctgggccaccacctggcccccctcgagtttccccagaccctcgggccgagctggacagcaccgtgctcctgacccgctctctcctggcggacacgcggcagctggctgcacagctgagggacaaattcccagctgacggggaccacaacctggattccctgcccaccctggccatgagtgcgggggcactgggagctctacagctcccaggtgtgctgacaaggctgcgagcggacctactgtcctacctgcggcacgtgcagtggctgcgccgggcaggtggctcttccctgaagaccctggagcccgagctgggcaccctgcaggcccgactggaccggctgctgcgccggctgcagctcctgatgtcccgcctggccctgccccagccacccccggacccgccggcgcccccgctggcgcccccctcctcagcctgggggggcatcagggccgcccacgccatcctgggggggctgcacctgacacttgactgggccgtgaggggactgctgctgctgaagactcggctgtgacccggggcccaaagccaccaccgtccttccaaagccagatcttatttatttatttatttcagtactgggggcgaaacagccaggtgatccccccgccattatctccccctagttagagacagtccttccgtgaggcctggggggcatctgtgccttatttatacttatttatttcaggagcaggggtgggaggcaggtggactcctgggtccccgaggaggaggggactggggtcccggattcttgggtctccaagaagtctgtccacagacttctgccctggctcttccccatctaggcctgggcaggaacatatattatttatttaagcaattacttttcatgttggggtggggacggaggggaaagggaagcctgggtttttgtacaaaaatgtgagaaacctttgtgagacagagaacagggaattaaatgtgtcatacatatccacttgagggcgatttgtctgagagctggggctggatgcttgggtaactggggcagggcaggtggaggggagacctccattcaggtggaggtcccgagtgggcggggcagcgactgggagatgggtcggtcacccagacagctctgtggaggcagggtctgagccttgcctggggccccgcactgcatagggccgtttgtttgttttttgagatggagtctcgctctgttgcctaggctggagtgcagtgaggcaatctaaggtcactgcaagctccacctcccgggttcaagcaattctcctgcctcagcctcccgattagctgggatcacaggtgtgcaccaccatgcccagctaattatttatttcttttgtatttttagtagagaccggcctgcgagacatggcaaaaccctgtctcaaaaaagaaagaatgatgtcctgacatgaaacagcaggctacaaaaccactgcatgctgtgatcccaattttgtgtttttctttctatatatggattaaaacaaaaatcctaaagggaaatacgccaaaatgttgacaatgactgtctccaggtcaaaggagagaggtgggattgtgggtgacttttaatgtgtatgattgtctgtattttacagaatttctgccatgactgtgtattttgcatgacacattttaaaaataataaacactatttttagaataacagaaaaaaaacc

SEQ ID NO: 63176 - DNA, 1185 bp, Homo sapiens
gctcagggcacatgcctcccctccccaggccgcggcccagctgaccctcggggctcccccggcagcggacagggaagggttaaaggcccccggctccctgccccctgccctggggaacccctggccctgtggggacatgaactgtgtttgccgcctggtcctggtcgtgctgagcctgtggccagatacagctgtcgcccctgggccaccacctggcccccctcgagtttccccagaccctcgggccgagctggacagcaccgtgctcctgacccgctctctcctggcggacacgcggcagctggctgcacagctgagggacaaattcccagctgacggggaccacaacctggattccctgcccaccctggccatgagtgcgggggcactgggagctctacagctcccaggtgtgctgacaaggctgcgagcggacctactgtcctacctgcggcacgtgcagtggctgcgccgggcaggtggctcttccctgaagaccctggagcccgagctgggcaccctgcaggcccgactggaccggctgctgcgccggctgcagctcctgatgtcccgcctggccctgccccagccacccccggacccgccggcgcccccgctggcgcccccctcctcagcctgggggggcatcagggccgcccacgccatcctgggggggctgcacctgacacttgactgggccgtgaggggactgctgctgctgaagactcggctgtgacccggggcccaaagccaccaccgtccttccaaagccagatcttatttatttatttatttcagtactgggggcgaaacagccaggtgatccccccgccattatctccccctagttagagacagtccttccgtgaggcctggggggcatctgtgccttatttatacttatttatttcaggagcaggggtgggaggcaggtggactcctgggtccccgaggaggaggggactggggtcccggattcttgggtctccaagaagtctgtccacagacttctgccctggctcttccccatctaggcctgggcaggaacatatattatttatttaagcaattacttttcatgttggggtggggacggaggggaaagggaagcctgggtttttgtacaaaaatgtgagaaacctttgtgagacagagaacagggaattaaatgtgtcatacatatcc

SEQ ID NO: 63177 - DNA, 1186 bp, Homo sapiens
aagggaggggctgtgtttccatctcaaagaaggcatttgcagggtcctcttctgggcctgaccaaacagccaactagcccctggggtggccaccagtatgacagtattatacgctggcaacacagaggcagcccgcacacctgcgcctgggtgttgagagccatcctgcaagtctttttcaacagaacttcacagactgttagagctgctgagaagaatttgctttccgaattcagcctggaaggcgcccagggacagctgtactgagtctagatgactctgacccccgccccaggtcaaggccagcagagcagtcagtgcctctggagaaggcccttgctctcccacctggcccagactccgaggagcctgggtctggagctgccggtctggttcttccctttagagcccggatctgccacctgcggcccctcccaagccgtgaaccagctcatgagagatgaacactgtgggatccactcaggaaggctcggggctggcacaaaggaccacccagcattgccctgtgccacccagcactcagtggacattctggggacctgccttcagccttttcctgccctgtgcctgacatcagcaccctggctggtcagaatgccgccctcccagaggagcagccgagagatcccctgaaggctggaggcattctgctcaggacccctatcccagctcacagtgcccaaccatctcaccaggagaaagagccacatccccacgttaggaccacggagactgaccaccaccctgaccccccaaacccacgcaccagacgcttgcaggacaggcgccgcgcagcgggcaggggcttgcccggccgaccctcccctccccacctcccccactgcgcgttactccaggatatgccgagtgcacgtataaggtcatcttcgtcgtccccgtggacctcccccttcctctgcacgtcgtccaacgtgggactggcgtgtcgggcttccctgggaggatctggaggttgttctctgcagagaaccagcctggctcctggcgcgcacctctgctcccttctcctcactacccacccacgcatgtaccgggaaaaaaactactatgcccttctagaccatgttctgagaaaagatcgaaaatatttaacaagagataataataaatctgatgccggtctttgtgtgtgttgcggaaaaaa

SEQ ID NO: 63178 - DNA, 1068 bp, Homo sapiens
aagggaggggctgtgtttccatctcaaagaaggcatttgcagggtcctcttctgggcctgaccaaacagccaactagcccctggggtggccaccagtatgacagtattatacgctggcaacacagaggcagcccgcacacctgcgcctgggtgttgagagccatcctgcaagtctttttcaacagaacttcacagactgttagagctgctgagaagaatttgctttccgaattcagcctggaaggcgcccagggacagctgtactgagtctagatgactctgacccccgccccaggtcaaggccagcagagcagtcagtgcctctggagaaggcccttgctctcccacctggcccagactccgaggagcctgggtctggagctgccggtctggttcttccctttagagcccggatctgccacctgcggcccctcccaagccgtgaaccagctcatgagagatgaacactgtgggatccactcaggaaggctcggggctggcacaaaggaccacccagcattgccctgtgccacccagcactcagtggacattctggggacctgccttcagccttttcctgccctgtgcctgacatcagcaccctggctggtcagaatgccgccctcccagaggagcagccgagagatcccctgaaggctggaggcattctgctcaggacccctatcccagctcacagtgcccaaccatctcaccaggagaaagagccacaccccacctcccccactgcgcgttactccaggatatgccgagtgcacgtataaggtcatcttcgtcgtccccgtggacctcccccttcctctgcacgtcgtccaacgtgggactggcgtgtcgggcttccctgggaggatctggaggttgttctctgcagagaaccagcctggctcctggcgcgcacctctgctcccttctcctcactacccacccacgcatgtaccgggaaaaaaactactatgcccttctagaccatgttctgagaaaagatcgaaaatatttaacaagagataataataaatctgatgccggtctttgtgtgtgttgcggaaaaaa

SEQ ID NO: 63179 - DNA, 236 bp, Homo sapiens
attttaagctgataacaacttagcattgttttcaaagacaaacgagctaaaaaaaagactaataaagacttttaagccttaacttcatcccccatattttaaaaattttcctgtgactatttatatctaattatactatgtattgaagagttgttgtagttattattttttattggtttatagtttagtctttctacttaagatacttacacaccacagttagagcattataatat

SEQ ID NO: 63180 - DNA, 248 bp, Homo sapiens
ccacatcatatccatttgctcattggactacttcaaaagagaagctctaaggacatccaaagatcctaagtgaaaaatcaccctggctgcacgggtcaagccaggacacagggccaaaggtcggtcagcactgacacgctgagcccaggcgtttgctttccagatgagacctgcaccgctggaccagcaatgtagcagaggcagcaggaagagggagatggagccaaagggtttctggacaggcggtt

SEQ ID NO: 63181 - DNA, 306 bp, Homo sapiens
ccaagcccgtctccctcaaggaattgggaagacctggaaaaccatgctcatcaaatttcctctagcactagcctgctgtctcctgatattcttcactaaaaatggatcctttgtgcttatcatagtaatggtgacttctagaaaatgtaagcgatgaatgttcttttttgccaagcctccagctcagttcgctaaaggaatttttcaggatcatcagaaggaatcggaaaaaacagatgctttcagagacttgaattaagtatccttgcaacaaccaggcaataaagttgaatgtagtttttagac

SEQ ID NO: 63182 - DNA, 646 bp, Homo sapiens
agacagtgctagtgttatcagcatacaatagaaagctgtaaccatgttagctaatgagatagccagtgaaaagaaggacgatgatgtgattttaaaaatagaagaaaaggaacctaaatcagaactaagaaaagatagtggtaggaaatggatgcaaaaggataagagtttcagaataagaaaatggccagcattttcatttacttcagcaggtggaagtaagaaataattctttgggttgtgaaattttgtagtattgatggtttttaaggggttcagtgaaagtgagaagtaacggggtggtatttttgagagggactgtttagaacagtggggagttccattgaagtggtagaggtggaggcattaatactactctttcaagaagaaaatctcaagaaaaccaaagaaataaaggttaaccaagctttggatgaggcactagcacattttgtctcaagcatgtcaggttcaattattagtatcacccacacctcttattaagctaggtaggtcacttactgggaggtggttttgcctctgctaattgcacattagcaaatccatgccactgcatgtcactgttacttctcagatgttagttaactagaaacaatacaaatatctgatagtactctgtctcaaa

SEQ ID NO: 63183 - DNA, 432 bp, Homo sapiens
atcctctttctgtcacattgcagacatcaagccaaagtgacttgttcaactcctgttttgatgtcgaagatatcacatactttgaaaatgatttctgattattttccccatagtcttgccatctttaaaaatagtttttcaagtgaattctagctctcacccacctttcctgaagtgcgtggctttttgtaattactaaaaatgactatttctttataaccagagaaataaaatgccagaatgttaataactgattatattacataaattcattttagatctctgaattatctagattccaaaaatcactgaccatagaacattaaattattgaaagtatgtctggacatatctttaaatcatgaaatcaagtgagttttggagtgatcctaaggtatactaaacattttgtttagtttgtgatattaattt

SEQ ID NO: 63184 - DNA, 343 bp, Homo sapiens
tcttttgtgatggaagtggctcacatcacttacttatattacccactaggctccaagcatttatgtttgcaattcctgaaccaaataagtgcattagatatatatcaaaggtgaacctgattataggggttggtgtgggaagtctcttgaagaacgagagggctaaaggagttttaaagaaatggaacacaaaaaagaaaatggattgttcaatctacacagtgccaactgtttgggaaaacacttggaatcaaataagtgtgcagtgtctttagagatgtaatacaaatatgatgctgaaaggaacattatgtatttagagaatagtaatatgtaaagatgg

SEQ ID NO: 63185 - DNA, 2548 bp, Homo sapiens
  misc_feature (1)..(1): n is a, c, g, or t
  misc_feature (3)..(4): n is a, c, g, or t
  misc_feature (7)..(7): n is a, c, g, or t
  misc_feature (9)..(10): n is a, c, g, or t
ncnngcntnntgctgtgcaggagtcggcagctggcgccagggcggccggaggatgccgaggggccggagccgggcgggcccgaggccgaggcgcactctacccccagctcctaccctgtaagccccgccagcctccggacgtgctgtccctgggcccgtcgccctctgggctcccgccggaactccttcactctcagaggccgagtccctcccctccccacggctgcgtgtggccgttgccgtctgcacccagaccctgagccgccgccgccggccatggaggtggcgccggagcagccgcgctggatggcgcacccggccgtgctgaatgcgcagcaccccgactcacaccacccgggcctggcgcacaactacatggaacccgcgcagctgctgcctccagacgaggtggacgtcttcttcaatcacctcgactcgcagggcaacccctactatgccaaccccgctcacgcgcgggcgcgcgtctcctacagccccgcgcacgcccgcctgaccggaggccagatgtgccgcccacacttgttgcacagcccgggtttgccctggctggacgggggcaaagcagccctctctgccgctgcggcccaccaccacaacccctggaccgtgagccccttctccaagacgccactgcacccctcagctgctggaggccctggaggcccactctctgtgtacccaggggctgggggtgggagcgggggaggcagcgggagctcagtggcctccctcacccctacagcagcccactctggctcccaccttttcggcttcccacccacgccacccaaagaagtgtctcctgaccctagcaccacgggggctgcgtctccagcctcatcttccgcggggggtagtgcagcccgaggagaggacaaggacggcgtcaagtaccaggtgtcactgacggagagcatgaagatggaaagtggcagtcccctgcgcccaggcctagctactatgggcacccagcctgctacacaccaccccatccccacctacccctcctatgtgccggcggctgcccacgactacagcagcggactcttccaccccggaggcttcctggggggaccggcctccagcttcacccctaagcagcgcagcaaggctcgttcctgttcagaaggccgggagtgtgtcaactgtggggccacagccacccctctctggcggcgggacggcaccggccactacctgtgcaatgcctgtggcctctaccacaagatgaatgggcagaaccgaccactcatcaagcccaagcgaagactgacgacaaccaccaccttatggcgccgaaacgccaacggggaccctgtctgcaacgcctgtggcctctactacaagctgcacaatgttaacaggccactgaccatgaagaaggaagggatccagactcggaaccggaagatgtccaacaagtccaagaagagcaagaaaggggcggagtgcttcgaggagctgtcaaagtgcatgcaggagaagtcatcccccttcagtgcagctgccctggctggacacatggcacctgtgggccacctcccgcccttcagccactccggacacatcctgcccactccgacgcccatccacccctcctccagcctctccttcggccacccccacccgtccagcatggtgaccgccatgggctagggaacagatggacgtcgaggaccgggcactcccgggatgggtggaccaaacccttagcagcccagcatttcccgaaggccgacaccactcctgccagcccggctcggcccagcaccccctctcctggagggcgcccagcagcctgccagcagttactgtgaatgttccccaccgctgagaggctgcctccgcacctgaccgctgcccaggtggggtttcctgcatggacagttgtttggagaacaacaaggacaactttatgtagagaaaaggaggggacgggacagacgaaggcaaccatttttagaaggaaaaaggattaggcaaaaataatttattttgctcttgtttctaacaaggacttggagacttggtggtctgagctgtcccaagtcctccggttcttcctcgggattggcgggtccacttgccagggctctgggggcagatttgtggggacctcagcctgcaccctcttctcctctggcttccctctctgaaatagccgaactccaggctgggctgagccaaagccagagtggccacggcccagggagggtgagctggtgcctgctttgacgggccaggccctggagggcagagacaatcacgggcggtcctgcacagattcccaggccagggctgggtcacaggaaggaaacaacattttcttgaaaggggaaacgtctcccagatcgctcccttggctttgaggccgaagctgctgtgactgtgtccccttactgagcgcaagccacagcctgtcttgtcaggtggaccctgtaaatacatcctttttctgctaacccttcaaccccctcgcctcctactctgagacaaaagaaaaaatattaaaaaaatgcataggctt

SEQ ID NO: 63186 - DNA, 262 bp, Homo sapiens
aaccgtaaccctggcctccagcttcacccctaagcagcgcatcaaggctcgttcctgttcctgttcagaaggccgggagtgtgtcaactgtggggccacagccacccctctctggcggcgggacggcaccggccactacctgtgcaatgcctgtggcctctaccacaagatgaatgggcagaaccgaccactcatcaagcccaagcgaagactgtttgcgccgcctgaagagccgcacatactgccgatttcagacgcaacc

SEQ ID NO: 63187 - DNA, 3440 bp, Homo sapiens
  misc_feature (1)..(1): n is a, c, g, or t
  misc_feature (3)..(4): n is a, c, g, or t
  misc_feature (7)..(7): n is a, c, g, or t
  misc_feature (9)..(10): n is a, c, g, or t
  misc_feature (3390)..(3390): n is a, c, g, or t
  misc_feature (3437)..(3437): n is a, c, g, or t
ncnngcntnntgctgtgcaggagtcggcagctggcgccagggcggccggaggatgccgaggggccggagccgggcgggcccgaggccgaggcgcactctacccccagctcctaccctgtaagccccgccagcctccggacgtgctgtccctgggcccgtcgccctctgggctcccgccggaactccttcactctcagaggccgagtccctcccctccccacggctgcgtgtggccgttgccgtctgcacccagaccctgagccgccgccgccggccatggaggtggcgccggagcagccgcgctggatggcgcacccggccgtgctgaatgcgcagcaccccgactcacaccacccgggcctggcgcacaactacatggaacccgcgcagctgctgcctccagacgaggtggacgtcttcttcaatcacctcgactcgcagggcaacccctactatgccaaccccgctcacgcgcgggcgcgcgtctcctacagccccgcgcacgcccgcctgaccggaggccagatgtgccgcccacacttgttgcacagcccgggtttgccctggctggacgggggcaaagcagccctctctgccgctgcggcccaccaccacaacccctggaccgtgagccccttctccaagacgccactgcacccctcagctgctggaggccctggaggcccactctctgtgtacccaggggctgggggtgggagcgggggaggcagcgggagctcagtggcctccctcacccctacagcagcccactctggctcccaccttttcggcttcccacccacgccacccaaagaagtgtctcctgaccctagcaccacgggggctgcgtctccagcctcatcttccgcggggggtagtgcagcccgaggagaggacaaggacggcgtcaagtaccaggtgtcactgacggagagcatgaagatggaaagtggcagtcccctgcgcccaggcctagctactatgggcacccagcctgctacacaccaccccatccccacctacccctcctatgtgccggcggctgcccacgactacagcagcggactcttccaccccggaggcttcctggggggaccggcctccagcttcacccctaagcagcgcagcaaggctcgttcctgttcagaaggccgggagtgtgtcaactgtggggccacagccacccctctctggcggcgggacggcaccggccactacctgtgcaatgcctgtggcctctaccacaagatgaatgggcagaaccgaccactcatcaagcccaagcgaagactgtcggccgccagaagagccggcacctgttgtgcaaattgtcagacgacaaccaccaccttatggcgccgaaacgccaacggggaccctgtctgcaacgcctgtggcctctactacaagctgcacaatgttaacaggccactgaccatgaagaaggaagggatccagactcggaaccggaagatgtccaacaagtccaagaagagcaagaaaggggcggagtgcttcgaggagctgtcaaagtgcatgcaggagaagtcatcccccttcagtgcagctgccctggctggacacatggcacctgtgggccacctcccgcccttcagccactccggacacatcctgcccactccgacgcccatccacccctcctccagcctctccttcggccacccccacccgtccagcatggtgaccgccatgggctagggaacagatggacgtcgaggaccgggcactcccgggatgggtggaccaaacccttagcagcccagcatttcccgaaggccgacaccactcctgccagcccggctcggcccagcaccccctctcctggagggcgcccagcagcctgccagcagttactgtgaatgttccccaccgctgagaggctgcctccgcacctgaccgctgcccaggtggggtttcctgcatggacagttgtttggagaacaacaaggacaactttatgtagagaaaaggaggggacgggacagacgaaggcaaccatttttagaaggaaaaaggattaggcaaaaataatttattttgctcttgtttctaacaaggacttggagacttggtggtctgagctgtcccaagtcctccggttcttcctcgggattggcgggtccacttgccagggctctgggggcagatttgtggggacctcagcctgcaccctcttctcctctggcttccctctctgaaatagccgaactccaggctgggctgagccaaagccagagtggccacggcccagggagggtgagctggtgcctgctttgacgggccaggccctggagggcagagacaatcacgggcggtcctgcacagattcccaggccagggctgggtcacaggaaggaaacaacattttcttgaaaggggaaacgtctcccagatcgctcccttggctttgaggccgaagctgctgtgactgtgtccccttactgagcgcaagccacagcctgtcttgtcaggtggaccctgtaaatacatcctttttctgctaacccttcaaccccctcgcctcctactctgagacaaaagaaaaaatattaaaaaaatgcataggcttaactcgctgatgagttaattgttttatttttaaactctttttgggtccagttgattgtacgtagccacaggagccctgctatgaaaggaataaaacctacacacaaggttggagctttgcaattctttttggaaaagagctgggatcccacagccctagtatgaaagctgggggtggggaggggcctttgctgcccttggtttctgggggctggttggcatttgctggcctggcagggggtgaaggcaggagttgggggcaggtcaggaccaggacccagggagaggctgtgtccctgctggggtctcaggtccagctttactgtggctgtctggatccttcccaaggtacagctgtatataaacgtgtcccgagcttagattctgtatgcggtgacggcggggtgtggtggcctgtgaggggcccctggcccaggaggaggattgtgctgatgtagtgaccaagtgcaatatgggcgggcagtcgctgcagggagcaccacggccagaagtaacttattttgtactagtgtccgcataagaaaaagaatcggcagtattttctgtttttatgttttatttggcttgttttattttggattagtgaactaagttattgttaattatgtacaacatttatatattgtctgtaaaaaatgtatgctatcctcttattcctttaaagtgagtactgttaagaataataaaatactttttgtgaatgcccgccaaaaaaaaaaaaaaaagcggcgcccaatttcgacgcggcgcgaatcctgcagccggggtcactagtctaancggcgcaccgcgtggagcccagctttgttccctagtgaggttcgctngcg

SEQ ID NO: 63188 - DNA, 3133 bp, Homo sapiens
  misc_feature (1)..(1): n is a, c, g, or t
  misc_feature (3)..(4): n is a, c, g, or t
  misc_feature (7)..(7): n is a, c, g, or t
  misc_feature (9)..(10): n is a, c, g, or t
  misc_feature (3083)..(3083): n is a, c, g, or t
  misc_feature (3130)..(3130): n is a, c, g, or t
ncnngcntnntgctgtgcaggagtcggcagctggcgccagggcggccggaggatgccgaggggccggagccgggcgggcccgaggccgaggcgcactctacccccagctcctaccctgtaagccccgccagcctccggacgtgctgtccctgggcccgtcgccctctgggctcccgccggaactccttcactctcagaggccgagtccctcccctccccacggctgcgtgtggccgttgccgtctgcacccagaccctgagccgccgccgccggccatggaggtggcgccggagcagccgcgctggatggcgcacccggccgtgctgaatgcgcagcaccccgactcacaccacccgggcctggcgcacaactacatggaacccgcgcagctgctgcctccagacgaggtggacgtcttcttcaatcacctcgactcgcagggcaacccctactatgccaaccccgctcacgcgcgggcgcgcgtctcctacagccccgcgcacgcccgcctgaccggaggccagatgtgccgcccacacttgttgcacagcccgggtttgccctggctggacgggggcaaagcagccctctctgccgctgcggcccaccaccacaacccctggaccgtgagccccttctccaagacgccactgcacccctcagctgctggaggccctggaggcccactctctgtgtacccaggggctgggggtgggagcgggggaggcagcgggagctcagtggcctccctcacccctacagcagcccactctggctcccaccttttcggcttcccacccacgccacccaaagaagtgtctcctgaccctagcaccacgggggctgcgtctccagcctcatcttccgcggggggtagtgcagcccgaggagaggacaaggacggcgtcaagtaccaggtgtcactgacggagagcatgaagatggaaagtggcagtcccctgcgcccaggcctagctactatgggcacccagcctgctacacaccaccccatccccacctacccctcctatgtgccggcggctgcccacgactacagcagcggactcttccaccccggaggcttcctggggggaccggcctccagcttcacccctaagcagcgcagcaaggctcgttcctgttcagaaggccgggagtgtgtcaactgtggggccacagccacccctctctggcggcgggacggcaccggccactacctgtgcaatgcctgtggcctctaccacaagatgaatgggcagaaccgaccactcatcaagcccaagcgaagactgtcggccgccagaagagccggcacctgttgtgcaaattgtcagacgacaaccaccaccttatggcgccgaaacgccaacggggaccctgtctgcaacgcctgtggcctctactacaagctgcacaatgttaacaggccactgaccatgaagaaggaagggatccagactcggaaccggaagatgtccaacaagtccaagaagagcaagaaaggggcggagtgcttcgaggagctgtcaaagtgcatgcaggagaagtcatcccccttcagtgcagctgccctggctggacacatggcacctgtgggccacctcccgcccttcagccactccggacacatcctgcccactccgacgcccatccacccctcctccagcctctccttcggccacccccacccgtccagcatggtgaccgccatgggctagggaacagatggacgtcgaggaccgggcactcccgggatgggtggaccaaacccttagcagcccagcatttcccgaaggccgacaccactcctgccagcccggctcggcccagcaccccctctcctggagggcgcccagcagcctgccagcagttactgtgaatgttccccaccgctgagaggctgcctccgcacctgaccgctgcccaggtggggtttcctgcatggacagttgtttggagaacaacaaggacaactttatgtagagaaaaggaggggacgggacagacgaaggcaaccatttttagaaggaaaaaggattaggcaaaaataatttattttgctcttgtttctaacaaggacttggagacttggtggtctgagctgtcccaagtcctccggttcttcctcgggattggcgggtccacttgccagggctctgggggcagatttgtggggacctcagcctgcaccctcttctcctctggcttccctctctgaaatagccgaactccaggctgggctgagccaaagccagagtggccacggcccagggagggtgagctggtgcctgctttgacgggccaggccctggagggcagagacaatcacgggcggtcctgcaggaattcgagctcggtaccctgcaacagattcccaggccagggctgggtcacaggaaggaaacaacattttcttgaaaggggaaacgtctcccagatcgctcccttggctttgaggccgaagctgctgtgactgtgtccccttactgagcgcaagccacagcctgtcttgtcaggtggaccctgtaaatacatcctttttctgctaacccttcaaccccgggagaggctgtgtccctgctggggtctcaggtccagctttactgtggctgtctggatccttcccaaggtacagctgtatataaacgtgtcccgagcttagattctgtatgcggtgacggcggggtgtggtggcctgtgaggggcccctggcccaggaggaggattgtgctgatgtagtgaccaagtgcaatatgggcgggcagtcgctgcagggagcaccacggccagaagtaacttattttgtactagtgtccgcataagaaaaagaatcggcagtattttctgtttttatgttttatttggcttgttttattttggattagtgaactaagttattgttaattatgtacaacatttatatattgtctgtaaaaaatgtatgctatcctcttattcctttaaagtgagtactgttaagaataataaaatactttttgtgaatgcccgccaaaaaaaaaaaaaaaagcggcgcccaatttcgacgcggcgcgaatcctgcagccggggtcactagtctaancggcgcaccgcgtggagcccagctttgttccctagtgaggttcgctngcg

SEQ ID NO: 63189 - DNA, 4052 bp, Homo sapiens
  misc_feature (4002)..(4002): n is a, c, g, or t
  misc_feature (4049)..(4049): n is a, c, g, or t
gcgtgtgctcacagctcctgagggtccccggggagagtctcagtaaagacgtgtcccaagctttctgagcaagcatccctgaggtcaggggcgcgcgtgtgcgctccggagagggtgggagcggcctggagtgtggatgcacagggtgtgcgcgccctgagtgcctagcggcccttggccggccaggcggctggacctggtaggccgggtgcagagccccgggtaccctcctgccccctgcggcgctcccgcccccgtcgccaccccctgcccccccgcaaagtgatgtcgaaataaaaagccgcgttgcggccggtgggggagagagaggcagcgtgagcgccaggaaggtagcgaggccagcgtcgccccgggactcgctgctcaagtctgtctattgcctgccgccacatccatcctagcagggccccgtcgcccaccaggcggacaaaagcggtccgctgaacaccatgcggccgctcggcgtgccgcccaggctctgctggtgagcgccgccaccccgcgcccaggtcccgcgagcccgcctgccgcgcacctcgccctgctcccagctctactccaggccccgtccgcccgggggcgccgcccaccgcgcctcgctcggcttgaactccgcgttgctccaaccacgaggggaaaggccccgcgttcagggaccccgtgtgtggcgaacgctcctttaccggaaaacaaggaaggaaattcgttgttttggaaaaagcctcctctcccgaggtcgggaacatctggtggtgagctccaggtctacgcaggcaccccgtgctaggattcgtttatgagcaggcaggattcgagaaccagggccgttgccgtctgcacccagaccctgagccgccgccgccggccatggaggtggcgccggagcagccgcgctggatggcgcacccggccgtgctgaatgcgcagcaccccgactcacaccacccgggcctggcgcacaactacatggaacccgcgcagctgctgcctccagacgaggtggacgtcttcttcaatcacctcgactcgcagggcaacccctactatgccaaccccgctcacgcgcgggcgcgcgtctcctacagccccgcgcacgcccgcctgaccggaggccagatgtgccgcccacacttgttgcacagcccgggtttgccctggctggacgggggcaaagcagccctctctgccgctgcggcccaccaccacaacccctggaccgtgagccccttctccaagacgccactgcacccctcagctgctggaggccctggaggcccactctctgtgtacccaggggctgggggtgggagcgggggaggcagcgggagctcagtggcctccctcacccctacagcagcccactctggctcccaccttttcggcttcccacccacgccacccaaagaagtgtctcctgaccctagcaccacgggggctgcgtctccagcctcatcttccgcggggggtagtgcagcccgaggagaggacaaggacggcgtcaagtaccaggtgtcactgacggagagcatgaagatggaaagtggcagtcccctgcgcccaggcctagctactatgggcacccagcctgctacacaccaccccatccccacctacccctcctatgtgccggcggctgcccacgactacagcagcggactcttccaccccggaggcttcctggggggaccggcctccagcttcacccctaagcagcgcagcaaggctcgttcctgttcagaaggccgggagtgtgtcaactgtggggccacagccacccctctctggcggcgggacggcaccggccactacctgtgcaatgcctgtggcctctaccacaagatgaatgggcagaaccgaccactcatcaagcccaagcgaagactgtcggccgccagaagagccggcacctgttgtgcaaattgtcagacgacaaccaccaccttatggcgccgaaacgccaacggggaccctgtctgcaacgcctgtggcctctactacaagctgcacaatgttaacaggccactgaccatgaagaaggaagggatccagactcggaaccggaagatgtccaacaagtccaagaagagcaagaaaggggcggagtgcttcgaggagctgtcaaagtgcatgcaggagaagtcatcccccttcagtgcagctgccctggctggacacatggcacctgtgggccacctcccgcccttcagccactccggacacatcctgcccactccgacgcccatccacccctcctccagcctctccttcggccacccccacccgtccagcatggtgaccgccatgggctagggaacagatggacgtcgaggaccgggcactcccgggatgggtggaccaaacccttagcagcccagcatttcccgaaggccgacaccactcctgccagcccggctcggcccagcaccccctctcctggagggcgcccagcagcctgccagcagttactgtgaatgttccccaccgctgagaggctgcctccgcacctgaccgctgcccaggtggggtttcctgcatggacagttgtttggagaacaacaaggacaactttatgtagagaaaaggaggggacgggacagacgaaggcaaccatttttagaaggaaaaaggattaggcaaaaataatttattttgctcttgtttctaacaaggacttggagacttggtggtctgagctgtcccaagtcctccggttcttcctcgggattggcgggtccacttgccagggctctgggggcagatttgtggggacctcagcctgcaccctcttctcctctggcttccctctctgaaatagccgaactccaggctgggctgagccaaagccagagtggccacggcccagggagggtgagctggtgcctgctttgacgggccaggccctggagggcagagacaatcacgggcggtcctgcacagattcccaggccagggctgggtcacaggaaggaaacaacattttcttgaaaggggaaacgtctcccagatcgctcccttggctttgaggccgaagctgctgtgactgtgtccccttactgagcgcaagccacagcctgtcttgtcaggtggaccctgtaaatacatcctttttctgctaacccttcaaccccctcgcctcctactctgagacaaaagaaaaaatattaaaaaaatgcataggcttaactcgctgatgagttaattgttttatttttaaactctttttgggtccagttgattgtacgtagccacaggagccctgctatgaaaggaataaaacctacacacaaggttggagctttgcaattctttttggaaaagagctgggatcccacagccctagtatgaaagctgggggtggggaggggcctttgctgcccttggtttctgggggctggttggcatttgctggcctggcagggggtgaaggcaggagttgggggcaggtcaggaccaggacccagggagaggctgtgtccctgctggggtctcaggtccagctttactgtggctgtctggatccttcccaaggtacagctgtatataaacgtgtcccgagcttagattctgtatgcggtgacggcggggtgtggtggcctgtgaggggcccctggcccaggaggaggattgtgctgatgtagtgaccaagtgcaatatgggcgggcagtcgctgcagggagcaccacggccagaagtaacttattttgtactagtgtccgcataagaaaaagaatcggcagtattttctgtttttatgttttatttggcttgttttattttggattagtgaactaagttattgttaattatgtacaacatttatatattgtctgtaaaaaatgtatgctatcctcttattcctttaaagtgagtactgttaagaataataaaatactttttgtgaatgcccgccaaaaaaaaaaaaaaaagcggcgcccaatttcgacgcggcgcgaatcctgcagccggggtcactagtctaancggcgcaccgcgtggagcccagctttgttccctagtgaggttcgctngcg

SEQ ID NO: 63190 - DNA, 3266 bp, Homo sapiens
  misc_feature (1)..(1): n is a, c, g, or t
  misc_feature (3)..(4): n is a, c, g, or t
  misc_feature (7)..(7): n is a, c, g, or t
  misc_feature (9)..(10): n is a, c, g, or t
  misc_feature (3216)..(3216): n is a, c, g, or t
  misc_feature (3263)..(3263): n is a, c, g, or t
ncnngcntnntgctgtgcaggagtcggcagctggcgccagggcggccggaggatgccgaggggccggagccgggcgggcccgaggccgaggcgcactctacccccagctcctaccctgtaagccccgccagcctccggacgtgctgtccctgggcccgtcgccctctgggctcccgccggaactccttcactctcagaggccgagtccctcccctccccacggctgcgtgtggccgttgccgtctgcacccagaccctgagccgccgccgccggccatggaggtggcgccggagcagccgcgctggatggcgcacccggccgtgctgaatgcgcagcaccccgactcacaccacccgggcctggcgcacaactacatggaacccgcgcagctgctgcctccagacgaggtggacgtcttcttcaatcacctcgactcgcagggcaacccctactatgccaaccccgctcacgcgcgggcgcgcgtctcctacagccccgcgcacgcccgcctgaccggaggccagatgtgccgcccacacttgttgcacagcccgggtttgccctggctggacgggggcaaagcagccctctctgccgctgcggcccaccaccacaacccctggaccgtgagccccttctccaagacgccactgcacccctcagctgctggaggccctggaggcccactctctgtgtacccaggggctgggggtgggagcgggggaggcagcgggagctcagtggcctccctcacccctacagcagcccactctggctcccaccttttcggcttcccacccacgccacccaaagaagtgtctcctgaccctagcaccacgggggctgcgtctccagcctcatcttccgcggggggtagtgcagcccgaggagaggacaaggacggcgtcaagtaccaggtgtcactgacggagagcatgaagatggaaagtggcagtcccctgcgcccaggcctagctactatgggcacccagcctgctacacaccaccccatccccacctacccctcctatgtgccggcggctgcccacgactacagcagcggactcttccaccccggaggcttcctggggggaccggcctccagcttcacccctaagcagcgcagcaaggctcgttcctgttcagaaggccgggagtgtgtcaactgtggggccacagccacccctctctggcggcgggacggcaccggccactacctgtgcaatgcctgtggcctctaccacaagatgaatgggcagaaccgaccactcatcaagcccaagcgaagactgtcggccgccagaagagccggcacctgttgtgcaaattgtcagacgacaaccaccaccttatggcgccgaaacgccaacggggaccctgtctgcaacgcctgtggcctctactacaagctgcacaatgttaacaggccactgaccatgaagaaggaagggatccagactcggaaccggaagatgtccaacaagtccaagaagagcaagaaaggggcggagtgcttcgaggagctgtcaaagtgcatgcaggagaagtcatcccccttcagtgcagctgccctggctggacacatggcacctgtgggccacctcccgcccttcagccactccggacacatcctgcccactccgacgcccatccaagcaccccctctcctggagggcgcccagcagcctgccagcagttactgtgaatgttccccaccgctgagaggctgcctccgcacctgaccgctgcccaggtggggtttcctgcatggacagttgtttggagaacaacaaggacaactttatgtagagaaaaggaggggacgggacagacgaaggcaaccatttttagaaggaaaaaggattaggcaaaaataatttattttgctcttgtttctaacaaggacttggagacttggtggtctgagctgtcccaagtcctccggttcttcctcgggattggcgggtccacttgccagggctctgggggcagatttgtggggacctcagcctgcaccctcttctcctctggcttccctctctgaaatagccgaactccaggctgggctgagccaaagccagagtggccacggcccagggagggtgagctggtgcctgctttgacgggccaggccctggagggcagagacaatcacgggcggtcctgcacagattcccaggccagggctgggtcacaggaaggaaacaacattttcttgaaaggggaaacgtctcccagatcgctcccttggctttgaggccgaagctgctgtgactgtgtccccttactgagcgcaagccacagcctgtcttgtcaggtggaccctgtaaatacatcctttttctgctaacccttcaaccccctcgcctcctactctgagacaaaagaaaaaatattaaaaaaatgcataggcttaactcgctgatgagttaattgttttatttttaaactctttttgggtccagttgattgtacgtagccacaggagccctgctatgaaaggaataaaacctacacacaaggttggagctttgcaattctttttggaaaagagctgggatcccacagccctagtatgaaagctgggggtggggaggggcctttgctgcccttggtttctgggggctggttggcatttgctggcctggcagggggtgaaggcaggagttgggggcaggtcaggaccaggacccagggagaggctgtgtccctgctggggtctcaggtccagctttactgtggctgtctggatccttcccaaggtacagctgtatataaacgtgtcccgagcttagattctgtatgcggtgacggcggggtgtggtggcctgtgaggggcccctggcccaggaggaggattgtgctgatgtagtgaccaagtgcaatatgggcgggcagtcgctgcagggagcaccacggccagaagtaacttattttgtactagtgtccgcataagaaaaagaatcggcagtattttctgtttttatgttttatttggcttgttttattttggattagtgaactaagttattgttaattatgtacaacatttatatattgtctgtaaaaaatgtatgctatcctcttattcctttaaagtgagtactgttaagaataataaaatactttttgtgaatgcccgccaaaaaaaaaaaaaaaagcggcgcccaatttcgacgcggcgcgaatcctgcagccggggtcactagtctaancggcgcaccgcgtggagcccagctttgttccctagtgaggttcgctngcg

SEQ ID NO: 63191 - DNA, 2366 bp, Homo sapiens
  misc_feature (2316)..(2316): n is a, c, g, or t
  misc_feature (2363)..(2363): n is a, c, g, or t
ctctagaggatcggctgctgctccctcttcaccctaagcagcttcagcaaggctcgttcctgttcctgttcagaaggccgggagtgtgtcaactgtggggccacagccacccctctctggcggcgggacggcaccggccactacctgtgcaatgcctgtggcctctaccacaagatgaatgggcagaaccgaccactcatcaagcccaagcgaagactgtcggccgccagaagagccggcacctgttgtgcaaattgtcagacgacaaccaccaccttatggcgccgaaacgccaacggggaccctgtctgcaacgcctgtggcctctactacaagctgcacaatgttaacaggccactgaccatgaagaaggaagggatccagactcggaaccggaagatgtccaacaagtccaagaagagcaagaaaggggcggagtgcttcgaggagctgtcaaagtgcatgcaggagaagtcatcccccttcagtgcagctgccctggctggacacatggcacctgtgggccacctcccgcccttcagccactccggacacatcctgcccactccgacgcccatccacccctcctccagcctctccttcggccacccccacccgtccagcatggtgaccgccatgggctagggaacagatggacgtcgaggaccgggcactcccgggatgggtggaccaaacccttagcagcccagcatttcccgaaggccgacaccactcctgccagcccggctcggcccagcaccccctctcctggagggcgcccagcagcctgccagcagttactgtgaatgttccccaccgctgagaggctgcctccgcacctgaccgctgcccaggtggggtttcctgcatggacagttgtttggagaacaacaaggacaactttatgtagagaaaaggaggggacgggacagacgaaggcaaccatttttagaaggaaaaaggattaggcaaaaataatttattttgctcttgtttctaacaaggacttggagacttggtggtctgagctgtcccaagtcctccggttcttcctcgggattggcgggtccacttgccagggctctgggggcagatttgtggggacctcagcctgcaccctcttctcctctggcttccctctctgaaatagccgaactccaggctgggctgagccaaagccagagtggccacggcccagggagggtgagctggtgcctgctttgacgggccaggccctggagggcagagacaatcacgggcggtcctgcacagattcccaggccagggctgggtcacaggaaggaaacaacattttcttgaaaggggaaacgtctcccagatcgctcccttggctttgaggccgaagctgctgtgactgtgtccccttactgagcgcaagccacagcctgtcttgtcaggtggaccctgtaaatacatcctttttctgctaacccttcaaccccctcgcctcctactctgagacaaaagaaaaaatattaaaaaaatgcataggcttaactcgctgatgagttaattgttttatttttaaactctttttgggtccagttgattgtacgtagccacaggagccctgctatgaaaggaataaaacctacacacaaggttggagctttgcaattctttttggaaaagagctgggatcccacagccctagtatgaaagctgggggtggggaggggcctttgctgcccttggtttctgggggctggttggcatttgctggcctggcagggggtgaaggcaggagttgggggcaggtcaggaccaggacccagggagaggctgtgtccctgctggggtctcaggtccagctttactgtggctgtctggatccttcccaaggtacagctgtatataaacgtgtcccgagcttagattctgtatgcggtgacggcggggtgtggtggcctgtgaggggcccctggcccaggaggaggattgtgctgatgtagtgaccaagtgcaatatgggcgggcagtcgctgcagggagcaccacggccagaagtaacttattttgtactagtgtccgcataagaaaaagaatcggcagtattttctgtttttatgttttatttggcttgttttattttggattagtgaactaagttattgttaattatgtacaacatttatatattgtctgtaaaaaatgtatgctatcctcttattcctttaaagtgagtactgttaagaataataaaatactttttgtgaatgcccgccaaaaaaaaaaaaaaaagcggcgcccaatttcgacgcggcgcgaatcctgcagccggggtcactagtctaancggcgcaccgcgtggagcccagctttgttccctagtgaggttcgctngcg

SEQ ID NO: 63192 - DNA, 818 bp, Homo sapiens
  misc_feature (768)..(768): n is a, c, g, or t
  misc_feature (815)..(815): n is a, c, g, or t
cccacgcgtccgcggacgcgtggggtacgtagccacaggagccctgctatgaaaggaataaaacctacacacaaggttggagctttgcaattctttttggaaaagagctgggatcccacagccctagtatgaaagctgggggtggggaggggcctttgctgcccttggtttctgggggctggttggcatttgctggcctggcagggggtgaaggcaggagttgggggcaggtcaggaccaggacccagggagaggctgtgtccctgctggggtctcaggtccagctttactgtggctgtctggatccttcccaaggtacagctgtatataaacgtgtcccgagcttagattctgtatgcggtgacggcggggtgtggtggcctgtgaggggcccctggcccaggaggaggattgtgctgatgtagtgaccaagtgcaatatgggcgggcagtcgctgcagggagcaccacggccagaagtaacttattttgtactagtgtccgcataagaaaaagaatcggcagtattttctgtttttatgttttatttggcttgttttattttggattagtgaactaagttattgttaattatgtacaacatttatatattgtctgtaaaaaatgtatgctatcctcttattcctttaaagtgagtactgttaagaataataaaatactttttgtgaatgcccgccaaaaaaaaaaaaaaaagcggcgcccaatttcgacgcggcgcgaatcctgcagccggggtcactagtctaancggcgcaccgcgtggagcccagctttgttccctagtgaggttcgctngcg

SEQ ID NO: 63193 - DNA, 722 bp, Homo sapiens
  misc_feature (672)..(672): n is a, c, g, or t
  misc_feature (719)..(719): n is a, c, g, or t
atcaggcgaatgatgtggcatggagtgatgcctagcagatctgtgagcagcttcacggggtggctttccccgcgtacctccctctcatgggagctctggttaccccactccactatcaggcgaagactgtggatcaggcgaagactgtggggggagaggctgtgtccctgctggggtctcaggtccagctttactgtggctgtctggatccttcccaaggtacagctgtatataaacgtgtcccgagcttagattctgtatgcggtgacggcggggtgtggtggcctgtgaggggcccctggcccaggaggaggattgtgctgatgtagtgaccaagtgcaatatgggcgggcagtcgctgcagggagcaccacggccagaagtaacttattttgtactagtgtccgcataagaaaaagaatcggcagtattttctgtttttatgttttatttggcttgttttattttggattagtgaactaagttattgttaattatgtacaacatttatatattgtctgtaaaaaatgtatgctatcctcttattcctttaaagtgagtactgttaagaataataaaatactttttgtgaatgcccgccaaaaaaaaaaaaaaaagcggcgcccaatttcgacgcggcgcgaatcctgcagccggggtcactagtctaancggcgcaccgcgtggagcccagctttgttccctagtgaggttcgctngcg

SEQ ID NO: 63194 - DNA, 881 bp, Homo sapiens
tgtcgagcgcgggtccctctttattggccagctgggcgccctgctacttggcgtcgcatttctctctcccaggcgggttcgtttccgccagagaatgcagcagtcccgcatcctacgcaggacctgcaaccgaggtggaggcttcggtcaagccggctcctgcctgcgttgtcgaggaaggcaaccccaaggcctgaaaggacctggcagaactcctgtttcctttttttcctctacaccggattgcgggcaaggaggctggttcgggtctcccgaggcccctgctcaagcactccttaaccgtcctgctaagcccctctgtgcggcgattttctgagctgccgagcgggggccgttgccgtctgcacccagaccctgagccgccgccgccggccatggaggtggcgccggagcagccgcgctggatggcgcacccggccgtgctgaatgcgcagcaccccgactcacaccacccgggcctggcgcacaactacatggaacccgcgcagctgctgcctccagacgaggtggacgtcttcttcaatcacctcgactcgcagggcaacccctactatgccaaccccgctcacgcgcgggcgcgcgtctcctacagccccgcgcacgcccgcctgaccggaggccagatgtgccgcccacacttgttgcacagcccgggtttgccctggctggacgggggcaaagcagccctctgcgtggggccacacaaaacctggacggagccttttcagaagcatggaccctaggtgtgaggctggagccctcttgtgtccggtggggggcgcgggggcgcgggaccaggccacaaaaggattgggcacaggggcccaaccacaaggtgggcaacagggggccgcacgggg

SEQ ID NO: 63195 - DNA, 3833 bp, Homo sapiens
  misc_feature (3783)..(3783): n is a, c, g, or t
  misc_feature (3830)..(3830): n is a, c, g, or t
gcgtgtgctcacagctcctgagggtccccggggagagtctcagtaaagacgtgtcccaagctttctgagcaagcatccctgaggtcaggggcgcgcgtgtgcgctccggagagggtgggagcggcctggagtgtggatgcacagggtgtgcgcgccctgagtgcctagcggcccttggccggccaggcggctggacctggtaggccgggtgcagagccccgggtaccctcctgccccctgcggcgctcccgcccccgtcgccaccccctgcccccccgcaaagtgatgtcgaaataaaaagccgcgttgcggccggtgggggagagagaggcagcgtgagcgccaggaaggtagcgaggccagcgtcgccccgggactcgctgctcaagtctgtctattgcctgccgccacatccatcctagcagggccccgtcgcccaccaggcggacaaaagcggtccgctgaacaccatgcggccgctcggcgtgccgcccaggctctgctggtgagcgccgccaccccgcgcccaggtcccgcgagcccgcctgccgcgcacctcgccctgctcccagctctactccaggccccgtccgcccgggggcgccgcccaccgcgcctcgctcgggccgttgccgtctgcacccagaccctgagccgccgccgccggccatggaggtggcgccggagcagccgcgctggatggcgcacccggccgtgctgaatgcgcagcaccccgactcacaccacccgggcctggcgcacaactacatggaacccgcgcagctgctgcctccagacgaggtggacgtcttcttcaatcacctcgactcgcagggcaacccctactatgccaaccccgctcacgcgcgggcgcgcgtctcctacagccccgcgcacgcccgcctgaccggaggccagatgtgccgcccacacttgttgcacagcccgggtttgccctggctggacgggggcaaagcagccctctctgccgctgcggcccaccaccacaacccctggaccgtgagccccttctccaagacgccactgcacccctcagctgctggaggccctggaggcccactctctgtgtacccaggggctgggggtgggagcgggggaggcagcgggagctcagtggcctccctcacccctacagcagcccactctggctcccaccttttcggcttcccacccacgccacccaaagaagtgtctcctgaccctagcaccacgggggctgcgtctccagcctcatcttccgcggggggtagtgcagcccgaggagaggacaaggacggcgtcaagtaccaggtgtcactgacggagagcatgaagatggaaagtggcagtcccctgcgcccaggcctagctactatgggcacccagcctgctacacaccaccccatccccacctacccctcctatgtgccggcggctgcccacgactacagcagcggactcttccaccccggaggcttcctggggggaccggcctccagcttcacccctaagcagcgcagcaaggctcgttcctgttcagaaggccgggagtgtgtcaactgtggggccacagccacccctctctggcggcgggacggcaccggccactacctgtgcaatgcctgtggcctctaccacaagatgaatgggcagaaccgaccactcatcaagcccaagcgaagactgtcggccgccagaagagccggcacctgttgtgcaaattgtcagacgacaaccaccaccttatggcgccgaaacgccaacggggaccctgtctgcaacgcctgtggcctctactacaagctgcacaatgttaacaggccactgaccatgaagaaggaagggatccagactcggaaccggaagatgtccaacaagtccaagaagagcaagaaaggggcggagtgcttcgaggagctgtcaaagtgcatgcaggagaagtcatcccccttcagtgcagctgccctggctggacacatggcacctgtgggccacctcccgcccttcagccactccggacacatcctgcccactccgacgcccatccacccctcctccagcctctccttcggccacccccacccgtccagcatggtgaccgccatgggctagggaacagatggacgtcgaggaccgggcactcccgggatgggtggaccaaacccttagcagcccagcatttcccgaaggccgacaccactcctgccagcccggctcggcccagcaccccctctcctggagggcgcccagcagcctgccagcagttactgtgaatgttccccaccgctgagaggctgcctccgcacctgaccgctgcccaggtggggtttcctgcatggacagttgtttggagaacaacaaggacaactttatgtagagaaaaggaggggacgggacagacgaaggcaaccatttttagaaggaaaaaggattaggcaaaaataatttattttgctcttgtttctaacaaggacttggagacttggtggtctgagctgtcccaagtcctccggttcttcctcgggattggcgggtccacttgccagggctctgggggcagatttgtggggacctcagcctgcaccctcttctcctctggcttccctctctgaaatagccgaactccaggctgggctgagccaaagccagagtggccacggcccagggagggtgagctggtgcctgctttgacgggccaggccctggagggcagagacaatcacgggcggtcctgcacagattcccaggccagggctgggtcacaggaaggaaacaacattttcttgaaaggggaaacgtctcccagatcgctcccttggctttgaggccgaagctgctgtgactgtgtccccttactgagcgcaagccacagcctgtcttgtcaggtggaccctgtaaatacatcctttttctgctaacccttcaaccccctcgcctcctactctgagacaaaagaaaaaatattaaaaaaatgcataggcttaactcgctgatgagttaattgttttatttttaaactctttttgggtccagttgattgtacgtagccacaggagccctgctatgaaaggaataaaacctacacacaaggttggagctttgcaattctttttggaaaagagctgggatcccacagccctagtatgaaagctgggggtggggaggggcctttgctgcccttggtttctgggggctggttggcatttgctggcctggcagggggtgaaggcaggagttgggggcaggtcaggaccaggacccagggagaggctgtgtccctgctggggtctcaggtccagctttactgtggctgtctggatccttcccaaggtacagctgtatataaacgtgtcccgagcttagattctgtatgcggtgacggcggggtgtggtggcctgtgaggggcccctggcccaggaggaggattgtgctgatgtagtgaccaagtgcaatatgggcgggcagtcgctgcagggagcaccacggccagaagtaacttattttgtactagtgtccgcataagaaaaagaatcggcagtattttctgtttttatgttttatttggcttgttttattttggattagtgaactaagttattgttaattatgtacaacatttatatattgtctgtaaaaaatgtatgctatcctcttattcctttaaagtgagtactgttaagaataataaaatactttttgtgaatgcccgccaaaaaaaaaaaaaaaagcggcgcccaatttcgacgcggcgcgaatcctgcagccggggtcactagtctaancggcgcaccgcgtggagcccagctttgttccctagtgaggttcgctngcg

SEQ ID NO: 63196 - DNA, 2983 bp, Homo sapiens
gcgtgtgctcacagctcctgagggtccccggggagagtctcagtaaagacgtgtcccaagctttctgagcaagcatccctgaggtcaggggcgcgcgtgtgcgctccggagagggtgggagcggcctggagtgtggatgcacagggtgtgcgcgccctgagtgcctagcggcccttggccggccaggcggctggacctggtaggccgggtgcagagccccgggtaccctcctgccccctgcggcgctcccgcccccgtcgccaccccctgcccccccgcaaagtgatgtcgaaataaaaagccgcgttgcggccggtgggggagagagaggcagcgtgagcgccaggaaggtagcgaggccagcgtcgccccgggactcgctgctcaagtctgtctattgcctgccgccacatccatcctagcagggccccgtcgcccaccaggcggacaaaagcggtccgctgaacaccatgcggccgctcggcgtgccgcccaggctctgctggtgagcgccgccaccccgcgcccaggtcccgcgagcccgcctgccgcgcacctcgccctgctcccagctctactccaggccccgtccgcccgggggcgccgcccaccgcgcctcgctcgggccgttgccgtctgcacccagaccctgagccgccgccgccggccatggaggtggcgccggagcagccgcgctggatggcgcacccggccgtgctgaatgcgcagcaccccgactcacaccacccgggcctggcgcacaactacatggaacccgcgcagctgctgcctccagacgaggtggacgtcttcttcaatcacctcgactcgcagggcaacccctactatgccaaccccgctcacgcgcgggcgcgcgtctcctacagccccgcgcacgcccgcctgaccggaggccagatgtgccgcccacacttgttgcacagcccgggtttgccctggctggacgggggcaaagcagccctctctgccgctgcggcccaccaccacaacccctggaccgtgagccccttctccaagacgccactgcacccctcagctgctggaggccctggaggcccactctctgtgtacccaggggctgggggtgggagcgggggaggcagcgggagctcagtggcctccctcacccctacagcagcccactctggctcccaccttttcggcttcccacccacgccacccaaagaagtgtctcctgaccctagcaccacgggggctgcgtctccagcctcatcttccgcggggggtagtgcagcccgaggagaggacaaggacggcgtcaagtaccaggtgtcactgacggagagcatgaagatggaaagtggcagtcccctgcgcccaggcctagctactatgggcacccagcctgctacacaccaccccatccccacctacccctcctatgtgccggcggctgcccacgactacagcagcggactcttccaccccggaggcttcctggggggaccggcctccagcttcacccctaagcagcgcagcaaggctcgttcctgttcagaaggccgggagtgtgtcaactgtggggccacagccacccctctctggcggcgggacggcaccggccactacctgtgcaatgcctgtggcctctaccacaagatgaatgggcagaaccgaccactcatcaagcccaagcgaagactgtcggccgccagaagagccggcacctgttgtgcaaattgtcagacgacaaccaccaccttatggcgccgaaacgccaacggggaccctgtctgcaacgcctgtggcctctactacaagctgcacaatgttaacaggccactgaccatgaagaaggaagggatccagactcggaaccggaagatgtccaacaagtccaagaagagcaagaaaggggcggagtgcttcgaggagctgtcaaagtgcatgcaggagaagtcatcccccttcagtgcagctgccctggctggacacatggcacctgtgggccacctcccgcccttcagccactccggacacatcctgcccactccgacgcccatccacccctcctccagcctctccttcggccacccccacccgtccagcatggtgaccgccatgggctagggaacagatggacgtcgaggaccgggcactcccgggatgggtggaccaaacccttagcagcccagcatttcccgaaggccgacaccactcctgccagcccggctcggcccagcaccccctctcctggagggcgcccagcagcctgccagcagttactgtgaatgttccccaccgctgagaggctgcctccgcacctgaccgctgcccaggtggggtttcctgcatggacagttgtttggagaacaacaaggacaactttatgtagagaaaaggaggggacgggacagacgaaggcaaccatttttagaaggaaaaaggattaggcaaaaataatttattttgctcttgtttctaacaaggacttggagacttggtggtctgagctgtcccaagtcctccggttcttcctcgggattggcgggtccacttgccagggctctgggggcagatttgtggggacctcagcctgcaccctcttctcctctggcttccctctctgaaatagccgaactccaggctgggctgagccaaagccagagtggccacggcccagggagggtgagctggtgcctgctttgacgggccaggccctggagggcagagacaatcacgggcggtcctgcacagattcccaggccagggctgggtcacaggaaggaaacaacattttcttgaaaggggaaacgtctcccagatcgctcccttggctttgaggccgaagctgctgtgactgtgtccccttactgagcgcaagccacagcctgtcttgtcaggtggaccctgtaaatacatcctttttctgctaacccttcaaccccctcgcctcctactctgagacaaaagaaaaaatattaaaaaaatgcataggctt

SEQ ID NO: 63197 - DNA, 2743 bp, Homo sapiens
  misc_feature (2693)..(2693): n is a, c, g, or t
  misc_feature (2740)..(2740): n is a, c, g, or t
ttaggctaggtacgaggcctggttgaaattcggccgagggctcagtggcctccctcacccctacagcagcccactctggctcccaccttttcggcttcccacccacgccacccaaagaagtgtctcctgaccctagcaccacgggggctgcgtctccagcctcatcttccgcggggggtagtgcagcccgaggagaggacaaggacggcgtcaagtaccaggtgtcactgacggagagcatgaagatggaaagtggcagtcccctgcgcccaggcctagctactatgggcacccagcctgctacacaccaccccatccccacctacccctcctatgtgccggcggctgcccacgactacagcagcggactcttccaccccggaggcttcctggggggaccggcctccagcttcacccctaagcagcgcagcaaggctcgttcctgttcagaaggccgggagtgtgtcaactgtggggccacagccacccctctctggcggcgggacggcaccggccactacctgtgcaatgcctgtggcctctaccacaagatgaatgggcagaaccgaccactcatcaagcccaagcgaagactgtcggccgccagaagagccggcacctgttgtgcaaattgtcagacgacaaccaccaccttatggcgccgaaacgccaacggggaccctgtctgcaacgcctgtggcctctactacaagctgcacaatgttaacaggccactgaccatgaagaaggaagggatccagactcggaaccggaagatgtccaacaagtccaagaagagcaagaaaggggcggagtgcttcgaggagctgtcaaagtgcatgcaggagaagtcatcccccttcagtgcagctgccctggctggacacatggcacctgtgggccacctcccgcccttcagccactccggacacatcctgcccactccgacgcccatccacccctcctccagcctctccttcggccacccccacccgtccagcatggtgaccgccatgggctagggaacagatggacgtcgaggaccgggcactcccgggatgggtggaccaaacccttagcagcccagcatttcccgaaggccgacaccactcctgccagcccggctcggcccagcaccccctctcctggagggcgcccagcagcctgccagcagttactgtgaatgttccccaccgctgagaggctgcctccgcacctgaccgctgcccaggtggggtttcctgcatggacagttgtttggagaacaacaaggacaactttatgtagagaaaaggaggggacgggacagacgaaggcaaccatttttagaaggaaaaaggattaggcaaaaataatttattttgctcttgtttctaacaaggacttggagacttggtggtctgagctgtcccaagtcctccggttcttcctcgggattggcgggtccacttgccagggctctgggggcagatttgtggggacctcagcctgcaccctcttctcctctggcttccctctctgaaatagccgaactccaggctgggctgagccaaagccagagtggccacggcccagggagggtgagctggtgcctgctttgacgggccaggccctggagggcagagacaatcacgggcggtcctgcacagattcccaggccagggctgggtcacaggaaggaaacaacattttcttgaaaggggaaacgtctcccagatcgctcccttggctttgaggccgaagctgctgtgactgtgtccccttactgagcgcaagccacagcctgtcttgtcaggtggaccctgtaaatacatcctttttctgctaacccttcaaccccctcgcctcctactctgagacaaaagaaaaaatattaaaaaaatgcataggcttaactcgctgatgagttaattgttttatttttaaactctttttgggtccagttgattgtacgtagccacaggagccctgctatgaaaggaataaaacctacacacaaggttggagctttgcaattctttttggaaaagagctgggatcccacagccctagtatgaaagctgggggtggggaggggcctttgctgcccttggtttctgggggctggttggcatttgctggcctggcagggggtgaaggcaggagttgggggcaggtcaggaccaggacccagggagaggctgtgtccctgctggggtctcaggtccagctttactgtggctgtctggatccttcccaaggtacagctgtatataaacgtgtcccgagcttagattctgtatgcggtgacggcggggtgtggtggcctgtgaggggcccctggcccaggaggaggattgtgctgatgtagtgaccaagtgcaatatgggcgggcagtcgctgcagggagcaccacggccagaagtaacttattttgtactagtgtccgcataagaaaaagaatcggcagtattttctgtttttatgttttatttggcttgttttattttggattagtgaactaagttattgttaattatgtacaacatttatatattgtctgtaaaaaatgtatgctatcctcttattcctttaaagtgagtactgttaagaataataaaatactttttgtgaatgcccgccaaaaaaaaaaaaaaaagcggcgcccaatttcgacgcggcgcgaatcctgcagccggggtcactagtctaancggcgcaccgcgtggagcccagctttgttccctagtgaggttcgctngcg

SEQ ID NO: 63198 - DNA, 2400 bp, Homo sapiens
  misc_feature (1)..(1): n is a, c, g, or t
  misc_feature (3)..(4): n is a, c, g, or t
  misc_feature (7)..(7): n is a, c, g, or t
  misc_feature (9)..(10): n is a, c, g, or t
  misc_feature (2350)..(2350): n is a, c, g, or t
  misc_feature (2397)..(2397): n is a, c, g, or t
ncnngcntnntgctgtgcaggagtcggcagctggcgccagggcggccggaggatgccgaggggccggagccgggcgggcccgaggccgaggcgcactctacccccagctcctaccctgtaagccccgccagcctccggacgtgctgtccctgggcccgtcgccctctgggctcccgccggaactccttcactctcagaggccgagtccctcccctccccacggctgcgtgtggccgttgccgtctgcacccagaccctgagccgccgccgccggccatggaggtggcgccggagcagccgcgctggatggcgcacccggccgtgctgaatgcgcagcaccccgactcacaccacccgggcctggcgcacaactacatggaacccgcgcagctgctgcctccagacgaggtggacgtcttcttcaatcacctcgactcgcagggcaacccctactatgccaaccccgctcacgcgcgggcgcgcgtctcctacagccccgcgcacgcccgcctgaccggaggccagatgtgccgcccacacttgttgcacagcccgggtttgccctggctggacgggggcaaagcagccctctctgccgctgcggcccaccaccacaacccctggaccgtgagccccttctccaagacgccactgcacccctcagctgctggaggccctggaggcccactctctgtgtacccaggggctgggggtgggagcgggggaggcagcgggagctcagtggcctccctcacccctacagcagcccactctggctcccaccttttcggcttcccacccacgccacccaaagaagtgtctcctgaccctagcaccacgggggctgcgtctccagcctcatcttccgcggggggtagtgcagcccgaggagaggacaaggacggcgtcaagtaccaggtgtcactgacggagagcatgaagatggaaagtggcagtcccctgcgcccaggcctagctactatgggcacccagcctgctacacaccaccccatccccacctacccctcctatgtgccggcggctgcccacgactacagcagcggactcttccaccccggaggcttcctggggggaccggcctccagcttcacccctaagcagcgcagcaaggctcgttcctgttcagaaggccgggagtgtgtcaactgtggggccacagccacccctctctggcggcgggacggcaccggccactacctgtgcaatgcctgtggcctctaccacaagatgaatgggcagaaccgaccactcatcaagcccaagcgaagactgtcggccgccagaagagccggcacctgttgtgcaaattgtcagacgacaaccaccaccttatggcgccgaaacgccaacggggaccctgtctgcaacgcctgtggcctctactacaagctgcacaatgttaacaggccactgaccatgaagaaggaagggatccagactcggaaccggaagatgtccaacaagtccaagaagagcaagaaaggggcggagtgcttcgaggagctgtcaaagtgcatgcaggagaagtcatcccccttcagtgcagctgccctggctggacacatggcacctgtgggccacctcccgcccttcagccactccggacacatcctgcccactccgacgcccatccacccctcctccagcctctccttcggccacccccacccgtccagcatggtgaccgccatgggctagggaacagatggacgtcgaggaccgggcactcccgggatgggtggaccaaacccttagcagcccagcatttcccgaaggccgacaccactcctgccagcccggctcggcccgggagaggctgtgtccctgctggggtctcaggtccagctttactgtggctgtctggatccttcccaaggtacagctgtatataaacgtgtcccgagcttagattctgtatgcggtgacggcggggtgtggtggcctgtgaggggcccctggcccaggaggaggattgtgctgatgtagtgaccaagtgcaatatgggcgggcagtcgctgcagggagcaccacggccagaagtaacttattttgtactagtgtccgcataagaaaaagaatcggcagtattttctgtttttatgttttatttggcttgttttattttggattagtgaactaagttattgttaattatgtacaacatttatatattgtctgtaaaaaatgtatgctatcctcttattcctttaaagtgagtactgttaagaataataaaatactttttgtgaatgcccgccaaaaaaaaaaaaaaaagcggcgcccaatttcgacgcggcgcgaatcctgcagccggggtcactagtctaancggcgcaccgcgtggagcccagctttgttccctagtgaggttcgctngcg

SEQ ID NO: 63199 - DNA, 259 bp, Homo sapiens
cctcgcccggccttggagaggcccggtgaggggctgatggctagtgagggcttgatggctagtgaggactttgtctcagggcgcacatatttcccccactatgctgttggcctggtttctccttacaggagaagtttcagagtaatttaatatttggtggttttactaccaacttatgtttctatagtttacaaatagtgtcttttgaccctaataagctattttactttaataaaaatatattctgttctgtttgcat

SEQ ID NO: 63200 - DNA, 481 bp, Homo sapiens
  misc_feature (77)..(77): n is a, c, g, or t
acaccttgggatataggtcagaaaactgggggtgtagccctggccttgccctcttaactgctgcatgacccttgggncaagtccactttcaaacttgcgatctcatctctaaacaggatataactcactgacttggagtgaagataaaatgaaagtaataggtgtgaatataccagggaaaactataaagtattaaatgaaatcagtaaaaagtatttttcacaaccccaggtttgtctctagacccaggggttggcaaactttttctgtaaagcactagctagtaaatatttttggcttgttagatgatactatccctttagtacctattcaactctgcaagagcagccatagacaatatgtaaatggatgagcatggctgtgttccaataaaactttatttatggacactgagatttgaattttgtataattttcacatgtcatggaatattctttttattttttttccaaccatttaa

SEQ ID NO: 63201 - DNA, 483 bp, Homo sapiens
ctgcctcctcaggatccagaaggcattgagaaaccatctcatagcagcctcctaggggacatagccaggggagggggcaagggtcttatagcaactccttacaagcttccaacccaggagtatccaggtgttctaccaagacgtagattcagtagtggttccagttttgctttgtggcctatgtggatatgtgcagggtcaccaaggtgccatggcagagccatcccccttcatctctattctgtttcattgctctatttgcctgttttaacaccaataccatactgtcttgaatattgtaactttataataaattttgaagtcaggtagtataagttttcaagcatagttcttccttcttgaagttgttttggctattctagctcctttgcatttccagatgaattttagattcagttcatccatttctacaacatagcttcctgggttatgttgtccaaatctataaatcaatttggagaa

SEQ ID NO: 63202 - DNA, 111 bp, Homo sapiens
gtacgttcgttaatttagtattctggttagctaaaattgtgtgagaaggctgataaacgtctgtggtttctccctgtgctattaaaaaaaaaaataaaagaatgttaaagt

SEQ ID NO: 63203 - DNA, 1783 bp, Homo sapiens
cacatataataatagcaactcctggtcgactgattgaccacttgaaacctttcgtattttccggggctggcaagcgcttcctgcgcagcgcctaggcgacctggagtttgtgacgctgtgatggtctagaggctggagattcaagatctgggtgccatcattttctggttctgttgatgaccctcttccaggttacatacagcttacatcttgcatcctcaagcgtttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaacaattcccttgactgaagacgttctcataacattaggaaaagaagagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcataggccatcttacttttattgcaaaatggcatgtgctgccatctattattcatttttaaatggtcatttcttattcagtgagtgctttagtgttttaaactatatggataagaatgcaggtagataatattctaggcataaaacatttaatgtaccttacctcatgcaatattctttggattctttgttgatttatgatattgctaatataatattttcttaaaatatataacaatatcttttatgcattttgagttccagctggtgcttctttatatttagaaattataatgggaaggtcatttaatttacagatggttttaaaattgaggtaatatctgaggtggcataatttaaaaatatttagcaaatttgtttcatatatactgtcttatttctagatttgtttaaaattggaatatgaaaaactaatggataaagctagcataaaattgatattttagtttgtattattaatatatcatgttaccttatatattaatctactcttgattctgctaattattaccaacaaaattgtattcatgacattttattaatcctctgtgaattttctgtaaataaaattatttctgaaaatctcta

SEQ ID NO: 63204 - DNA, 745 bp, Homo sapiens
ttcatgtcttcttactcagttgtcaatttctcagtaaccttatatgaccaccttatttaaaattatattgtccttgccctagcatttcctatgtttcttccttgtcttttctccatggcacttataaatcatttgatatactaagtatatatatgttttattttttattttattgtctgttttccttacttagaataaggttcacggtaggagggatttttgtctattttgttcattgctatattcttaccccctagatgagtatctggcaggtaataagtgttcaaccaatactgctgaatgaataaatattttttgctttagtttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaaggcctaatcgtgttggcccagtctggaagtccaatggcacaaacatgggttaatagggggcccccaatctcccggggtcaaggaatccctcctaactctaaccctcctgtagatgcttgggacctccaagggtgtgccacc

SEQ ID NO: 63205 - DNA, 1997 bp, Homo sapiens
aggatcccccatctggaggtcgctccggggctggcaagcgcttcctgcgcagcgcctaggcgacctggagtttgtgacgctgtgatggtctagaggctggagattcaagatctgggtgccatcattttctggttctgttgatgaccctcttccaggttacatacagcttacatcttgcatcctcaagcgtttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaacaattcccttgactgaagacgttctcataacattaggaaaagaagagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcataggccatcttacttttattgcaaaatggcatgtgctgccatctattattcatttttaaatggtcatttcttattcagtgagtgctttagtgttttaaactatatggataagaatgcaggtagataatattctaggcataaaacatttaatgtaccttacctcatgcaatattctttggattctttgttgatttatgatattgctaatataatattttcttaaaatatataacaatatcttttatgcattttgagttccagctggtgcttctttatatttagaaattataatgggaaggtcatttaatttacagatggttttaaaattgaggtaatatctgaggtggcataatttaaaaatatttagcaaatttgtttcatatatactgtcttatttctagatttgtttaaaattggaatatgaaaaactaatggataaagctagcataaaattgatattttagtttgtattattaatatatcatgttaccttatatattaatctactcttgattctgctaattattaccaacaaaattgtattcatgacattttattaatcctctgtgaattttctgtaaataaaattatttctgaaaatctctaaaagaacaccccgggcgcacacccgcacacacactgtttggcgcgcgctcacgacccctggaaagacgtttcgaggacccactgtttgggacgccccgcggccccacaggaaatgatgaacacagggtccacaggagtgttcccaagagaaaatccgggtgcaagaaaaacggagcgtgtacgtcttctccacccagtaaagaaatgccgtcgcgggtcaaccacaccagcggtgtggacatcaaaccgg

SEQ ID NO: 63206 - DNA, 1749 bp, Homo sapiens
cacatataataatagcaactcctggtcgactgattgaccacttgaaacctttcgtattttccggggctggcaagcgcttcctgcgcagcgcctaggcgacctggagtttgtgacgctgtgatggtctagaggctggagattcaagatctgggtgccatcattttctggttctgttgatgaccctcttccagtttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaacaattcccttgactgaagacgttctcataacattaggaaaagaagagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcataggccatcttacttttattgcaaaatggcatgtgctgccatctattattcatttttaaatggtcatttcttattcagtgagtgctttagtgttttaaactatatggataagaatgcaggtagataatattctaggcataaaacatttaatgtaccttacctcatgcaatattctttggattctttgttgatttatgatattgctaatataatattttcttaaaatatataacaatatcttttatgcattttgagttccagctggtgcttctttatatttagaaattataatgggaaggtcatttaatttacagatggttttaaaattgaggtaatatctgaggtggcataatttaaaaatatttagcaaatttgtttcatatatactgtcttatttctagatttgtttaaaattggaatatgaaaaactaatggataaagctagcataaaattgatattttagtttgtattattaatatatcatgttaccttatatattaatctactcttgattctgctaattattaccaacaaaattgtattcatgacattttattaatcctctgtgaattttctgtaaataaaattatttctgaaaatctcta

SEQ ID NO: 63207 - DNA, 1397 bp, Homo sapiens
  misc_feature (1218)..(1218): n is a, c, g, or t
  misc_feature (1221)..(1221): n is a, c, g, or t
  misc_feature (1225)..(1225): n is a, c, g, or t
  misc_feature (1229)..(1229): n is a, c, g, or t
  misc_feature (1233)..(1233): n is a, c, g, or t
  misc_feature (1242)..(1242): n is a, c, g, or t
  misc_feature (1244)..(1245): n is a, c, g, or t
  misc_feature (1249)..(1249): n is a, c, g, or t
  misc_feature (1252)..(1252): n is a, c, g, or t
  misc_feature (1258)..(1258): n is a, c, g, or t
  misc_feature (1380)..(1380): n is a, c, g, or t
aggatcccccatctggaggtcgctccggggctggcaagcgcttcctgcgcagcgcctaggcgacctggagtttgtgacgctgtgatggtctagaggctggagattcaagatctgggtgccatcattttctggttctgttgatgaccctcttccaggttacatacagcttacatcttgcatcctcaagcgtttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaacaattcccttgactgaagacgttctcataacattaggaaaagaagagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcataggccatcttacttttattgcaaaatggcatgtgctgccatctattattcatttttaaatggtcatttctctatanggngggntagngttnactattggnannatgnggngaaaanttcgggtaatatggtctacatgaaatctgcgctcgggatagatgggaaatttaaataaaaattagtagggcagggggggataaaaagagggaacaaaagagaggcggaaaatttttagtagngcaatatatagcattta

SEQ ID NO: 63208 - DNA, 1633 bp, Homo sapiens
cacatataataatagcaactcctggtcgactgattgaccacttgaaacctttcgtattttccggggctggcaagcgcttcctgcgcagcgcctaggcgacctggagtttgtgacgctgtgatggtctagaggctggagattcaagatctgggtgccatcattttctggttctgttgatgaccctcttccaggttacatacagcttacatcttgcatcctcaagcgtgtcagaataaattatcacttattggaactgaaacactcaccgattcaaatgctcagctatcattgttaattatgcaagtaaaatgtttaaccgctgaactcagtcaatggcagaaaaaaacacctgaaacaattcccttgactgaagacgttctcataacattaggaaaagaagagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcataggccatcttacttttattgcaaaatggcatgtgctgccatctattattcatttttaaatggtcatttcttattcagtgagtgctttagtgttttaaactatatggataagaatgcaggtagataatattctaggcataaaacatttaatgtaccttacctcatgcaatattctttggattctttgttgatttatgatattgctaatataatattttcttaaaatatataacaatatcttttatgcattttgagttccagctggtgcttctttatatttagaaattataatgggaaggtcatttaatttacagatggttttaaaattgaggtaatatctgaggtggcataatttaaaaatatttagcaaatttgtttcatatatactgtcttatttctagatttgtttaaaattggaatatgaaaaactaatggataaagctagcataaaattgatattttagtttgtattattaatatatcatgttaccttatatattaatctactcttgattctgctaattattaccaacaaaattgtattcatgacattttattaatcctctgtgaattttctgtaaataaaattatttctgaaaatctcta

SEQ ID NO: 63209 - DNA, 1826 bp, Homo sapiens
  misc_feature (136)..(136): n is a, c, g, or t
agcgcttcctgcgcagcgcctaggacagaaaccctgggacgcttttgtgacgctgggtttgacaatcatggactctctaagacagagccctctggccacgcactttcaacaagaaactctctgagcagattgcccnattccaatttttccctggtattctggtttgtggaagttggaaacgcccgtttctttttcccagagattataaacaagttaaccaaggggaccttttaaccaatacttttgcccaattccttcaaaggcggattttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaacaattcccttgactgaagacgttctcataacattaggaaaagaagagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcataggccatcttacttttattgcaaaatggcatgtgctgccatctattattcatttttaaatggtcatttcttattcagtgagtgctttagtgttttaaactatatggataagaatgcaggtagataatattctaggcataaaacatttaatgtaccttacctcatgcaatattctttggattctttgttgatttatgatattgctaatataatattttcttaaaatatataacaatatcttttatgcattttgagttccagctggtgcttctttatatttagaaattataatgggaaggtcatttaatttacagatggttttaaaattgaggtaatatctgaggtggcataatttaaaaatatttagcaaatttgtttcatatatactgtcttatttctagatttgtttaaaattggaatatgaaaaactaatggataaagctagcataaaattgatattttagtttgtattattaatatatcatgttaccttatatattaatctactcttgattctgctaattattaccaacaaaattgtattcatgacattttattaatcctctgtgaattttctgtaaataaaattatttctgaaaatctcta

SEQ ID NO: 63210 - DNA, 2019 bp, Homo sapiens
ttcatgtcttcttactcagttgtcaatttctcagtaaccttatatgaccaccttatttaaaattatattgtccttgccctagcatttcctatgtttcttccttgtcttttctccatggcacttataaatcatttgatatactaagtatatatatgttttattttttattttattgtctgttttccttacttagaataaggttcacggtaggagggatttttgtctattttgttcattgctatattcttaccccctagatgagtatctggcaggtaataagtgttcaaccaatactgctgaatgaataaatattttttgctttagtttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaaggtctcatcgtgttgtccaggctggagtacagtggcacaatcatggctcattgcagccccgatctcccgggttcaagtgatcctcctacctcagcctcctgagtagctaggactacaagtgtgtgccaccatgcttgcaattcccttgactgaagacgttctcataacattaggaaaagaagagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcataggccatcttacttttattgcaaaatggcatgtgctgccatctattattcatttttaaatggtcatttcttattcagtgagtgctttagtgttttaaactatatggataagaatgcaggtagataatattctaggcataaaacatttaatgtaccttacctcatgcaatattctttggattctttgttgatttatgatattgctaatataatattttcttaaaatatataacaatatcttttatgcattttgagttccagctggtgcttctttatatttagaaattataatgggaaggtcatttaatttacagatggttttaaaattgaggtaatatctgaggtggcataatttaaaaatatttagcaaatttgtttcatatatactgtcttatttctagatttgtttaaaattggaatatgaaaaactaatggataaagctagcataaaattgatattttagtttgtattattaatatatcatgttaccttatatattaatctactcttgattctgctaattattaccaacaaaattgtattcatgacattttattaatcctctgtgaattttctgtaaataaaattatttctgaaaatctcta

SEQ ID NO: 63211 - DNA, 1599 bp, Homo sapiens
cacatataataatagcaactcctggtcgactgattgaccacttgaaacctttcgtattttccggggctggcaagcgcttcctgcgcagcgcctaggcgacctggagtttgtgacgctgtgatggtctagaggctggagattcaagatctgggtgccatcattttctggttctgttgatgaccctcttccagtgtcagaataaattatcacttattggaactgaaacactcaccgattcaaatgctcagctatcattgttaattatgcaagtaaaatgtttaaccgctgaactcagtcaatggcagaaaaaaacacctgaaacaattcccttgactgaagacgttctcataacattaggaaaagaagagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcataggccatcttacttttattgcaaaatggcatgtgctgccatctattattcatttttaaatggtcatttcttattcagtgagtgctttagtgttttaaactatatggataagaatgcaggtagataatattctaggcataaaacatttaatgtaccttacctcatgcaatattctttggattctttgttgatttatgatattgctaatataatattttcttaaaatatataacaatatcttttatgcattttgagttccagctggtgcttctttatatttagaaattataatgggaaggtcatttaatttacagatggttttaaaattgaggtaatatctgaggtggcataatttaaaaatatttagcaaatttgtttcatatatactgtcttatttctagatttgtttaaaattggaatatgaaaaactaatggataaagctagcataaaattgatattttagtttgtattattaatatatcatgttaccttatatattaatctactcttgattctgctaattattaccaacaaaattgtattcatgacattttattaatcctctgtgaattttctgtaaataaaattatttctgaaaatctcta

SEQ ID NO: 63212 - DNA, 1542 bp, Homo sapiens
cacatataataatagcaactcctggtcgactgattgaccacttgaaacctttcgtattttccggggctggcaagcgcttcctgcgcagcgcctaggcgacctggagtttgtgacgctgtgatggtctagaggctggagattcaagatctgggtgccatcattttctggttctgttgatgaccctcttccagctatcattgttaattatgcaagtaaaatgtttaaccgctgaactcagtcaatggcagaaaaaaacacctgaaacaattcccttgactgaagacgttctcataacattaggaaaagaagagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcataggccatcttacttttattgcaaaatggcatgtgctgccatctattattcatttttaaatggtcatttcttattcagtgagtgctttagtgttttaaactatatggataagaatgcaggtagataatattctaggcataaaacatttaatgtaccttacctcatgcaatattctttggattctttgttgatttatgatattgctaatataatattttcttaaaatatataacaatatcttttatgcattttgagttccagctggtgcttctttatatttagaaattataatgggaaggtcatttaatttacagatggttttaaaattgaggtaatatctgaggtggcataatttaaaaatatttagcaaatttgtttcatatatactgtcttatttctagatttgtttaaaattggaatatgaaaaactaatggataaagctagcataaaattgatattttagtttgtattattaatatatcatgttaccttatatattaatctactcttgattctgctaattattaccaacaaaattgtattcatgacattttattaatcctctgtgaattttctgtaaataaaattatttctgaaaatctcta

SEQ ID NO: 63213 - DNA, 1831 bp, Homo sapiens
cacatataataatagcaactcctggtcgactgattgaccacttgaaacctttcgtattttccggggctggcaagcgcttcctgcgcagcgcctaggcgacctggagtttgtgacgctgtgatggtctagaggctggagattcaagatctgggtgccatcattttctggttctgttgatgaccctcttccagtttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaacaattcccttgactgaagacgttctcataacattaggaaaagaagagattctgcagatgatgattctctcctacaaaccagttgggtgtcctcttaattcacttcagttctgacataatctacttggagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcataggccatcttacttttattgcaaaatggcatgtgctgccatctattattcatttttaaatggtcatttcttattcagtgagtgctttagtgttttaaactatatggataagaatgcaggtagataatattctaggcataaaacatttaatgtaccttacctcatgcaatattctttggattctttgttgatttatgatattgctaatataatattttcttaaaatatataacaatatcttttatgcattttgagttccagctggtgcttctttatatttagaaattataatgggaaggtcatttaatttacagatggttttaaaattgaggtaatatctgaggtggcataatttaaaaatatttagcaaatttgtttcatatatactgtcttatttctagatttgtttaaaattggaatatgaaaaactaatggataaagctagcataaaattgatattttagtttgtattattaatatatcatgttaccttatatattaatctactcttgattctgctaattattaccaacaaaattgtattcatgacattttattaatcctctgtgaattttctgtaaataaaattatttctgaaaatctcta

SEQ ID NO: 63214 - DNA, 1818 bp, Homo sapiens
gggccgggcacggtggctcacgcctgtaatcccagcactttgggaggccgaggcgggtggatcacaaggtcaggacatcgagaccatcctggctaacatggtgaaaccctatctctactaaaaacacaaaaaattagcctggcatggtggcgggcacctgtagtcccagctactcaggggctggggcaggagaatggcgtgaacccgggaggcggagcttgcagtgagctgagatggcaccactgccctccagcctgggtgacagagtgagactgtctcaaaaaaaaaaaagaaagaaagaaaaggtacctactctcttattactgaaaacacaccattattttgcctttcaatatgatattaaaatttactgctcaaaacctcttgtattttttaatttaaccatagaatattaccacaaatttagcgcctactgtatatttaccttttcaaatgctttctgctaggctttttcactactgatgtctgaatggaagtatcctggaccactgtgtaaatttgactatcgttcagaaataaaactgggattaaagaccaagcaattaatttgaattattttattctagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcataggccatcttacttttattgcaaaatggcatgtgctgccatctattattcatttttaaatggtcatttcttattcagtgagtgctttagtgttttaaactatatggataagaatgcaggtagataatattctaggcataaaacatttaatgtaccttacctcatgcaatattctttggattctttgttgatttatgatattgctaatataatattttcttaaaatatataacaatatcttttatgcattttgagttccagctggtgcttctttatatttagaaattataatgggaaggtcatttaatttacagatggttttaaaattgaggtaatatctgaggtggcataatttaaaaatatttagcaaatttgtttcatatatactgtcttatttctagatttgtttaaaattggaatatgaaaaactaatggataaagctagcataaaattgatattttagtttgtattattaatatatcatgttaccttatatattaatctactcttgattctgctaattattaccaacaaaattgtattcatgacattttattaatcctctgtgaattttctgtaaataaaattatttctgaaaatctcta

SEQ ID NO: 63215 - DNA, 1648 bp, Homo sapiens
aggatcccccatctggaggtcgctccggggctggcaagcgcttcctgcgcagcgcctaggcgacctggagtttgtgacgctgtgatggtctagaggctggagattcaagatctgggtgccatcattttctggttctgttgatgaccctcttccaggttacatacagcttacatcttgcatcctcaagcgtttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaacaattcccttgactgaagacgttctcataacattaggaaaagaagagttccaaaagctgagacaagatcttgaaatggtactgtccactaaggagtcaaagaatgaaaagttaaaggaagacttagaaagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcataggccatcttacttttattgcaaaatggcatgtgctgccatctattattcatttttaaatggtcatttcttattcagtgagtgctttagtgttttaaactatatggataagaatgcaggtagataatattctaggcataaaacatttaatgtaccttacctcatgcaatattctttggattctttgttgatttatgatattgctaatataatattttcttaaaatatataacaatatcttttatgcattttgagttccagctggtgcttctttatatttagaaattataatgggaaggtcatttaatttacagatggttttaaaattgaggtaatatctgaggtggcataatttaaaaatatttagcaaatttgtttcatatatactgtcttatttctagatttgtttaaaattggaatatgaaaaactaatggataaagctagcataaaattgatattttagtttgtattattaatatatcatgttaccttatatattaatctactcttgattctgctaattattaccaacaaaattgtattcatgacattttattaatcctctgtgaattttctgtaaataaaattatttctgaaaatctcta

SEQ ID NO: 63216 - DNA, 1370 bp, Homo sapiens
cacatataataatagcaactcctggtcgactgattgaccacttgaaacctttcgtattttccggggctggcaagcgcttcctgcgcagcgcctaggcgacctggagtttgtgacgctgtgatggtctagaggctggagattcaagatctgggtgccatcattttctggttctgttgatgaccctcttccagcaattcccttgactgaagacgttctcataacattaggaaaagaagagttccaaaagctgagacaagatcttgaaatggtactgtccactaaggagtcaaagaatgaaaagttaaaggaagacttagaaagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcataggccatcttacttttattgcaaaatggcatgtgctgccatctattattcatttttaaatggtcatttcttattcagtgagtgctttagtgttttaaactatatggataagaatgcaggtagataatattctaggcataaaacatttaatgtaccttacctcatgcaatattctttggattctttgttgatttatgatattgctaatataatattttcttaaaatatataacaatatcttttatgcattttgagttccagctggtgcttctttatatttagaaattataatgggaaggtcatttaatttacagatggttttaaaattgaggtaatatctgaggtggcataatttaaaaatatttagcaaatttgtttcatatatactgtcttatttctagatttgtttaaaattggaatatgaaaaactaatggataaagctagcataaaattgatattttagtttgtattattaatatatcatgttaccttatatattaatctactcttgattctgctaattattaccaacaaaattgtattcatgacattttattaatcctctgtgaattttctgtaaataaaattatttctgaaaatctcta

SEQ ID NO: 63217 - DNA, 879 bp, Homo sapiens
cacatataataatagcaactcctggtcgactgattgaccacttgaaacctttcgtattttccggggctggcaagcgcttcctgcgcagcgcctaggcgacctggagtttgtgacgctgtgatggtctagaggctggagattcaagatctgggtgccatcattttctggttctgttgatgaccctcttccagtgtcagaataaattatcacttattggaactgaaacactcaccgattcaaatgctcagctatcattgttaattatgcaagtaaaatgtttaaccgctgaactcagtcaatggcagaaaaaaacacctgaaacaattcccttgactgaagacgttctcataacattaggaaaagaagagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgtaactgtgggcgtaaggatggctgaactcagaagacaacgctagatgaattccccaacgcggtttttcacca

SEQ ID NO: 63218 - DNA, 1541 bp, Homo sapiens
cacatataataatagcaactcctggtcgactgattgaccacttgaaacctttcgtattttccggggctggcaagcgcttcctgcgcagcgcctaggcgacctggagtttgtgacgctgtgatggtctagaggctggagattcaagatctgggtgccatcattttctggttctgttgatgaccctcttccaggttacatacagcttacatcttgcatcctcaagcggtagagagcaaactcttaaatgtttctatatgtttttattctactgccacattaaatcgccaagccagataatttgttgaatatttatccctcaccctccgcccccaccacatgtgcagagttttgcattacttttgcatattgataatgtattttggtggtcagtaaagaaatatttatgtttgactttttcgcttaaaaatattctaaaattcatgatgactgactttggctttgtgaacttaaactgtatcttatgggtatagcaggtgagattttcagccttctactagttgacattcaaattgttaatagctaacactgataaagctctttatatgctagctacagtacttatatatatatatttatatactcatttaattgtcataaccctagggagtatttaatattatcttcattttataggaaaggaaactgaggcatagaaagtttaagtgacttgcccaagtctcatagcttttaaatatcaaaacagatttaaacctgtatagtctggttgcagagttcatacctttaaagtttttttttctctaagtaatgtgccagtaaacataattgtatagacttatgcagacatatctatctttaggattattcctaagaatagaacttctggatcacaagaaatgcatgtaaaattttgatggatattatcatacaaagtgattgttccaccaacagtgcaagcctcttatttcacatgcttgccagtattatctcttaccaattttacattattgccattctgaatgaaaattaatgcttgtttaatttggattttcataaattatatatgagcttatgaatgtactttttctgtatttaaaaggtatttgttttttctttgaattcctcatttgtgttctttgccagtttctattgaattgtttttgttgtttacctttttattgtaaaaatgcagacacaaaataaacgtaaagtttactaattattatgaggtgaacacccttaccatcatgctagtcaaaaaataaaactttgataattacctcagaaatctctccatttggcccatcccagccacaacccttttcccccttccactcttcctccaaagtaattggtaacctgacttttttggtaatcttttttaaattttttttaatggtgagttgtttggtttcttcttatgaatttgtaggcacttgttatatattaaggaaattaggtcttgggttgccatatatattacaagtatttctcctaggtttgggggttttaaattttaactttgttgatgagatgtttgtccatgcagaattaaaaaaaaa

SEQ ID NO: 63219 - DNA, 1747 bp, Homo sapiens
cacatataataatagcaactcctggtcgactgattgaccacttgaaacctttcgtattttccggggctggcaagcgcttcctgcgcagcgcctaggcgacctggagtttgtgacgctgtgatgatacctgacttcccagccgggctttgagtcccgttcttctcggcttcccgcgcgccaacgcaagctccataacctcaccaatatttagagaaagatggaagggtggggacagaaggaagtggttaactcgcgggtttcctttcagatggactaaacatgttttctctcctgacctttattctctcacacactctctgaagaaggtggtctagaggctggagattcaagatctgggtgccatcattttctggttctgttgatgaccctcttccaggttacatacagcttacatcttgcatcctcaagcggtagagagcaaactcttaaatgtttctatatgtttttattctactgccacattaaatcgccaagccagataatttgttgaatatttatccctcaccctccgcccccaccacatgtgcagagttttgcattacttttgcatattgataatgtattttggtggtcagtaaagaaatatttatgtttgactttttcgcttaaaaatattctaaaattcatgatgactgactttggctttgtgaacttaaactgtatcttatgggtatagcaggtgagattttcagccttctactagttgacattcaaattgttaatagctaacactgataaagctctttatatgctagctacagtacttatatatatatatttatatactcatttaattgtcataaccctagggagtatttaatattatcttcattttataggaaaggaaactgaggcatagaaagtttaagtgacttgcccaagtctcatagcttttaaatatcaaaacagatttaaacctgtatagtctggttgcagagttcatacctttaaagtttttttttctctaagtaatgtgccagtaaacataattgtatagacttatgcagacatatctatctttaggattattcctaagaatagaacttctggatcacaagaaatgcatgtaaaattttgatggatattatcatacaaagtgattgttccaccaacagtgcaagcctcttatttcacatgcttgccagtattatctcttaccaattttacattattgccattctgaatgaaaattaatgcttgtttaatttggattttcataaattatatatgagcttatgaatgtactttttctgtatttaaaaggtatttgttttttctttgaattcctcatttgtgttctttgccagtttctattgaattgtttttgttgtttacctttttattgtaaaaatgcagacacaaaataaacgtaaagtttactaattattatgaggtgaacacccttaccatcatgctagtcaaaaaataaaactttgataattacctcagaaatctctccatttggcccatcccagccacaacccttttcccccttccactcttcctccaaagtaattggtaacctgacttttttggtaatcttttttaaattttttttaatggtgagttgtttggtttcttcttatgaatttgtaggcacttgttatatattaaggaaattaggtcttgggttgccatatatattacaagtatttctcctaggtttgggggttttaaattttaactttgttgatgagatgtttgtccatgcagaattaaaaaaaaa

SEQ ID NO: 63220 - DNA, 1248 bp, Homo sapiens
cacatataataatagcaactcctggtcgactgattgaccacttgaaacctttcgtattttccggggctggcaagcgcttcctgcgcagcgcctaggcgacctggagtttgtgacgctgtgatggtctagaggctggagattcaagatctgggtgccatcattttctggttctgttgatgaccctcttccagtttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaaggtctcatcgtgttgtccaggctggagtacagtggcacaatcatggctcattgcagccccgatctcccgggttcaagtgatcctcctacctcagcctcctgagtagctaggactacaagtgtgtgccaccatgcttggttagtggttggtttttgtatttttttgtagagacggggtttcaccatgttacccaggctggtcttgaactcctgggctcaagggatcctcctgccttggcctctcaaagtgcctggattactggcgtgccagtgatttgtttcttaatgaatgcaatttacctagtggaagagaaaagttataatttattttagatacttacacaaaagggacacatagttggatatgtcttctgtcttgtccagctggtgccaactatgtttttgtcttcagttaggaagtagaagacagcataaaaatttataattgtgatactccactagtacatcttttttttttaaatgtgagagcttaagtttctctatgcaatatacatctatacaggcacatctcattttattgtgcttcactttattgcactttgcagacactctatgtttaacaaattcagtttgtggcgagcctgtgtcacattttggtaatctcacagtattttagacttttaagtcattattacatctggttgggggatctgtgatcagtggtctttgatcttactattttaattgttttgaggaaccacaagctgcacctgtgtaagacagtaaatttaaccaataaatgttgtgtgtattctga

SEQ ID NO: 63221 - DNA, 330 bp, Homo sapiens
tttcctttcagatggactaaacatgttttctctcctgacctttattctctcacacactctctgaagaaggtggtgagtgcttgttactgtttctgggggtggggtggagaagcagctacttcaaataaccaaaagacctagggcagaacgggtcactcttctttcttctctctggtataggatttcatctcctagcagtcatctgaactctttctcctcctcctcatctgtcttcttcatttttaaaaaattaggtaaaaagcacataacataaaatgtattatcttaatctcttttttaaaaaatcaaatacagcttgtcaaaatgacc

SEQ ID NO: 63222 - DNA, 439 bp, Homo sapiens
ctttatcctaaagaagatattaatctcaaaagaagtgggaggattgtaaattctttctaaccaatttttaggaaatgtttttctaaattaaagatgcaaaaattcactttaaagcttttttcattagctaatacccatagtcctttcaaaaaggaaattcaaatttgtagattaaaagtattaaacagttgttgaaaaagaaaagaggtcaatattctttgacaaaaaactttcttatagctatattgactttttcccaagtaaagtatattttgaatgatattttctcctagattcttataaatagattatttgatgttccacatgatccatatgtcaaaattagtgattccttttggccaccttatgttgagctgctgctgcgtaatggaattgccttgagacatccagaagatccaacccgaataagattagaagc

SEQ ID NO: 63223 - DNA, 409 bp, Homo sapiens
gatattgctaatataatattttcttaaaatatataacaatatcttttatgcattttgagttccagctggtgcttctttatatttagaaattataatgggaaggtcatttaatttacagatggttttaaaattgaggtaatatctgaggtggcataatttaaaaatatttagcaaatttgtttcatatatactgtcttatttctagatttgtttaaaattggaatatgaaaaactaatggataaagctagcataaaattgatattttagtttgtattattaatatatcatgttaccttatatattaatctactcttgattctgctaattattaccaacaaaattgtattcatgacattttattaatcctctgtgaattttctgtaaataaaattatttctgaaaatctct

SEQ ID NO: 63224 - DNA, 1747 bp, Homo sapiens
aggatcccccatctggaggtcgctccggggctggcaagcgcttcctgcgcagcgcctaggcgacctggagtttgtgacgctgtgatggtctagaggctggagattcaagatctgggtgccatcattttctggttctgttgatgaccctcttccaggttacatacagcttacatcttgcatcctcaagcgtttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaacaattcccttgactgaagacgttctcataacattaggaaaagaagagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcataggccatcttacttttattgcaaaatggcatgtgctgccatctattattcatttttaaatggtcatttcttattcagtgagtgctttagtgttttaaactatatggataagaatgcaggtagataatattctaggcataaaacatttaatgtaccttacctcatgcaatattctttggattctttgttgatttatgatattgctaatataatattttcttaaaatatataacaatatcttttatgcattttgagttccagctggtgcttctttatatttagaaattataatgggaaggtcatttaatttacagatggttttaaaattgaggtaatatctgaggtggcataatttaaaaatatttagcaaatttgtttcatatatactgtcttatttctagatttgtttaaaattggaatatgaaaaactaatggataaagctagcataaaattgatattttagtttgtattattaatatatcatgttaccttatatattaatctactcttgattctgctaattattaccaacaaaattgtattcatgacattttattaatcctctgtgaattttctgtaaataaaattatttctgaaaatctcta

SEQ ID NO: 63225 - DNA, 1693 bp, Homo sapiens
aggatcccccatctggaggtcgctccggggctggcaagcgcttcctgcgcagcgcctaggcgacctggagtttgtgacgctgtgatggtctagaggctggagattcaagatctgggtgccatcattttctggttctgttgatgaccctcttccaggttacatacagcttacatcttgcatcctcaagcgtttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaacaattcccttgactgaagacgttctcataacattaggaaaagaagagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcataggccatcttacttttattgcaaaatggcatgtgctgccatctattattcatttttaaatggtcatttcttattcagtgagtgctttagtgttttaaactatatggataagaatgcaggtagataatattctaggcattatgatattgctaatataatattttcttaaaatatataacaatatcttttatgcattttgagttccagctggtgcttctttatatttagaaattataatgggaaggtcatttaatttacagatggttttaaaattgaggtaatatctgaggtggcataatttaaaaatatttagcaaatttgtttcatatatactgtcttatttctagatttgtttaaaattggaatatgaaaaactaatggataaagctagcataaaattgatattttagtttgtattattaatatatcatgttaccttatatattaatctactcttgattctgctaattattaccaacaaaattgtattcatgacattttattaatcctctgtgaattttctgtaaataaaattatttctgaaaatctcta

SEQ ID NO: 63226 - DNA, 1862 bp, Homo sapiens
cacatataataatagcaactcctggtcgactgattgaccacttgaaacctttcgtattttccggggctggcaagcgcttcctgcgcagcgcctaggcgacctggagtttgtgacgctgtgatggtctagaggctggagattcaagatctgggtgccatcattttctggttctgttgatgaccctcttccaggttacatacagcttacatcttgcatcctcaagcgacagccacaaagtcacactcagtttcagggggagaggaaaaagactctgtctcttgatggggaatgatgaaatattgcttttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaacaattcccttgactgaagacgttctcataacattaggaaaagaagagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcataggccatcttacttttattgcaaaatggcatgtgctgccatctattattcatttttaaatggtcatttcttattcagtgagtgctttagtgttttaaactatatggataagaatgcaggtagataatattctaggcataaaacatttaatgtaccttacctcatgcaatattctttggattctttgttgatttatgatattgctaatataatattttcttaaaatatataacaatatcttttatgcattttgagttccagctggtgcttctttatatttagaaattataatgggaaggtcatttaatttacagatggttttaaaattgaggtaatatctgaggtggcataatttaaaaatatttagcaaatttgtttcatatatactgtcttatttctagatttgtttaaaattggaatatgaaaaactaatggataaagctagcataaaattgatattttagtttgtattattaatatatcatgttaccttatatattaatctactcttgattctgctaattattaccaacaaaattgtattcatgacattttattaatcctctgtgaattttctgtaaataaaattatttctgaaaatctcta

SEQ ID NO: 63227 - DNA, 1882 bp, Homo sapiens
ttcatgtcttcttactcagttgtcaatttctcagtaaccttatatgaccaccttatttaaaattatattgtccttgccctagcatttcctatgtttcttccttgtcttttctccatggcacttataaatcatttgatatactaagtatatatatgttttattttttattttattgtctgttttccttacttagaataaggttcacggtaggagggatttttgtctattttgttcattgctatattcttaccccctagatgagtatctggcaggtaataagtgttcaaccaatactgctgaatgaataaatattttttgctttagtttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaacaattcccttgactgaagacgttctcataacattaggaaaagaagagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcataggccatcttacttttattgcaaaatggcatgtgctgccatctattattcatttttaaatggtcatttcttattcagtgagtgctttagtgttttaaactatatggataagaatgcaggtagataatattctaggcataaaacatttaatgtaccttacctcatgcaatattctttggattctttgttgatttatgatattgctaatataatattttcttaaaatatataacaatatcttttatgcattttgagttccagctggtgcttctttatatttagaaattataatgggaaggtcatttaatttacagatggttttaaaattgaggtaatatctgaggtggcataatttaaaaatatttagcaaatttgtttcatatatactgtcttatttctagatttgtttaaaattggaatatgaaaaactaatggataaagctagcataaaattgatattttagtttgtattattaatatatcatgttaccttatatattaatctactcttgattctgctaattattaccaacaaaattgtattcatgacattttattaatcctctgtgaattttctgtaaataaaattatttctgaaaatctcta

SEQ ID NO: 63228 - DNA, 1701 bp, Homo sapiens
cacatataataatagcaactcctggtcgactgattgaccacttgaaacctttcgtattttccggggctggcaagcgcttcctgcgcagcgcctaggcgacctggagtttgtgacgctgtgatggtctagaggctggagattcaagatctgggtgccatcattttctggttctgttgatgaccctcttccaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaacaattcccttgactgaagacgttctcataacattaggaaaagaagagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcataggccatcttacttttattgcaaaatggcatgtgctgccatctattattcatttttaaatggtcatttcttattcagtgagtgctttagtgttttaaactatatggataagaatgcaggtagataatattctaggcataaaacatttaatgtaccttacctcatgcaatattctttggattctttgttgatttatgatattgctaatataatattttcttaaaatatataacaatatcttttatgcattttgagttccagctggtgcttctttatatttagaaattataatgggaaggtcatttaatttacagatggttttaaaattgaggtaatatctgaggtggcataatttaaaaatatttagcaaatttgtttcatatatactgtcttatttctagatttgtttaaaattggaatatgaaaaactaatggataaagctagcataaaattgatattttagtttgtattattaatatatcatgttaccttatatattaatctactcttgattctgctaattattaccaacaaaattgtattcatgacattttattaatcctctgtgaattttctgtaaataaaattatttctgaaaatctcta

SEQ ID NO: 63229 - DNA, 1503 bp, Homo sapiens
cacatataataatagcaactcctggtcgactgattgaccacttgaaacctttcgtattttccggggctggcaagcgcttcctgcgcagcgcctaggcgacctggagtttgtgacgctgtgatggtctagaggctggagattcaagatctgggtgccatcattttctggttctgttgatgaccctcttccaggttacatacagcttacatcttgcatcctcaagcgcaattcccttgactgaagacgttctcataacattaggaaaagaagagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcataggccatcttacttttattgcaaaatggcatgtgctgccatctattattcatttttaaatggtcatttcttattcagtgagtgctttagtgttttaaactatatggataagaatgcaggtagataatattctaggcataaaacatttaatgtaccttacctcatgcaatattctttggattctttgttgatttatgatattgctaatataatattttcttaaaatatataacaatatcttttatgcattttgagttccagctggtgcttctttatatttagaaattataatgggaaggtcatttaatttacagatggttttaaaattgaggtaatatctgaggtggcataatttaaaaatatttagcaaatttgtttcatatatactgtcttatttctagatttgtttaaaattggaatatgaaaaactaatggataaagctagcataaaattgatattttagtttgtattattaatatatcatgttaccttatatattaatctactcttgattctgctaattattaccaacaaaattgtattcatgacattttattaatcctctgtgaattttctgtaaataaaattatttctgaaaatctcta

SEQ ID NO: 63230 - DNA, 1865 bp, Homo sapiens
cacatataataatagcaactcctggtcgactgattgaccacttgaaacctttcgtattttccggggctggcaagcgcttcctgcgcagcgcctaggcgacctggagtttgtgacgctgtgatggtctagaggctggagattcaagatctgggtgccatcattttctggttctgttgatgaccctcttccaggttacatacagcttacatcttgcatcctcaagcgtttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaacaattcccttgactgaagacgttctcataacattaggaaaagaagagattctgcagatgatgattctctcctacaaaccagttgggtgtcctcttaattcacttcagttctgacataatctacttggagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcataggccatcttacttttattgcaaaatggcatgtgctgccatctattattcatttttaaatggtcatttcttattcagtgagtgctttagtgttttaaactatatggataagaatgcaggtagataatattctaggcataaaacatttaatgtaccttacctcatgcaatattctttggattctttgttgatttatgatattgctaatataatattttcttaaaatatataacaatatcttttatgcattttgagttccagctggtgcttctttatatttagaaattataatgggaaggtcatttaatttacagatggttttaaaattgaggtaatatctgaggtggcataatttaaaaatatttagcaaatttgtttcatatatactgtcttatttctagatttgtttaaaattggaatatgaaaaactaatggataaagctagcataaaattgatattttagtttgtattattaatatatcatgttaccttatatattaatctactcttgattctgctaattattaccaacaaaattgtattcatgacattttattaatcctctgtgaattttctgtaaataaaattatttctgaaaatctcta

SEQ ID NO: 63231 - DNA, 2088 bp, Homo sapiens
aggatcccccatctggaggtcgctccggggctggcaagcgcttcctgcgcagcgcctaggcgacctggagtttgtgacgctgtgatggtctagaggctggagattcaagatctgggtgccatcattttctggttctgttgatgaccctcttccaggttacatacagcttacatcttgcatcctcaagcgtttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaacaattcccttgactgaagacgttctcataacattaggaaaagaagagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagggtattaattttatgttctaggtttttaaaataggaaaagtattttattttttgtgttacatgaaacatagatgaagttaaatgttaccaggaatcaggagtcttgccctaacttttgttaactattagctattatatgatcttttatgggtgacttgacttgactgtacctttggtttctctacttgttatatagacaatatgattttcaaaaaggtagttatttggtttgagcaaatgaagttttaacaaagtttttgatcaacttcatgaataactagttacatgtgtgtatgtgttttatcagttaaatgtttctcttaatttttttaatctattagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcataggccatcttacttttattgcaaaatggcatgtgctgccatctattattcatttttaaatggtcatttcttattcagtgagtgctttagtgttttaaactatatggataagaatgcaggtagataatattctaggcataaaacatttaatgtaccttacctcatgcaatattctttggattctttgttgatttatgatattgctaatataatattttcttaaaatatataacaatatcttttatgcattttgagttccagctggtgcttctttatatttagaaattataatgggaaggtcatttaatttacagatggttttaaaattgaggtaatatctgaggtggcataatttaaaaatatttagcaaatttgtttcatatatactgtcttatttctagatttgtttaaaattggaatatgaaaaactaatggataaagctagcataaaattgatattttagtttgtattattaatatatcatgttaccttatatattaatctactcttgattctgctaattattaccaacaaaattgtattcatgacattttattaatcctctgtgaattttctgtaaataaaattatttctgaaaatctcta

SEQ ID NO: 63232 - DNA, 1501 bp, Homo sapiens
cacatataataatagcaactcctggtcgactgattgaccacttgaaacctttcgtattttccggggctggcaagcgcttcctgcgcagcgcctaggcgacctggagtttgtgacgctgtgatggtctagaggctggagattcaagatctgggtgccatcattttctggttctgttgatgaccctcttccagcaattcccttgactgaagacgttctcataacattaggaaaagaagagttccaaaagctgagacaagatcttgaaatggtactgtccactaaggagtcaaagaatgaaaagttaaaggaagacttagaaagatattgcttgtattgtttttccatgtcgaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcataggccatcttacttttattgcaaaatggcatgtgctgccatctattattcatttttaaatggtcatttcttattcagtgagtgctttagtgttttaaactatatggataagaatgcaggtagataatattctaggcataaaacatttaatgtaccttacctcatgcaatattctttggattctttgttgatttatgatattgctaatataatattttcttaaaatatataacaatatcttttatgcattttgagttccagctggtgcttctttatatttagaaattataatgggaaggtcatttaatttacagatggttttaaaattgaggtaatatctgaggtggcataatttaaaaatatttagcaaatttgtttcatatatactgtcttatttctagatttgtttaaaattggaatatgaaaaactaatggataaagctagcataaaattgatattttagtttgtattattaatatatcatgttaccttatatattaatctactcttgattctgctaattattaccaacaaaattgtattcatgacattttattaatcctctgtgaattttctgtaaataaaattatttctgaaaatctcta

SEQ ID NO: 63233 - DNA, 1020 bp, Homo sapiens
cacatataataatagcaactcctggtcgactgattgaccacttgaaacctttcgtattttccggggctggcaagcgcttcctgcgcagcgcctaggcgacctggagtttgtgacgctgtgatggtctagaggctggagattcaagatctgggtgccatcattttctggttctgttgatgaccctcttccaggttacatacagcttacatcttgcatcctcaagcgtttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaacaattcccttgactgaagacgttctcataacattaggaaaagaagagattctgcagatgatgattctctcctacaaaccagttgggtgtcctcttaattcacttcagttctgacataatctacttggagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgttaaaaagaaaaagatggagtctccctgtgtcacccaggctggaatgcagtggcatgatctcgtctcactgcaacctctgcctcctgggtt

SEQ ID NO: 63234 - DNA, 376 bp, Homo sapiens
tatctttgaagaccaaatacccaaaagatctgcttcaaccttccccagttaatcttttgccagaagattcacaatctgaatgtggctgcctgtccatcattggaagtaattggaaagaaaactttgcctgaagctacatgagaactggaacccttaaatcatgaatggtggcaagattccaaaattaattatgaagactattggaatgatgtagcatcctttaactcttattgtgatcgacagaaagtatcatagatggacaactcactttccctttgctctgtgcttcctggtgattttaggtcacgtccactctgaaatctgagctgtcattaaagccatgtcttcgtgtctgtctgtctgaagcagcaaagat

SEQ ID NO: 63235 - DNA, 272 bp, Homo sapiens
tatctttgaagaccaaatacccaaaagatctgcttcaaccttccccagttaatcttttgccagaagattcacaatctgaatgtggctcaatataaagaaatccttcagtcaagtttccataaagaccctctttcctgcttctggctgagctcctactaaaaagaagattaatgtggaaattaatctaatccaggattaagagtagaagacttacttaaactgggcaattttctgtcaatttgattgtaataaatattttgcatttaagagtt

SEQ ID NO: 63236 - DNA, 529 bp, Homo sapiens
ctaactgtgcatcaaaatctgcaaaatgcaaatatatcaccattctgttttcacagacatattctcgttggcaacagcagatgtggttaagctaattacaagaaagctcagaaaaaggagagcagacactgcaaatgcgcaataggcttaaggtaatgaagctgcaggatacaccagcccagatcaagaagctggtaaataatgaggatggcaatgcccaatactgcctggcagtgatgaggtgagcaatttagcctgcgagcatcacctcactgggaaagttaatagccccccaggctttaaagggaaagccacgaaacagctgtgatggtggcataggaggggctgcctctagatgtgctttttaaaaagcatcatatgttttatcctggggctcctgaagtgtcttgggaaatggccaaagaagttttgctttgtaagtgcctgaaaaatgctgttaagagctcaacacagcccttaaagaatcctataacattgtggcaattaaatgactttgctaccagcaaca

SEQ ID NO: 63237 - DNA, 598 bp, Homo sapiens
cctcggcctcccaaagtgctgggattacaggtgtgagccactgtgcccggccaaaattagccaaattcttgaaagaatgaatgaggaatgggagctattgcatccacaacctcagggtttcaagaaacatcctaattatgttctttaaatcaaatcaacttaaatcctacttcaagcctttatttcaccagaccaataggaaatccagtctcagtcatatttgggtttccctcgttgatatggttccgatgtcctgcccaaatctcatgttgaaatgtaatccccagtgtcagaggtggggcctggtgggaggtgattggatcatgggggtggatttctcatgaatggtttagcagcagcatcttagtactattctcgcaatagtgagtgagttctcatgggatctggtcatttaaaagtgtgtagcccctctgcccctgcctactgctcctgctctggccatgtgacctgtctgctccccccacttctgcttctgccatcattggaagtttcctgaggcctccccagaagcagatgccgttatgcttcctgtacagcctgacgaagtgtgagccaatgaaacctctttttataaatg

SEQ ID NO: 63238 - DNA, 659 bp, Homo sapiens
gcgcccagccatcagttatattttagagtcaattttatattcttgaattttcattttgtatgaatttattttttatgaaattcataaaattgggtgaagaaataaagctgaaacttgcctttcatgtcagaagaccctatgagtttctgtgctggctcctactgggaaacactgtttttcacccaaagcagactaacttaaattcttcagttccagaataaggctttcaagatgtatttttaccatgccaaagtctgcaaaagttttggaaaaccaaaatcataatgtggaaatctgacagtcttgcactgtgatctgcttctttggagataacacgttcattgttcacttgagaaaggggataaatgtgctaattaggtagtaaacatctactctcaaattcttcccatcctttattacctttttgtctatatcctaggagacattcttttctattttttcagacctactgttaataatggggtaatagaggctgtagattaatagcagttcacattcatgtggtactatcgaggtgccaggtactggactaaatgttttcattacctcatttaaagcctggagagttaagtattttctctgaagtcacataacttgtaaagaaagaagctgagattagttttacagccctcacttaa

SEQ ID NO: 63239 - DNA, 159 bp, Homo sapiens
gaaggaaaaggaaaatctattcaaaataaagtattccagatatctgacattgctgcattgctgtatcattcattaacattcacaaaaaataaaatgagtgccttccgtgtgtgtgcaggcattgttctaggcaaagaagatttagcattcaaccaaaac

SEQ ID NO: 63240 - DNA, 393 bp, Homo sapiens
ttgtgctttcctgtgcatgtatgtttagtttttatttttctaatcaatgtaaggtacttttttataatcagaaaaaaaaaaaagaattccgtagctattagtggatattttgatgtcagtggcctcagaattcagggaatcccaaagccacacaattgccaaaaatatttatgaagtagggaacatttgaataatatgccatagatgatgggattctaaaattatgcttcatattatttttgttcaaattgcgttttggccagattttacttattgtacacttttctttttttgccaatggggtgtgtgttcaattatgttacaaataatattaaaaggaatatactgaaggaaagtgaaagttcccttatacttaaggcaagcatttaaaaa

SEQ ID NO: 63241 - DNA, 139 bp, Homo sapiens
gtgagtgaacatggatggaaacaaattattaggttgttcaaagtgaaaaacaccaaaaataagatttaaaaagaatgtcaggtatccatagaaaaatattaataggtctaatacatatgtaaaaattggagtcccaggg

SEQ ID NO: 63242 - DNA, 336 bp, Homo sapiens
aaagtctctgtgcattcaccccaccacggcatggaaaaaaacataacattgtcctgaggaacttgaccactaacatatctaagtggaaaaatacccattcatccctgaccgttatttacattctctaagttaagcttaacatcctctctagttccaccagtaattatgtttttaaaatgctgtcagttgttttccagtgatgcatattgatatctgtagtgactgggcatttgcttttaaatctactgcagcaaagaaaaacagttcgttccaccattctgtctacttttgtgtgtgtgtgaaaacttttatagtaaacattttaagaaataagtc

SEQ ID NO: 63243 - DNA, 330 bp, Homo sapiens
aacaaaatcatttccttcgcagcaacatggatacaactggaatccactatcctaagcaaactaacgcagaaagagaaaccaagtgtctcgttttcactcatatgtgggagctacacattaggtgcacattggcataaacataggaacaatagacactgggaaataagaacggggagggacagagtgggccagggttgaaaaactacttcttgggtcctatgctcactacctgtgtgatgggttcaattgtactccaaacctcagcatccctcgatatacctttggaagaaacttacacaggtaccactttaatttagaatacaaactaga

SEQ ID NO: 63244 - DNA, 210 bp, Homo sapiens
tttgtattctaaattaaagtggtacctgtttaagtttctcccaaaggtatatcgagggacagagtgggccagggttgaaaaactacttcttgggtcctatgctcactacctgtgtgatgggttcaattgtactccaaacctcagcatccctcgatatacctttggaagaaacttacacaggtaccactttaatttagaatacaaactaga

SEQ ID NO: 63245 - DNA, 1680 bp, Homo sapiens
gcaaggtatgttcatagctattgcacacacaaaacttacatacgtcctgcttacacaattttaagttggaaaagactgcatctttatgtttttgatttctctaaaaggttatttatgcttccttctgtttgggaaagataaattaagtcttgtgcgctatagaggattttttttctttaagaaaaacgaatgttgatgcattttatagcccgagtgaggaacagagatagaggtactttgtgccattgctattaaagaaaaagaaaatgtctctttttttttctggaagaataagattttaattaaagcacttgcacccttttgtatgtgagctggtctcaaacaaagtcctcacccacagcagtttcagcagctgaacagtcccatggaagttctgactggcaggcatcaacagggctattagcacccagcatagtttgccctgagtacggaggatggatgctttggctctaactactcaccaataattgctccttccttaccttctttgttaatggtaaactgctggaaatggagtagtacaggtaacaattatttttaattgtctttccagaccagtttttggttgtgtgttcagtaaatgatagtctgtatcacagccttcaagtctggattatttttctaaatgcatactctacctgttcagttacactcgttgtggaacaacattagcttatataccagtaagttgtcgagaatggataaccatctgtcattatcactgaccttcaaagactcatcaagcagtccctgcataaggattggagtggtttgaagtttctcttccaagcactaacatgtccctatcccacagtcattttaatttggtatgtgactgtttctttcatttctttcacagataatattatatatacagttatataaatatatttcatattaaatgttatataacacaagagagagaaagtataagtagaaagagtgcctagcaccctaagaaatttaaattaaaatgctaattatccattggtgagtgcagtctcgaggataggtgagtaaactgctctgtgttgaagtcacactgctgacctggttattgtaataaatcacctctttggttaatttaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaataaaaaaaaaaaatataattaattaaaaataaaatttaaatttaatagacatattattacaattttatatttaataaaaataatatttaacccaaattaaaattatttaaaaacaaaaccctttccccatctcaattaattccttttaaaccccctcccttttctcctttttaacacatttacatacctatacctcaatctcaaaatctttaacatctcaattttgctttaaatttccaaatatttttgttaaattaaatctttatttaaactataagtctaatttctaaaaaatcacttcaaatctaacaaatatcccagaacagtaaattctttttccaaatttggacaaactcaaatgtcccatttttgacacattaatctaattgactttctatgggcccagtgcccataacctcatttaagcgatcccttaaaggtgcccccttataataaatctatatcctaagccaa

SEQ ID NO: 63246 - DNA, 497 bp, Homo sapiens
aaataatagtctctgatgcttgaaaagccttaaagctacttattattatccccattttacagataagaaaacagaatgtgaagtggtagagcaattacctaactctaaacccaagtctctgagatttggaagctgtgcagcttgtgcattatgccatgactatgatatatctgctcactaagttgaatatcatgtagctatttaaaagcttattaaagaattatgtaggattatatgaaaatacttgggaggaataaatgacaattttggtctcaataaaatgcgtattttttaaaagactgggaaaaacacaagataaaaatggttttcttattatgcttttcacctttgctacaatttcttaactttctctaataccattataattatattgctcaaaaacatctatttttaaataataaatggatcaaatggtcaagtagtaaatgagtatgtggaaaatactattattttatctgtgtgcattttgtagtgta

SEQ ID NO: 63247 - DNA, 939 bp, Homo sapiens
gagaatttgggctggtgcattccgatgcaccttgaccgtcccataccagaattgtgccaggtgcacctggaattttccaagacagatgtgaatcttaaggggagtattttgtcctcttgtgaggaaaagtactttaaaatgtgcaaaactgaggaatcagagcttaaggaagactcagaccccattctggccaaacttgaaaggctgatcttgttgctaactttgattgccacttgctatcccacatgagcatcaacccagagttctcataggtgttggtgatcttgtttgggaacttggttttcacagcaggaactgattacttagcaagtgccctaattgaagaaaacacattgctcccaatctccattggcttttgtgaaaaatctggtcctgagcagttagacatcctcctttccaagctttttatagaacacagattaatctttaagctctgcttctgatgttgcccttctttactgaaaacaattctgaatcattagtgtaattaagaaaataccgtctgaggccatttttattttgtatttgcatatgacaccaaagctgcaaaacaggaactaagcatggtaataatgctggtccaaaggtggccaggtatgaacacttccttctaggcctgctgccaggaggagagctggcttattgatgggagcattgtatgctgctgaaacctccttacttgggggttctccccagagacagagaagaaaacctaaggcaggcattagtcttggaaaccagtaccagctagtatctcatgccaatgaaaagcatccaggacaagcatgtttgcaaaaaacaagcatgtcctgtctctttcacatctctggcacatccatgatcaccctgagtcagacccaaataaggggcagcagagacagccagatgaagcagcaatttgagggtagtaactggtga

SEQ ID NO: 63248 - DNA, 463 bp, Homo sapiens
acatagaacctgcattgctgtagagccgccgactccctttctttaaccctcgccttccctttaaaaaacctaatgaggatgtctcacagctaaaccttagaaaccatgaccttcactgaaactggctgagtttaaggagaggctcttagtcatggtcagtttcccctctcctctggctcccacctcccttggccatgctgtgtcccttgagggatgagcacacctggctgcttctccagacactagtcccctccgattaccagctctgggctgggctgaccaccttctcaaccatcctggtcagcatcctacgttctatctcttacagcaaacaaccagcctatttccttcaatgcctccttcactgtttctttgagactagagtaatataatgcttttaacagtggaaagactataaaaaatgaagttatcaatactcaataagtgagtacattctcccaaa

SEQ ID NO: 63249 - DNA, 350 bp, Homo sapiens
gggtggttccgagtctatttctaattgtgtggctttgggcaggccccatagcttctctgagcctctatttcctcgtctgtaaaatgggagcagcgacactaatctgacaaagctttgcagtgcttagcaacacagtacatgtgagcttcaccctgtgcttggcttattgaaagcatgtattacctgggagctctggtttccctccaaggctccaatcccacgtttccagcagctggtgcctcaaattaaaaaggaaaaggcatactcagttgagtctgtgcttcccatgattgaggctgctatcctccccagctcctggggaggcgatcccagagtcctctttgttccat

SEQ ID NO: 63250 - DNA, 226 bp, Homo sapiens
gttcctgcccctggagggttccggggcctcctacggcttgtgccgtccgtgtcgccgtccctgtctctgtcgtccttagctgctgggcctctcctagcttggagtgaggggcggtgggtttgctccctccacctgggtggtctttgtgctctttggggagggggtaggttggatgcagctggaactcacccagcagcaggtgcagctggagaatcccaggctttct

SEQ ID NO: 63251 - DNA, 698 bp, Homo sapiens
agggtaagagggatctgtggtgatttgggagccaaaggaaggagctcttcacccagtgtagggtatggtttgtgaaggtatccctagagaaggtgactctgcggctgagcttgaaggaagagaattggtaggtgacaaagaagaggaatataacacattcctgtcattaagagaagctgctgacttgaaatgggagttcagtaatggcagtgagaggagatgaagtaacaccgttggaggaggtcagagcacagggtgccttaaaaacaagccacagcatttggactttattctccttatttatgccatcctgtttatcagtattgatctgcagcactccaaggtccaagggacaaaggcaaggaaatctccaacctctcagaatatgagaagatactatagtaaatatgtcaataaattttattctacaacagctctatgtggcaggttctcatctccattgtacagaacaagaaattaagactcagaaatcttaaaggatttgctgaaggttgcatggcccttataaaatgttaccagctcatttaacttcaagacctcttcctgctatgctcacactgtttggaaagtcacattctaatcagacttgatggctaaatcagtcagaatcaaatatgcccacctatgttgacatgctgtgtaaagattttctgttcaacgtgaacacatggttgcaa

SEQ ID NO: 63252 - DNA, 654 bp, Homo sapiens
agggtaagagggatctgtggtgatttgggagccaaaggaaggagctcttcacccagtgtagggtatggtttgtgaaggtatccctagagaaggtgactctgcggctgagcttgaaggaagagaattggtaggtgacaaagaagaggtccactcatatgatcgaatttgaatcaaggtctcaagctaatctaaggaaaaaaaaaaagcagagaagctatatggcagaaagcagagaattggaagggaagtcacaaaagaagagaacatacttgcaggcattgtttcaggtagtgagtgaaatctgcaaacaaacagaaattctttctctcgtggaatgtatgtactaactggagaaagcattgtttaaaaaataagcaaataggatgtcaggctgtgttcaagagagtgtatttagttcttcacacaatagtgatgctgatggataaagatttccagtttggtctcaatccaataaaacacccccattcaaagtgtcattgtcccactctttccaactgatgccctaaagctcacagaagagacttgttgggtgtgcaaatttggctttcctcataattctgcaacctgcataagaaagttttagttctgattttcagccttatcttccctgtgactacatgaaataagagatta

SEQ ID NO: 63253 - DNA, 786 bp, Homo sapiens
agggtaagagggatctgtggtgatttgggagccaaaggaaggagctcttcacccagtgtagggtatggtttgtgaaggtatccctagagaaggtgactctgcggctgagcttgaaggaagagaattggtaggtgacaaagaagaggtaatgagccaaaaagatcatgtctgaaatacaaggaacggttgagttttcggtagagctacataaattttataatgtggatctctttcagagagggatgcagtctgaatttggcatttcacgtgcaggtgatatcagtaaatcctcatgatagacttacctccaaggctcattgtattaccagatccgagtgaccttgaaggtgtcttcaaggatcccccacagactgagtgcctccatcgctgggcagacagagagcagcagcctgcattcagcctgtgtccatgacagcaccgtgcacagccgggtctttcagatcttataccggaatgaagaggtacccataaatgatgctgtggtcttccgagttcatttactcttgggtggtgaaaggatggaagacgcactgagtgaagtagattttcaactcaaggtggatctgcactttacggacagtgaacagcagttgagggatgtggctggggcaccgatggtcagcagccgaacgcttggcctgcacttccacccccggaatggtctgcaccaccaggtcccggtcatgttcgactatttccacctgtctgtgatctcggtgaccgtccatgctgccctggtggctctgcagcagccattgatcaggt

SEQ ID NO: 63254 - DNA, 422 bp, Homo sapiens
ttattttcttgtttaaggtgagagggtcctattgtccgaacgtttgtgtctcccaaaatttatacgttgaaacataattaacatatgaatgtgatggcattgggaggtggggcctttgagaggtgattaggttatgagaaaagagccctcaggactaatgctttttaaaaagaggccccagagagctgccttgccccttccaccatgtgtggacacagctagatggcacctgtggaccagaaagctggccctcatcactcacccagattaaactggtaagaaacatgatggtatcaataagagtttatcagaaaataatatgtcattctagaggaatataccaacattttagacttaaagttattaataaaaataatttgccagttacaattaatagcacataatgatagctagtcagaaaa

SEQ ID NO: 63255 - DNA, 336 bp, Homo sapiens
tgtgtttgtaaataaagttttattggaacacagccaagcccattcctaaggaagggtctccggctctggaagaacaacaggagaaaccaagcaaccaaaccagaggccacgtgggccacagagcccagcaaaactactgtctagcccttcccagaaaacacttgccaagctctgttctatgggatcagggactctggtgaaaagtgtcttttgtgtaaaatgggaactgatagaactgcttctctgcttctctctaaaagggtcatttaaaagcacaaaagcacattcatgcattttcctctccacaattcgcaaaactggttttccattaaaaaa

SEQ ID NO: 63256 - DNA, 3115 bp, Homo sapiens
catctttgagcaagatgggtctctaccgcatccgcgtgtccactggggcctcgctctatgccggttccaacaaccaggtgcagctgtggctggtcggccagcacggggaggcggcgctcgggaagcgactgtggcccgcacggggcaaggagacagaactcaaggtggaagtaccggagtatctggggccgctgctgtttgtgaaactgcgcaaacggcacctccttaaggacgacgcctggttctgcaactggatctctgtgcagggccccggagccggggacgaggtcaggttcccttgttaccgctgggtggagggcaacggcgtcctgagcctgcctgaaggcaccggccgcactgtgggcgaggaccctcagggcctgttccagaaacaccgggaagaagagctggaagagagaaggaagttgtaccggtggggaaactggaaggacgggttaattctgaatatggctggggccaaactatatgacctccctgtggatgagcgatttctggaagacaagagagttgactttgaggtttcgctggccaaggggctggccgacctcgctatcaaagactctctaaatgttctgacttgctggaaggatctagatgacttcaaccggattttctggtgtggtcagagcaagctggctgagcgcgtgcgggactcctggaaggaagatgccttatttgggtaccagtttcttaatggcgccaaccccgtggtgctgaggcgctctgctcaccttcctgctcgcctagtgttccctccaggcatggaggaactgcaggcccagctggagaaggagctggagggaggcacactgttcgaagctgacttctccctgctggatgggatcaaggccaacgtcattctctgtagccagcagcacctggctgcccctctagtcatgctgaaattgcagcctgatgggaaactcttgcccatggtcatccagctccagctgccccgcacaggatccccaccacctccccttttcttgcctacggatcccccaatggcctggcttctggccaaatgctgggtgcgcagctctgacttccagctccatgagctgcagtctcatcttctgaggggacacttgatggctgaggtcattgttgtggccaccatgaggtgcctgccgtcgatacatcctatcttcaagcttataattccccacctgcgatacaccctggaaattaacgtccgggccaggactgggctggtctctgacatgggaattttcgaccagataatgagcactggtgggggaggccacgtgcagctgctcaagcaagctggagccttcctaacctacagctccttctgtccccctgatgacttggccgaccgggggctcctgggagtgaagtcttccttctatgcccaagatgcgctgcggctctgggaaatcatctatcggtatgtggaaggaatcgtgagtctccactataagacagacgtggctgtgaaagacgacccagagctgcagacctggtgtcgagagatcactgaaatcgggctgcaaggggcccaggaccgagggtttcctgtctctttacaggctcgggaccaggtttgccactttgtcaccatgtgtatcttcacctgcaccggccaacacgcctctgtgcacctgggccagctggactggtactcttgggtgcctaatgcaccctgcacgatgcggctgcccccgccaaccaccaaggatgcaacgctggagacagtgatggcgacactgcccaacttccaccaggcttctctccagatgtccatcacttggcagctgggcagacgccagcccgttatggtggctgtgggccagcatgaggaggagtatttttcgggccctgagcctaaggctgtgctgaagaagttcagggaggagctggctgccctggataaggaaattgagatccggaatgcaaagctggacatgccctacgagtacctgcggcccagcgtggtggaaaacagtgtggccatctaagcgtcgccaccctttggttatttcagcccccatcacccaagccacaagctgaccccttcgtggttatagccctgccctcccaagtcccaccctcttcccatgtcccaccctccctagaggggcaccttttcatggtctctgcacccagtgaacacattttactctagaggcatcacctgggaccttactcctctttccttccttcctcctttcctatcttccttcctctctctcttcctctttcttcattcagatctatatggcaaatagccacaattatataaatcatttcaagactagaatagggggatataatacatattactccacaccttttatgaatcaaatatgatttttttgttgttgttaagacagagtctcactttgacacccaggctggagtgcagtggtgccatcaccacggctcactgcagcctcagcgtcctgggctcaaatgatcctcccacctcagcctcctgagtagctgggactacaggctcatgccatcatgcccagctaatatttttttattttcgtggagacggggcctcactatgttgcctaggctggaaataggattttgaacccaaattgagtttaacaataataaaaagttgttttacgctaaagatggaaaagaactaggactgaactattttaaataaaatattggcaaaagaatatagagcatcaaaaaatttttctgggttcatatgcttgatgtggtaaagaattaaaaattttttatttttattgagacagaatcttgctcttgctgcccaggctggagtgcaatggcgcgatcttggctcgctgcaaccttcgcctcccaggttcaaacaattctcctgcctcagccgcccaagtagctgggattacaggcgcctgccaccacgcccaactaatattttgtatttttagtagagatggggtttcgccatgttggccaggctggtttcgaactcctgacctcaggtgatccacccgcctcggcctcccaaagtgctgggattacaggtgtgagccgccctgcccggcctaaaaattttttaaaattaaaaaaaaattgtcttctaactggataggatttaatttgtgtcctgaaaccagac

SEQ ID NO: 63257 - DNA, 203 bp, Homo sapiens
tgaggcatccctgaggagaacagctggaggtggggcgctcaaagttcaaggatcacgctagcatttgccatgtcaccattgctggagtttgtaagaccaatcaaggaatctgtcggcacccatgcacggggtcttggggtgattcactgtcagcatcgcaggcagaggggccaggtgagacctgaccagcaaccagagcagca

SEQ ID NO: 63258 - DNA, 370 bp, Homo sapiens
ctttatttattttcagcctggctcaaaaagcgtttgaggtagctgcttacaggaatgcatgcaataagattttttaagataataagttttcgaagtcagcataaggggaaattgttataaaatagaataagaaaatgagtacatgtgtgtgaaagaaagagagagagaaataactgtaagaatacaggagggctagcttaaaattagctggagtagcatcctactgcaacctttaaattttaagagttttggagaatatcttcctttttggcctattcatttccccaaaatccactgttatagatgaattcacacataactgtcatatcacaactgctcattgatacagaatgaaccaaaaaatgtaaaa

SEQ ID NO: 63259 - DNA, 131 bp, Homo sapiens
ctctcagcagctagccaggctggcctggccctgacggcccgggaatagcagctgtcttgtgacttcccacagcaggcacattgcgtcgtctctcaaagtccctcctctggagcgcctcctctgcccgtggg

SEQ ID NO: 63260 - DNA, 438 bp, Homo sapiens
gaattcagctgagatgatatttaaggcatagctagggactgtgatcttgccgacaaaaatattacttatttcctttttatgaaaagaatattaccatcagaatccaagacctccgaacttccctgctgaaggcacgtttacgtctttggactctggtgtaccagggcctgaacaagctataacaccatggtattaccaaatacatcctaagtcatcaaaacagctttttaggctaattctgtaagtacagcaaaacacacagcaaacttaaggttttcttagtagtaaaaaacatgtatctctcatactgtaaaaaataaaggtgttccatgggagggaaggagtagggggagaacaggttggggctcaaaataagcaagtagggttattgtaatctattttaaagaaaattcataattttaaatctctctttagttc

SEQ ID NO: 63261 - DNA, 328 bp, Homo sapiens
aaatctgtcttccactcctggcttctaaatctttttggtaggtacccacaaatgaaactgcgggaacatctgatcattctgtttctaatttttccagtacacgccatactattttccccgttccttcacggttttacattccctgcgatcagattcgagcattcctacttccctttagtctcaccaatgcctgtttgtttatcatatccatcctaatgtgtggtatcacgttcttggtttgatttgcgcttccctatgatgagtgattttgaacatcattttagatgcttattggccattgctatatcttctttagacacacgtctac

SEQ ID NO: 63262 - DNA, 812 bp, Homo sapiens
cccgggctgcaggaattcggcacgagagtgagccgagtttgcaccactgcactccagcgttggtaacagagtgagactccgtcttaaaaaacaaacaaacaaacaaaaagaatggctacatgaattattttataatactgcaacaaaatactgtactgtgttgaaaatcaatgaaactactcctgcacttaagaatatggttaaaatcttacaaaagtagtgttgccagacacaaaggagtacataccgtataattccatttgcgtaagtttcaaaaataggcaaactaatctatgattatagaattcagcatgatcggtaatttgggaatagtagtgactaggagagggcatacagtgggctttgacttactgttaatgttctttcttctctcattacatgaattactgagaaaatagtagattctattaatatttaacagttaaaacacttccttttgtgttgtcgtgtttattgaatagacattgctttttaaactttgttctttaaaaaatacagtttaggccgggtgtggtggctcacacctgtaatcccagcactttgggaggccaaggtgggtggatcacctgaggtcagaagttcgagaccatcctggccaacatggtgaaaccccgtctgtatttaaaaaaatacaaaaaaaaattagatgggtgtagtggctcgcgcctgtaatcccagctacttgggaggctgaggcaggagaatcgcttgaacccaggaggtggaggttgcagtgagccgagatcgcgccactgcactccagcctagcaacagagtgagactctgtctca

SEQ ID NO: 63263 - DNA, 331 bp, Homo sapiens
tgctgatattacaggcgtgtgaaccaccgtgcctggccgttttcatttctttgtgatctgcttaggagtagaattgtaggtcatatggtaacttcagggttaacatttgtaagcattgccaaactcttccactgtggctgtgctgtttcacatcccaatcagcagtgttagagggttccaatttctccacctcctccacaacccttgtcattgtctttttaattctagccccaagtggcatctcattgtggttttcatttgtacttctctaatgacttaacgattgtgtcttttcatgtgcttattggccattggtatttaagaactattt

SEQ ID NO: 63264 - DNA, 347 bp, Homo sapiens
ttcctgttttctgccaccctaaactcaacatatacttgtgttaggccacattgtgcctggggagtcaaccatacagaacattcttataaaaacgtcttccctgcactgatgggtttaatctggaatatgttgcattcactgtcatggctggattctctgtttattattataagcataatgatagtatttgggtattgtatttattttggcttttgaccttttttctgcttgtttaagataatcatatttttttgtttgccttttaattttataatctttttgaatggccaatttgtaaatattttgtaactatgtttactgtgttatttcttccatagtttatattt

SEQ ID NO: 63265 - DNA, 109 bp, Homo sapiens
tttcactacagaaaggacattattgggataactagtaagtttgaatggagtgtgagtggtaccgctgtctatgctaatttcactattttgatacataggtagaatgcac

SEQ ID NO: 63266 - DNA, 473 bp, Homo sapiens
cttatacctagtttacatatgaaaaaattgagacttagatattaactttctcatggtacacagattaataagtaccaacacagaattaaaccaagggccatctgactctaaagcctaggtttgtgttcttagtcaacacaagtggctaaagtattgtataaccctccagaacctatcaatgtatagtgggaaaacaaaaacaacaacaaaaaaaaccttagagcaggagttggaggctctaggtttaagtcctgactttaccagatctagtcttgtaaacttggataaaatttttaatggttctaagcctcagctgccttatctgtcaaactgatataatatccaagagtaaagcaataattagtaagtttatgtacggggaaagtactttataaattctaaaatatacaatcaatcaggcacagtggctcatgctaatcccagcactttggaaggctaagacgggaggattg

SEQ ID NO: 63267 - DNA, 1148 bp, Homo sapiens
acctttatctttcagggaagaggttggttgcacgttgttaggccaagagactggccctccattatgccctatgctggacttgctttgtcggtccattcattgatgtcctgttgaatcaaaaggtattgttttagtagaagttacatgaagtatattcatttatcacttgctaaacataggccttgctctgtttaataaataatgggtgtctctttcaagattttaggataggcctttttaacagagcagaatcttctgttaaagttctcacaaacagaccaactcccaagagagatgggctggtgggtcactgacataaagcagtccacaagatctattttagaaaagtatcaatgacatttccttagttggtttgattctcttgagaatacatgagtttaaaagaactgaggtcaaattgctttatgtggaaagcaataaaaacaagtatttttgacttgcaaattagaggtaactgtaagcaatttttgctattgaagcctatggcccaaattattccacctgcaaaataactttcacccttgcaaggctgatagacggctcttcattggtctttttttatggttttgttttgtttttttaagtcattggtcttaaatctgtatggtgacaaatctatttgagtttgattgagactttcttggactcctttggacaagaggtcagagcacaaaggctagtcaccacttctttgacttcttgaggtatgagccaaaattttacttttccattgatttaaagcagaatttttggagatgctgtgttctagttcctgacggaatcggtggtggttgctgactttgacactttggagagtgatgtggggagttatatagaaggggaaacactagtttaggtgtgaggagttctagtatgccacaaattagctgagactttagacgaagcacaatatttgagcatcaatcttctcatctatgagatagacctgtcaggattattgtgaaaattagatgagataagttgaaagtacagtgcttggtaaacagttagcactcaaatattagttctttttcactttaattaagagcagactttgaatggtctgatgccaagtgtagatccttaagagacaaaacaaagaaactttcctggcttcaaagaaaaga

SEQ ID NO: 63268 - DNA, 644 bp, Homo sapiens
ccttcgttgcttggtgactttcacgactcttttgaagcccagttaagttcctcagtttcggtttgggtgatgtttcttcatggttatattcaggttaggcatggttggcagggatttcatgaaaggggtgctatgttcttttcatggtatcctatcaggtggcaccaaacctggtgatgttcactttcatcatttgatgaaggtaattgacatgatgtatcctggacctcatcaaacttttaatttgctcatgtatttttatttttattggtatagacttcaatttcatattttattcaatgggttataatccatcactatcatgatttatttctatccttaagttgttccacacctggcccatgggagcccttatgagcaagtttccaggtccttatgacacaattccatcattctttgggtacatccttactttctggcacagtagagatgttccagacttatcttatatttttcctcccccatccctggaatcaatcacttctccgaggatgcttgattccttttagtgaagaacagtctttggaaaccaaccgtctagggacattaagtatgcttgttgctattggagtgtcattgctcctggaccttctcagtggacacagctaggaaatgtatgtgtt

SEQ ID NO: 63269 - DNA, 336 bp, Homo sapiens
gtcttcctcactgcccctgtccaggaatatcgtaattactactgagaagcccccggtaactctgtatgtcatgggcacccaaattcattttctttttgatacaagggcagattactctgttcttactgcttatacaggaaaactttcttcccggtccatgagtgttatgggaatggaaagaaagccataaaaaagattgtttactcctcctttgatttgtcaatttgagaaacaaatcttccaacaggaatttctagtagtaccaagatgcccagtccccccgttgggaagagatactatggttaaaataggggcactactacaatttaagcatca

SEQ ID NO: 63270 - DNA, 783 bp, Homo sapiens
  misc_feature (12)..(12): n is a, c, g, or t
  misc_feature (18)..(18): n is a, c, g, or t
  misc_feature (47)..(47): n is a, c, g, or t
  misc_feature (59)..(59): n is a, c, g, or t
attcggcacganggactngaagggattaagaagaactcttaggagcnccttggcctaanggctgtgtgggacgtgcctgctttgccttcgccttccaccatgatcgtaagttttctgagaccccctcagccatgtttcctgtagagcctgtggagttgtgagataaggatattgtaattatacaagagatgtccttcatctaggagatggctgctgaagtattgaagggtaaagtgtcctgtgcttataactggctttcaaacagacaaacaaaaaaagctggtccaaaatggcagtggcaatggatgtggataccccaagaagtaccaacagcagtgctttgaagtaaaaaagtgaaatgcagtagctagccctctgggcttgggatgttgtggttaataactgtgccatctgcaggaatcacagcatggatctgcattgaatgtcaagctaaccaagagtctgccacttcagaagtgtgtaccgttgcacggggagcctgtaaccgtgcttttcacttcactgtctctctcactggctcaaaacacaacagctgtgcctgttggacaacagacaataggaattcccaaagtatggacaccagaaaaagaattcttccatcaagcttaactgttttgtgattcatttaatgacttgcccttctgtcacttaattataaattagatagaactgtgtcttttctgctttgtctttgccatttgctgttctcgcagccacattgtattctgtgtcaaataaagtccagttggattctagagcgaa

SEQ ID NO: 63271 - DNA, 492 bp, Homo sapiens
gataatatctctcctctatgtagctcttaactggtttataaaaccttctcatgtcattgtttcacctaattcttcaaacagtcgcatagggcaggcaggtggtatatttttatccaattttcagataaagaaagaatatgagacatcagaagggtcagtgatttgcccaaggtcacacagcaataagtgcaaaaactaaatttaaatatttggagggccctgttggttgtacatggcacactgtaaaatgaatataaagctcgtgtctcttctagttaattcatttcaaaagtctttgtttatcctattgtcaataataacaatcctcagaagaggcaaattctgaaatttaatttatggattaatctagggttccagggaatgtgtgaacagaacaggacaaggttcttcaattttcactttaatcacagccataataattgtagtaaaatatatttgcaaagaagtttataatttgcttctattacaaaa

SEQ ID NO: 63272 - DNA, 336 bp, Homo sapiens
gaactaactgtccctctcaggtactaagctgttcccagtgctcacctctatgcaaaatcacccagtttcatctccattttgtgacccagggattagttcatggtttctaatttgtcactgagacacaccattatccacccagcagatactttcttctgcaaagggagcaaggaattgctaaccactatcctgctcctgttcaagcatttggattgggggaaagacagtgtacctcatcagaggagtctgagctctcagccccagagaatgaattgatggaagccaaccatggaaagtacattcttcttaccgtgacaggtgtaggtaaaagtacgg

SEQ ID NO: 63273 - DNA, 170 bp, Homo sapiens
ttttaagacagaatcagccgggctgttaatcccacctcagcctcccagagtgctgagatttgagattacaggggtgagccgctgcacccagctcccttgactatctctgcaacttctctgtaaatctaaaatgattccaaataaaaagtttattaaacacagatattata

SEQ ID NO: 63274 - DNA, 781 bp, Homo sapiens
cctttttctgcagtaaagaaaatgaaatatcctttattttccaaatgtatgaagcacaaatgcaatatagttatttaaaatataaaatactttaaaatgaatgtgaagaatgggaaaatatatttttgcatgaaaacagactacttacaaatgtgcttaatatctcaggaaaaaaagaatgaataaccgtatataaaattggtaaactataaattggctgtatttccttgccggttttaattttaaggaagcatttacatgaaaagaaaaaaggatcctagtagtctgaatttcctctcaagtatgctagaaaatactttctatgaatttacaattaactgcaataagaagtgggttagcattcaagtaaggtcaataccccaaatgagaaactcttcagttagaacacattagtggttgtaacacagaggcagtagataaatatttgaaatgtgagcatttctaaacttggtaccaaatggaaagggtttcatgaggtgacagtggcttttaaacattcatttgaccgattattctaattttccttgttaaatcattgcaacagttgcatgggggagaatggatattttttgaagaattgcttattccactttcaatttttaaaaatcgaggggattaaaatattactttttaaatatgcataaaagtatcttaactgtaattacattttcagttgctttgttatagtagcatgcatattaaatataaaatgcatttatgaaaatttttgtaaaaaataaaagatttttcatttctcaaa

SEQ ID NO: 63275 - DNA, 1035 bp, Homo sapiens
  misc_feature (1022)..(1022): n is a, c, g, or t
cctttttctgcagtaaagaaaatgaaatatcctttattttccaaatgtatgaagcacaaatgcaatatagttatttaaaatataaaatactttaaaatgaatgtgaagaatgggaaaatatatttttgcatgaaaacagactacttacaaatgtgcttaatatctcaggaaaaaaagaatgaataaccgtatataaaattggtaaactataaattggctgtatttccttgccggttttaattttaaggaagcatttacatgaaaagaaaaaaggatcctagtagtctgaatttcctctcaagtatgctagaaaatactttctatgaatttacaattaactgcaataagaagtgggttagcattcaagtaaggtcaataccccaaatgagaaactcttcagttagaacacattagtggttgtaacacagaggcagtagataaatatttgaaatgtgagcatttctaaacttggtaccaaatggaaagggtttcatgaggtgacagtggcttttaaacattcatttgaccgattattctaattttccttgttaaatcattgcaacagttgcatgggggagaatggatattttttgaagaattgcttattccactttcaatttttaaaaatcgaggggattaaaatattactttttaaatatgcataaaagtatcttaactgtaattacattttcagttgctttgttatagtagcatgcatattaaatataaaatgcatttatgaaaatttttgtaaaaaataaaagatttttcatttctcaaaaaaaaaaaaaaaaaatcgagactagttctctcgtgccgaattcggcacgagggagttcaagcgagcctctcacctaaacctcatctccacttaaaatacaaaaattagccaggcatggtggtgcgcgcctgtaatcccagctattagggaggctgaagcgggagaatcacttgagcctgggaggcaaaggttgcagtgagccaagactgcaccactacattccacctgggcaacacaacanagactctgtcttt

SEQ ID NO: 63276 - DNA, 372 bp, Homo sapiens
cccttgaatgattgggaatttgggttctttctaagcacagccttcactccctgcctgaaccacagcaacctgtggctgtttctcctgctaccaaaattgcaggagccctgtgctcctgctggcttccctagcatggcctctaaacaaaacaaaaaaaaaaattggggctgccttttttccagtcaccttccagaggagtcagggagattgcctgatgccccatggggtttgagaggctaaaaacctaaataagaacaaaagaagacttgacatctataggccagtgtgtcctctcccagtcttgctggggactgtagcctttctcatatgagtgggatggtctagaaagaatatttgcatcagaagcccatt

SEQ ID NO: 63277 - DNA, 387 bp, Homo sapiens
gtaatccccagctacttgggaggctgaggcatgagaatttcttgaacccgggaggcggaggttgcagtgagcagagatcacgccactgcactccagcctgggcaacagagcgagaccctgtctcaaaaacaacaaaataaatttccttttaacatctgttccaaaaatgagataagcgttatcagggcaagtccatcctcatcactctttccctccccactgccctctccacgatgcccagctgatcaaaagtcatttttactcataagaccaaagtatcatgggatactgtgcagttggagagcaggttgaacatcagaaataattgctgacaataaagtaaaagatgggagaaaaagcaagaccaattgtatataatacagcttc

SEQ ID NO: 63278 - DNA, 425 bp, Homo sapiens
agaatatctcgtatgaaagtgtgagtgtaccagtcaataactgatgttttacattcttgttaaatatgtaaggggaaagaacagattgggtgaaaggcaacttattgaatctatttccagaagtataaataaatgcatactttaaagatgtacctgaagtaaattattgaaaatgagcacacttttttggtttttgttattttattttctttgaaagatgtagtaagtacagtgtagtgattgaaaactactggactctggagcctggatttcaaattctggttccaccacttactagtcaggtgaacttcagtaagttgctttaacttcttggtccctcagtttccttacccacggaagtaggaggtaataattatgtgtacctggctcatctagctgttatgatataactaaataagttagta

SEQ ID NO: 63279 - DNA, 503 bp, Homo sapiens
ctctcaaccaggggcagttgtcccctccggggaacacttgctaatgtctggacacagttttggttgtcacgactaggctggtgatgctggagccacaacaaccaccggaaaccccaaggcgaagaccagagaatcccagagatgcagacagagacttcctagagctacagagtaagccaaattggagttgccttttctggacgtcttgttaagtctgatggggttcatcacatctgagccaggactggcttttcttggctgcaagctgaaagttgggtccaggtctgctgtactgagggtctcctatcttccttggacagggacaaccagaggcctatttatctcatgatggaaggcaggagaacaagcaggcaagaccagctgtgctagcacatgccacctctttgcccacgtcacacctgctgacgtcccattggccaatgcaagtcacacaaccaaagccaacatcaacaggacaaggaaacagactctgcctctagatg

SEQ ID NO: 63280 - DNA, 441 bp, Homo sapiens
ttcaaaataatacttctgaagttaatctgttctggtcagtgattcaaaggcagttgattttaatggacagccatgtacaatttataattagtacactgtctataaaatatttgcttctatttgaaatagcattttatatttatatttactatattccatataatcttacagaatttgttcgtaaaattacatttcatcaataatacaaagcttttgcctatccttgctatcaggtgcctgaattagtacacatacacacacacacttgcctaaaaggtgaactttcttgtcaagtaaaataaactactgccttctctaagacattctttcacaaactccaaaattcaggtctcagcatagtggttctcaaaatgtggatcttcaccaacagcatcagcacgacctgagagcctattaaaaaatgttgacctactgaatgag

SEQ ID NO: 63281 - DNA, 363 bp, Homo sapiens
ttcaaaataatacttctgaagttaatctgttctggtcagtgattcaaaggcagttgattttaatggacagccatgtacaatttataattagtacactgtctataaaatatttgcttctatttgaaatagcattttatatttatatttactatattccatataatcttacagaatttgttcgtaaaattacatttcatcaataatacaaagcttttgcctatccttgctatcaggtgcctgaattagtcaagcctgccatttacgtgaggctgcccctaaactattccatagctacaaaaccaccacatttcgttgattctttctttctttcttttctttctttctttccttccttcctggtgt

SEQ ID NO: 63282 - DNA, 859 bp, Homo sapiens
ctgtgtagtcaagagtaaccaccagatgggaagagaatacagatcagcttgtgcaataaagaaaggaaaactccaaaggagattatttccatagactcatcaacttctaagcaaggaatctcaaaaagacaatctaccagagaagtgacttggaccaaagagtaaacgaacaaaattaatgatgtggacagccctaggaatcagcttagaggttcagcctggcccctggtcggcacattctacgagctcgtggaaaagggcaagcacagactatttacagccgcagagaaatggcctcataaaaatgcataaggaatgatggaggatatttgccatctcatttttgaagcctgattcaccgtggcccttggggcttggtccttcctaatgacatctggtctactgccctttgtgctgatgagaacacgaagccccagaggaggggagtcagttcataaagccctctcagctactgtggaaaatcgaagcccagctcactaatttcctacctagagaaagagtaaagacagctttggagaaagacagacctggattcaaatgcagatctcttccttactagatgggcatgcttgggtgaagtgaagtgggtgtgcctgggatcacacacagctgtgcaataccaagtgacatgggacttatacaaaggcagcgccactagtcatgctggaagtttccccaagaagcagggaaaattcatgacgtgatatataagaaaaagttgaattgcttgatatggaccattgattgaggtctgcagctgcagttgctgccatcttagaccgactgttcatcttgtaaacttacagaatcaataaatacggtacagtactcgaaaaaa

SEQ ID NO: 63283 - DNA, 516 bp, Homo sapiens
  misc_feature (15)..(16): n is a, c, g, or t
  misc_feature (18)..(19): n is a, c, g, or t
  misc_feature (26)..(26): n is a, c, g, or t
  misc_feature (51)..(51): n is a, c, g, or t
  misc_feature (53)..(53): n is a, c, g, or t
  misc_feature (67)..(67): n is a, c, g, or t
  misc_feature (82)..(82): n is a, c, g, or t
  misc_feature (92)..(92): n is a, c, g, or t
  misc_feature (121)..(121): n is a, c, g, or t
  misc_feature (150)..(150): n is a, c, g, or t
aggggttattccccnncnnaggcccnccaatagaccaaggcaagccctcangngtaccatgccaagnttaatttacagatgnaggagcaaancccctggcccatacatcagtctggaaggntagaaggttgaaaatcaaggtgttggcanaagccatgtttcctctgaaggctgtagtgtggtggaaaagaaagagagagctgaggcagccgatgtaagatctgctgttacttcttgctgtgtgaccttgggtgaagtgaagtgggtgtgcctgggatcacacacagctgtgcaataccaagtgacatgggacttatacaaaggcagcgccactagtcatgctggaagtttccccaagaagcagggaaaattcatgacgtgatatataagaaaaagttgaattgcttgatatggaccattgattgaggtctgcagctgcagttgctgccatcttagaccgactgttcatcttgtaaacttacagaatcaataaatacggtacagtactcgaaaaaa

SEQ ID NO: 63284 - DNA, 234 bp, Homo sapiens
ttggattccatgcttctcagaccgtgctatcttggaatcctcacagttctgaggggcccctataattagaggccaccatagtggaggagttgaaaccaagcagacaccctactaaaccagagttgttgtcttgttttgcacattaaaactgtgtacaagctttgttttgaaaaaaaaagttgttatgcctgaaaaagaattgaaaactaccaacttaagtaaattaatgtacag

SEQ ID NO: 63285 - DNA, 576 bp, Homo sapiens
agcatgagcccagccagatttatagtctttgtactaaaacttatatataaccagtgatgaggcagtagtaagagaagttccaactgctgttagtgcccataaagctttatgagaggatacttttcttctatttttatagattttttaaaacattctgatgagaacaaatcctaccaatttataaatcaaggtaatgagaagttttattaagaattattgaacagctacattgtagtgtacattttcttttcaaatcatataactatggtgcatttaaagattttcttcttcagaaaagagagaagaatcaaatagacgcaataaaaaatgataaaggggatatcaccaccaatcccacagaaatacaaactaccatcagagaatactacaaacgcctctacgcaaagaatgacattttgttcagaaaacacagatgacctactacttcgcccaacccaggaaaaaatcttcgtgaaatgtgaaataaagtctaaaacatcaaagcgaaagatcagatgagatttaatgaagacccagtgtaaagaataaatgaatcttactccttaaatggaatgg

SEQ ID NO: 63286 - DNA, 1012 bp, Homo sapiens
ggtctctttggcttcagaaattaccaagaaagcctggaccccgggtgaaacggagaaatggacacaagtcccctgtgtttctccattctgttggttttatgcatctttatccaatcaagtgcccttggacaaagcctgaaaccagagcgtgggcatcaaacagcccataggacactatgacttctatcccaacgggggctccttccagcctggctgccacttcctagagctctacagacatattgcccagcacggcttcaatgccatcacccagaccataaaatgctcccacgagcgatcggtgcaccttttcatcgactccttgctgcacgccggcacgcagagcatggcctacccgtgtggtgacatgaacagcttcagccagggcctgtgcctgagctgcaagaagggccgctgcaacacgctgggctaccacgtccgccaggagccgcggagcaagagcaagaggctcttcctcgtaacgcgagcccagtcccccttcaaagtttatcattaccagttaaagatccagttcatcaaccaaactgagacgccaatacaaacaacttttaccatgtcactactcggaacaaaagagaaaatgcagaaaattcccatcactctgggcaaaggaattgctagtaataaaacgtattcctttcttatcacgctggatgtggatatcggcgagctgatcatgatcaagttcaagtgggaaaacagtgcagtgtgggccaatgtctgggacacggtccagaccatcatcccatggagcacagggccgcgccactcaggcctcgttctgaagacgatcagagtcaaagcaggagaaacccagcaaagaatgacattttgttcagaaaacacagatgacctactacttcgcccaacccaggaaaaaatcttcgtgaaatgtgaaataaagtctaaaacatcaaagcgaaagatcagatgagatttaatgaagacccagtgtaaagaataaatgaatcttactccttaaatggaatgg

SEQ ID NO: 63287 - DNA, 1614 bp, Homo sapiens
ggtctctttggcttcagaaattaccaagaaagcctggaccccgggtgaaacggagaaatggacacaagtcccctgtgtttctccattctgttggttttatgcatctttatccaatcaagtgcccttggacaaagcctgaaaccagagccatttggaagaagagctcaagctgttgaaacaaacaaaacgctgcatgagatgaagaccagattcctgctctttggagaaaccaatcagggctgtcagattcgaatcaatcatccggacacgttacaggagtgcggcttcaactcctccctgcctctggtgatgataatccacgggtggtcggtggacggcgtgctagaaaactggatctggcagatggtggccgcgctgaagtctcagccggcccagccagtgaacgtggggctggtggactggatcaccctggcccacgaccactacaccatcgccgtccgcaacacccgccttgtgggcaaggaggtcgcggctcttctccggtggctggaggaatctgttcaactctctcgaagccatgttcacctaattgggtacagcctgggtgcacacgtgtcaggatttgccggcagttccatcggtggaacgcacaagattgggagaatcacagggctggatgccgcgggacctttgtttgagggaagtgcccccagcaatcgtctttctccagatgatgccagttttgtggatgccattcatacctttacccgggagcacatgggcctgagcgtgggcatcaaacagcccataggacactatgacttctatcccaacgggggctccttccagcctggctgccacttcctagagctctacagacatattgcccagcacggcttcaatgccatcacccagaccataaaatgctcccacgagcgatcggtgcaccttttcatcgactccttgctgcacgccggcacgcagagcatggcctacccgtgtggtgacatgaacagcttcagccagggcctgtgcctgagctgcaagaagggccgctgcaacacgctgggctaccacgtccgccaggagccgcggagcaagagcaagaggctcttcctcgtaacgcgagcccagtcccccttcaaagtttatcattaccagttaaagatccagttcatcaaccaaactgagacgccaatacaaacaacttttaccatgtcactactcggaacaaaagagaaaatgcagaaaattcccatcactctgggcaaaggaattgctagtaataaaacgtattcctttcttatcacgctggatgtggatatcggcgagctgatcatgatcaagttcaagtgggaaaacagtgcagtgtgggccaatgtctgggacacggtccagaccatcatcccatggagcacagggccgcgccactcaggcctcgttctgaagacgatcagagtcaaagcaggagaaacccagcaaagaatgacattttgttcagaaaacacagatgacctactacttcgcccaacccaggaaaaaatcttcgtgaaatgtgaaataaagtctaaaacatcaaagcgaaagatcagatgagatttaatgaagacccagtgtaaagaataaatgaatcttactccttaaatggaatgg

SEQ ID NO: 63288 - DNA, 317 bp, Homo sapiens
ttctcccctcccccgtcggagtcagtccctctcttcaaccgcccccaccccctagtactggtctcagcttctccagcgggcctcagccccgtccacccccaaccccgacgcccctttctccgcgccagttctggcccttctcccatatttataagtgtccggccgggacgggcggtgggcgcggcgtccccggcgcgtatcgtaggcagtgtaccgtggccgtgccgtcagagtgtgcgtgtgcgtgtgtgccgtgtcgaggctgtgtagagtgcattgtacagcatattttcatgaataaaattgttttaaatatt

SEQ ID NO: 63289 - DNA, 263 bp, Homo sapiens
cactgtatttgatggcagtgtactaagaagcaattctccaggaaaccaggaatctcaatctaagagtggttccttgagccctcaaaaagtattaaaaatgaaaatttatactgaaaacatgaaatctcaaataaatgaaggtaaagatttttgtggaaataaaattgttgagaacaaaatattactgcaccttgaaaatcctagcacattaccacaggataaagctttagagacattactccaaccctgtaaagattgtcaaa

SEQ ID NO: 63290 - DNA, 844 bp, Homo sapiens
tgagttcctaggtggggagacaggggtgcagctcagatttaaatcaggatagcagcactttcgtgaaaagcctaggcacacagactcccttcatcagggagctgttggtgtggagcttccttttcctgtttcgtgtccttcccaaagtcccactgctattcttgcttttggagtgtgagtgctgcctgtgagaagacttcttctctgcccagctggcccctgcagactgcctccagccctaaggggagcatgaactgcctcatttgcccaagtcagaagggaagcggggaagcagggagaaagcacatggtttctctctgctggggccttaagtccatgagggagtttcccattttacatttttcctctgccctgcccatactcctcttcctcagaactgaacatgttttaaatagaatcccccaacctgagttcttctgcacttctctgtctgataagggccaaggtccagcatttttaccctggctcaaattctgatgccatccaatgatttgcttacagactaaatttttcccccatttttgactcccccacacccgtttgtgcttccattagagataaaggatttcaaaacatttctgtgaaataaactgaaactgaaacatggcttccctcttctcttcccctccctttgtatgtttcactggccggctctgagcgtccaggtaactggggaaggaggaagtcactgttgcctcaaatgttccagccgagaagtagcagctttgccatatgctgggtgactttgtctcaggacagtgtggggccaaagtgtttattctgcaccagcagctagcagactcaagggaaaagtgcaatgctg

SEQ ID NO: 63291 - DNA, 536 bp, Homo sapiens
agcctgtttaccatattgtgagtaatatcatctccccctctggagacctctggagattatgaactgtttcacagacgggtgtacaccctcagtgtacagagggcgtacacccatctgtattgggagtaatatcatcctcttcctccctgaatattaagaacagtatcacaggggtgtttctactccctgcgatatcgcgtgtcatatcctcctctcccacgttgcaattagaaacaatatcagtgggggcgtgtccaccttctgtcatattgaaagtaatatcattttcttccctccaggaccgtgggaacaatatctcaggggggtttccactttctgccatatatgtagtcacatcacccactccgccctggaatattattaaggaccatctaacacgagggtgtatacgtcctgcgatattacgagtaatatcaacttcttggcttctgaatatgaggaagaatatcacagggtgggtgtacacctcgtgctctattatgcggagtcgtatctgtctattatggggagtaata

SEQ ID NO: 63292 - DNA, 175 bp, Homo sapiens
aagaaaaagatattaagatgggcaagtcctggtggcaagacaagcagatgacattacagacaatggacatcaaactgctgccaagctaatttagattgtaaaaacagctccatagtcaataacatgagtgatcttaaatatgcacaattaagctacttctcctttaatactatct

SEQ ID NO: 63293 - DNA, 197 bp, Homo sapiens
tctgaaagacatatcttaaaagagactgatatggcaaattacacagggaagttgggggatctgggagcgtatttgtgcgatactggtgggggacagctatgctctctactgtaagtgggatgtcaacatgtaagaagtagtaatataatactgttatctagcgacatggaagtaaacaccaaaagaatcattcaaaa

SEQ ID NO: 63294 - DNA, 484 bp, Homo sapiens
gattgcttaagtgtatcttgaaatatgcagagttgacttatttttatgatttaattgggttaattcagtatgtttatcacctctcacattatttactatttacttcttaccttgttaccttgtttgtaattgtcttatcaattgtattgataggtcctcttgtacactagaagtagaactcaactccaagcaataagaatacttttagtgggccgggcgcagtggctcacgcctgtaatcccagggtgctggaattgcagacatgagccactgcacccagcctttatgttaaaccttgaatatacatcatctcatgggatagatgccattattattacacacatgcccattttataaatgaggaaaccgagatgcagagaggccaagaaactggcccaacgtcatgcaattagggagtggtgagaccaggatttaacctaggtaatttggttcagagctttaccactgtgctttattgcttcat

SEQ ID NO: 63295 - DNA, 386 bp, Homo sapiens
cacgaggtggcgctataatctattactcaatttataaatgcttcgtggattgcttgctgactattctctttttgttcctgttttacttgcttactttttaaaaatttatttttttaattgaaaaataaaaattgcatctatttattgcatacaacatgttactttgaaatatgcatactctgtggaatgcctaaattgagctaattaacgtatgcattacctcacacactttttatcttttgtgtggtgagaacatttaaaatctactctctaggcaaatttgcaaaaatacaatacaatacaatacattgttattaactgtagtcataatattgtgcaatggatctgtagaactaattcctgccatctaactgaaattttgtact

SEQ ID NO: 63296 - DNA, 583 bp, Homo sapiens
ttccaaacataactcagccagacccctctggtctctaaatagtatctcttctctttgtctttttctgtttcaggcctccagttaccaactcctgtctggtttcatgtccttttctatctggcagtgggaataatgtttttagtgaacactgttctctgggtgacaatacgtaaagaactgaaaagaaagaaaaagtggaatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagttggtggccatcgatctggaccgtcccctgcccacttgctccccatgagcactgcgtacaaacatccaaaagttcaacaacaccagaactgtgtgtctcatggtatataactcttaaagcaaataaatgaactgacttcaactgggatacatttggaaatgtggtcatcaaagatgacttgaaatgaggcctactctaaagaattcttgaaaaactta

SEQ ID NO: 63297 - DNA, 1127 bp, Homo sapiens
cggctggtacggccggaattagggatttcactactcccaccagcttggagacaacatgtggttcttgacaactctgctcctttgggttccagttgatgggcaagtggacaccacaaaggcagtgatcactttgcagcctccatgggtcagcgtgttccaagaggaaaccgtaaccttgcactgtgaggtgctccatctgcctgggagcagctccacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggctggctactactgcaggtctccagcagagtcttcatggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatcacaatacactgtgaaaggcctccagttaccaactcctgtctggtttcatgtccttttctatctggcagtgggaataatgtttttagtgaacactgttctctgggtgacaatacgtaaagaactgaaaagaaagaaaaagtggaatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagttggtggccatcgatctggaccgtcccctgcccacttgctccccatgagcactgcgtacaaacatccaaaagttcaacaacaccagaactgtgtgtctcatggtatataactcttaaagcaaataaatgaactgacttcaactgggatacatttggaaatgtggtcatcaaagatgacttgaaatgaggcctactctaaagaattcttgaaaaactta

SEQ ID NO: 63298 - DNA, 861 bp, Homo sapiens
cggctggtacggccggaattagggatttcactactcccaccagcttggagacaacatgtggttcttgacaactctgctcctttgggttccagttgagctggctactactgcaggtctccagcagagtcttcatggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatcacaatacactgtgaaaggcctccagttaccaactcctgtctggtttcatgtccttttctatctggcagtgggaataatgtttttagtgaacactgttctctgggtgacaatacgtaaagaactgaaaagaaagaaaaagtggaatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagttggtggccatcgatctggaccgtcccctgcccacttgctccccatgagcactgcgtacaaacatccaaaagttcaacaacaccagaactgtgtgtctcatggtatataactcttaaagcaaataaatgaactgacttcaactgggatacatttggaaatgtggtcatcaaagatgacttgaaatgaggcctactctaaagaattcttgaaaaactta

SEQ ID NO: 63299 - DNA, 1475 bp, Homo sapiens
cggctggtacggccggaattagggatttcactactcccaccagcttggagacaacatgtggttcttgacaactctgctcctttgggttccagttgatgggcaagtggacaccacaaaggcagtgatcactttgcagcctccatgggtcagcgtgttccaagaggaaaccgtaaccttgcactgtgaggtgctccatctgcctgggagcagctccacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggctggctactactgcaggtctccagcagagtcttcatggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatcacaatacactgtgaaagagctatttccagctccagtgctgaatgcatctgtgacatccccactcctggaggggaatctggtcaccctgagctgtgaaacaaagttgctcttgcagaggcctggtttgtagctttacttctccttctacatgggcagcaagaccctgcgaggcaggaacacatcctctgaataccaaatactaactgctagaagagaagactctgggttatactggtgcgaggctgccacagaggatggaaatgtccttaagcacagccctgagttggagcttcaagtgcttggtgagaatgacgggaagccactggcacagaagaagggactcccttatctcccatgggactgaggcctccagttaccaactcctgtctggtttcatgtccttttctatctggcagtgggaataatgtttttagtgaacactgttctctgggtgacaatacgtaaagaactgaaaagaaagaaaaagtggaatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagttggtggccatcgatctggaccgtcccctgcccacttgctccccatgagcactgcgtacaaacatccaaaagttcaacaacaccagaactgtgtgtctcatggtatataactcttaaagcaaataaatgaactgacttcaactgggatacatttggaaatgtggtcatcaaagatgacttgaaatgaggcctactctaaagaattcttgaaaaactta

SEQ ID NO: 63300 - DNA, 1026 bp, Homo sapiens
ctgatctcttgcagttccagttgatgggcaagtggcctccatgggtcagcgtgttccaagaggaaaccgtaaccttgcactgtgaggtgctccatctgcctgggagcagctccacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggctggctactactgcaggtctccagcagagtcttcatggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatcacaatacactgtgaaaggcctccagttaccaactcctgtctggtttcatgtccttttctatctggcagtgggaataatgtttttagtgaacactgttctctgggtgacaatacgtaaagaactgaaaagaaagaaaaagtggaatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagttggtggccatcgatctggaccgtcccctgcccacttgctccccatgagcactgcgtacaaacatccaaaagttcaacaacaccagaactgtgtgtctcatggtatataactcttaaagcaaataaatgaactgacttcaactgggatacatttggaaatgtggtcatcaaagatgacttgaaatgaggcctactctaaagaattcttgaaaaactta

SEQ ID NO: 63301 - DNA, 1412 bp, Homo sapiens
cggctggtacggccggaattagggatttcactactcccaccagcttggagacaacatgtggttcttgacaactctgctcctttgggttccagttgatgggcaagtggacaccacaaaggcagtgatcactttgcagcctccatgggtcagcgtgttccaagaggaaaccgtaaccttgcactgtgaggtgctccatctgcctgggagcagctccacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggctggctactactgcaggtctccagcagagtcttcatggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatcacaatacactgtgaaagagctatttccagctccagtgctgaatgcatctgtgacatccccactcctggaggggaatctggtcaccctgagctgtgaaacaaagttgctcttgcagaggcctggtttgtagctttacttctccttctacatgggcagcaagaccctgcgaggcaggaacacatcctctgaataccaaatactaactgctagaagagaagactctgggttatactggtgcgaggctgccacagaggatggaaatgtccttaagcacagccctgagttggagcttcaagtgcttggcctccagttaccaactcctgtctggtttcatgtccttttctatctggcagtgggaataatgtttttagtgaacactgttctctgggtgacaatacgtaaagaactgaaaagaaagaaaaagtggaatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagttggtggccatcgatctggaccgtcccctgcccacttgctccccatgagcactgcgtacaaacatccaaaagttcaacaacaccagaactgtgtgtctcatggtatataactcttaaagcaaataaatgaactgacttcaactgggatacatttggaaatgtggtcatcaaagatgacttgaaatgaggcctactctaaagaattcttgaaaaactta

SEQ ID NO: 63302 - DNA, 373 bp, Homo sapiens
ctaagcactgcggacacaaatattgctaaaccgtgtcatgaacattggccctgcctgtgaacttagtactaggtggcacagatcatagcgtggaaggtgcctgatagaatgcatgtgcacagccacacgggaggtctctttcactttggtgttcttgcagagtttgttgtaaagagaatttccaagtgaggaatttccctctctggtattccattgtcaaacttgagattacacataggccccagttgtaataaaatccaacttaattatccaacatcttgtggtctaagattcaggtgttgaagaaaatgtggcaatttaataatactcacggtactcttccacattaaaatgaatttttttttcagaatta

SEQ ID NO: 63303 - DNA, 162 bp, Homo sapiens
agctgagaatccttgagcttaccatttgatatttctatattaatttaaagaaaagtcaaaagattttgaaaacagcaatagaagtaagatcctttaagctctattcagcagcccctaagaaaagtgatgaggacactgtgcatgcccatatgtgaacatggt

SEQ ID NO: 63304 - DNA, 297 bp, Homo sapiens
aaaatctgacaagtgtgttgacaacggtgattttaaaggtcctaaaagattctccagatatcagagccattttcacatagtagaagggcacattccctgcagtggcctgtgtcatacacagccaatttaaccttttcactgcctggttattctgcaaagtgcatcctagaatgcccttcccctctgagctcctctacaaaattctgattctttctcaaactgtaaagcctctggcatttgccaagagccaaggccctcctgaagccatagtttgagaacaagccaagaggcagacat

SEQ ID NO: 63305 - DNA, 601 bp, Homo sapiens
gtagaaggggagacttggtctcatgtgtgagttttagtttaagagtttgccctgccaccttcctgccatggctgtttccaaacagctgagtgagccaaggtcacaagggcttggcctgatgttgattttgttttgtttgttttactgtcactggtttttatattttcatggtagaacaggtttgccctagcctgttttacttagttcggaaaaaaaaattcttgcttcctttcccgagccttgctgctgcatagtttattgctgggtcaggttcttcgtgcatttggtttgatgtttggcaacccccagaagtgtgtcactgggttgctaactgacacttttaaatcctttagcttcaacactttcccagcccaaccaaaaggttcacagtggattccttattatctttattctgcattgcctttcagtaaagggaattgctttgcacacttgatttggtgatactaaaagatagtggccggctgggtgtggtggctcatgcctgtaatcccagcactttgggaggctaagacaggtggatcacctgaggtcaggagttcgagaccagcctgaccaacatggtgaaaccctgtctctacta

SEQ ID NO: 63306 - DNA, 1038 bp, Homo sapiens
cttcgtgctccaccctgcactgggtacacacaggtggaggcaaggcccccaggcatgctgcttataaggtatctgtatgcgtccttcaattatctgtacaaatttcacattcactccatatttttctacatgtttcttccatgttgacagttggaagaccttcaagcagcccctggtggctgtttttaggtcttcagctgcagttaggctgttccacgcatgagatcgtgaaagagatcatttctcgctcggtctaacagcagggccctgtggtcagtcttcctatcagactttctgaagggttgggaataacagaagggtatttttaacacatgagagaaaactgccatctgaatgctaaacatatttgtccccaacaccccagagtaacaaatgaaaagaattacatgagttgcttgtggacacgtcccagctcctttttttatcttgctctcctgtcttgagggttcttctccaagtgacactccttcctcaagccccccaggcctatcattaacctgctgggatccttcccaccaggactgtgattgccctgaaacttgaccagtataatccatggtgcacagtaatttatggccatattcttcagtagcctgagttagtctgttctgtcatcatgagaggtgagctacatacagcagagagggcccgatagggcttagatgttttgtctcctccaaatctcgtgttgaaatgtgacctccagtactggaggtgggcctgctgggaggggtcgggtcatgggaacggatccctcatgaatggcttggtgctgtccttggcaatagtgagcgagttctcactctgagttcacaggagatctggttgtttaagagagtgtggcacctgccccctcacagtcttgctcccaccctagccgtgtgacacacctgttctcccttcgcttccagcatgattggaagcttcctgagcccctcaccaggagcagacactacccatgcttcctgtacagcctgtaaaatcatgagccaattaaaccccttttctttataaatt

SEQ ID NO: 63307 - DNA, 556 bp, Homo sapiens
cacaacaatagaaacttacacatggcaaatggctatgcagtacagctcccgatatctggtccactaaattgacctttgagcttagtgtgggaatttcttgcctcctttctatcacttctgagaacaaattctataagcagaaatgcctggaattattgtctggggtcgaggtgttttgtttcaatataagctggccagtctggaaccaaaaggacgaatgtttaacttgtataatcttcttgcagggaaacaggcaagtgtttttgcaagcataaaaggcacaaagtggagtttatttttggtcagagagatgaagaagtaaatcacaaggcaaaatttgttgtttgtttgaagaggggagcagtattaacaagcaaataaaatgccttctatgatttccacagttacaattatagatcctaatcttgcaaatacatgtcaccaaatgcacaacattttgggaatgatggtaaaattgtatgactgaaaaaatcataaatatttaagctatattgttttattaataaattgggtacttacagaattaaaaaaaaag

SEQ ID NO: 63308 - DNA, 534 bp, Homo sapiens
aataaataaaaaatacttctgctatgaaaaacctagttggtatttttgcttatttaatactatagaaatatggtgatctcatctttaatagagtgcttttaaggtccccagtgataatctcctaaaatcatgaactttaagaatttataatgttaatatgaggaaatgaaatctggattatctcaccacatattatataattcattagtgacagagcaagaactccaggtcacctgtctattccatgtttttcctatctgcctttaaatgttgagatactacccttatctcatgtgaatggagaaactgcctaaaatgctaaaactgactcagaggcacccagacataagtgaagtgtgattagaaaatcctggtcagttgagtcttagccaaatgtgtacctactgtgtactgcctctatcaagtcaatgaaaacatgatctgagaactgtaagtccatttatggaaaggtttgatttagagatattttgaacttccagtgatgagccccttctcaaatagctgtattctgaa

SEQ ID NO: 63309 - DNA, 308 bp, Homo sapiens
tcacatatatacattaaaaaatttccttaagtggatatatttctaaaatgtcctcaaatttggagcctcactcttgtgagtttcttcctttctcacagtcagctctgactatgcttttccacacaatattatcccctgacatcaagtgtgtggaaggtgcagaagttcttgcagaaatccataaataaatgaaaaatcctttgttttggcctcctaggctggctttgcagtcacgtagaggtagcctagctttggaaatgttgctaaacatgtctggtttaccctctttcttactcctttcccacaat

SEQ ID NO: 63310 - DNA, 402 bp, Homo sapiens
gcatagggaagactgaaattcttgaattcctatggttgagtggaatcttataactagttatgacgtttgaattttgtgtggaagtgacatgcaacagacacttccaggctggagcctggagcctatttgtgactttttagagctttcttttgtctttggtacaatagccagcagcattcaagatggtggctgctccatcagcctgggactccaggtgactacaataagcaaagtttcctgcttaaatgtaatgaatacgtagcttcagtaaaaaagaaaccggctgggcgtggtgtaatcccacctgtaatcccaacactttgggaggttgaggtgggcggatcacctgaggtcgggagttcgagaccagcctgaccaacatggagaaaccccgtctccatt

SEQ ID NO: 63311 - DNA, 513 bp, Homo sapiens
gcatttggtggatgggaagagtgtagagacaaaactatcagaaggctattgtgaggtcctccgagtatgattttggtggctgtaatgggaacaaagagaaagtgaggaatgtaacagacaccagcagagattaccagtgagtgcaggcatgcagccgtggagatggagacagagggctatcaggaggaagaaatgatctggagataaggtgattcatccagctctagagggcaggctgaaatactggcaaaatagagaaagcataaaagtttagcagacaattggaagcgcagacctggcactaaggacagaggggacacttagaaatgtgcagtcaggactgatctgctcagaggtcataactgatacgtttttgaagaaagggagcacaaggagaggagagccaggacccaccagggcatggcaggaggaggagaggggggtgaatcagggcagcgcctctgtggaaccgcgggaagagtgtttcaaggaagaagtgtttcacgggacgca

SEQ ID NO: 63312 - DNA, 949 bp, Homo sapiens
atcatagctcactgcagccttgaactcctggactcaagcagtcctcccacctcagcctcctgaatagctgaatacaggcatgcgctaccatacctggctaattattattattgtttttgtagaaatggggtcttgctctatagcccaggctggtcttgaactcctgggctcaagccatcctcctgccctggcctcccaaagtgctgggattataggcatgagccacggtgcccagcctttgtcttagtttttggtccccctcacccgaccccagagttctagaaccattcccttgcaaagaaagggactgctcacggctggggatggagaagtgctgtggtaggagccctttcttctctttcttccccagctggattgccaaacctaccctgcggtcctcgtcttcctggccccatagctcctcctcaccaagcatgtcttccccactgcagagagctgcgggaggtaccaagagggccttgtctgcatcttctagttcctctgccagtctacccttcgatgacagggactcaaaccatccctcagagggtaagtagatgttgcattgtgcggccacttcctgtgtccgtggcagccttccccctctcgttttcccacattgatgataatattcgtgggactgtgtgaatacaccagaagtgctgtactcgttcagcacagtgacaccctccctccagctccaggtgttttttttttggcggtcctagatgttgtagacatcaaaatagtagtacatcctgttttttgtttgtttgtttgtttgtatgagatggaatcttgccctgtcgcccaggctggagtgcagtggtgtgatcttggctcactgcaacctccgccttccgggttcaagcacatcctgtttttaatccatcatccatcgtgtctaaacctctcttaaacacatttctgtgttcagtatgtacaaccc

SEQ ID NO: 63313 - DNA, 800 bp, Homo sapiens
ctgccaaccagttatttagcatgctttttattttagttacacagagcgtaacattaacccaagagcagaaaggttttatttacagggttttcgaacttggtttgtaagacagctgccatcacaagcatagcttacaaatgtgctggggacccctaattgggaagtgctttcctctcaaatttttattttttatttttagagacagagtcttgctctgtcatccaggctggagtgcaatggcacgtttttcggcttaccgcaactgccgcctcctgggttcaagcgatagctgggattacaggcatgcgccaccatgcccagctaatttatttgtatttttagtagagacggggtttctccatgttggtcaggctggtctcgaactcccgacctcaggtgatgtgcacacctcagcctcccaataaaccatgacttttaagaggaatagcaggtttacttcccctgccagcattggggtgctctctaagcaacagtaggcggagagtggtctggcgtattaaaaacaaaggatcgtcaagtgggccttcccaggcattgctttgacttagtacatgtagaggatgtggcagttctctccgtccctgccactgctggtttctttgttaaatgtttagttgaaatggcctgatacgatatttgagtagttcactgttggtgctttgcctagcaggattctaatcttgctttggttgtggtcccctgatgccctcctgttaggagtggaggaggtcgaagctccttgtaagatatgattactgggaccattagtgtcaagttcc

SEQ ID NO: 63314 - DNA, 1055 bp, Homo sapiens
ctgccaaccagttatttagcatgctttttattttagttacacagagcgtaacattaacccaagagcagaaaggttttatttacagggttttcgaacttggtttgtaagacagctgccatcacaagcatagcttacaaatgtgctggggacccctaattgggaagtgctttcctctcaaatttttattttttatttttagagacagagtcttgctctgtcatccaggctggagtgcagtggcgtgatctcggctcactgtagcctctgcctcctgagtttaagcgattctcctgccttggcctcccaaagtgctggaattacaggcatgagccgctgcatctggccatcctctcaaattttcaagtgttccacaagtatgttctctactgaagagttgctgcatccttgaatcttgggtgatttgaggcacagaaactatgactttattttttgagatggagttttgctcttgttgcccaggctggagtgcaatggcacgtttttcggcttaccgcaactgccgcctcctgggttcaagcgatagctgggattacaggcatgcgccaccatgcccagctaatttatttgtatttttagtagagacggggtttctccatgttggtcaggctggtctcgaactcccgacctcaggtgatgtgcacacctcagcctcccaataaaccatgacttttaagaggaatagcaggtttacttcccctgccagcattggggtgctctctaagcaacagtaggcggagagtggtctggcgtattaaaaacaaaggatcgtcaagtgggccttcccaggcattgctttgacttagtacatgtagaggatgtggcagttctctccgtccctgccactgctggtttctttgttaaatgtttagttgaaatggcctgatacgatatttgagtagttcactgttggtgctttgcctagcaggattctaatcttgctttggttgtggtcccctgatgccctcctgttaggagtggaggaggtcgaagctccttgtaagatatgattactgggaccattagtgtcaagttcc

SEQ ID NO: 63315 - DNA, 176 bp, Homo sapiens
gcaaaaagatgtaatatatgtaatatggcatcacagaagaggtgagaaatgtacattttaaaagatattagccaaacatttctaaaacccatgaaggatatcaagtacatcaaggttcaaggaatgctactaacttgaagaacaaaatgtacaaagagagtctcattgtgttgcac

SEQ ID NO: 63316 - DNA, 199 bp, Homo sapiens
gttttagaagataagggttgaggctaccgatcctaagtatttgcattttaacatggtgatttctgataaataaaaggataacctttctgggttcttaggagcaaagaagataatggctgcggaattgctctacagcataatgtataagaatttcgttgggtcattaataaataatgcaattattttatcacattttcaa

SEQ ID NO: 63317 - DNA, 433 bp, Homo sapiens
ggcctcaggacgctttggaatgaagagccagggctgtcttttgtgtgacgcgagagccgccgggacgcttcaactctgcagctgctgaagctctgcgagcgaagtcgatgcccaagagagaggggtttggacgtcgtgagaggcgaggcggccgtgttcattcattgttctcgttctagggctctgggtgtgcccctggtattcattctgtggtgggaagaaggaatggaacttagtgtatccttgagatgtgaacgggttctagggggtcacttaatctaagtggaaaatgaattcaaggcacgttcattgagcgtttctgcttgcctggtcctctgtgggctgagtggagagactctgccctccctgcgctcctaaggcgtgaaaacaatgcagtgtgataagaattggcttatcaagtgttatggggatt

SEQ ID NO: 63318 - DNA, 367 bp, Homo sapiens
cttctcttccatcaagactacatctcaaccatccaaagaaactagattggttataattgtctagactggttataattgtaaaaagcagaatagcctgggcacggtggctcgtgcctgtaatcccagcactttgggaggccgaggcaggtggatcacctgaggtcaggaattcgagaccagcctgaccaacatggagaaaccctatctctactaaaaatataaaattagccaggcgtgggggtgcatgcctgtaatcccagctcctcgggaggctgaggcaggagaatcgcttaaacctgggaggcggaggttgccgtgagccgagatcatgccattgcactccagcctgggcaagaagagcggggaa

SEQ ID NO: 63319 - DNA, 766 bp, Homo sapiens
tcggttgcccttcaaacgcctgcaacaccagtgatgatgtaaacttctctccttggcaggacatgggcaaacatgctgattggtgcaaatgtggtgccgagctgtccatagctgcagtgaaagatgaagagcaagaccttctctaggttttctagctttcattaaatgtatttttttccccagagctaatttgaaagttgattggaccactgtggatggggtgtcattaagaatgtgggaaataggggccgagtgcggtggctcacacctgtaatcccagcagtttggaaggccagggcaggtggatcgcttgatcccaggaggtcgagaccagcctggggaacacatcctgtctctacaaaaaatacaaaaattagccaggcagggtggtgcatgcctgtagtcccagctacttgggaggctgaggcaggagaattttttgagcccaggatgcagaggttgaagtgagccaagatcgtgccactgcactccagccttgagacagagcgagaccctgtctcaaaaaaaaaaaaagaacgtgggaaatatgaacctttgaaagttaatctgtgaattgaaagtttaacaataaaagtagttgtttgtttcctttggaagagttttgttccagatgtttgtaatttggttgtttgtaatttggaatgagagaatttttttttcttaggagtgattgcaagaaattaacatgaacaacagtggtcataactgattaaaagctgacacgtcagtaacaaaattgtttata

SEQ ID NO: 63320 - DNA, 3673 bp, Homo sapiens
cgcgtacgcgggtcacgtgagggcgcggcgcggcagcagctccggcggccgagacgggggcggcggccgcgcgggtctggcgggaccggtttggaagactttgccggcctgcagattggccttaagagaaggacggagccacatactgctgacggcccagaactggcagagagaaggttgccatggctgctgttgacagtttctacctcttgtacagggaaatcgccaggtcttgcaattgctatatggaagctctagctttggttggagcctggtatacggccagaaaaagcatcactgtcatctgtgacttttacagcctgatcaggctgcattttatcccccgcctggggagcagagcagacttgatcaagcagtatggaagatgggccgttgtcagcggtgcaacagatgggattggaaaagcctacgctgaagagttagcaagccgaggtctcaatataatcctgattagtcggaacgaggagaagttgcaggttgttgctaaagacatagccgacacgtacaaagtggaaactgatattatagttgcggacttcagcagcggtcgtgagatctaccttccaattcgagaagccctgaaggacaaagacgttggcatcttggtaaataacgtgggtgtgttttatccctacccgcagtatttcactcagctgtccgaggacaagctctgggacatcataaatgtgaacattgccgccgctagtttgatggtccatgttgtgttaccgggaatggtggagagaaagaaaggtgccatcgtcacgatctcttctggctcctgctgcaaacccactcctcagctggctgcattttctgcttctaaggcttatttagaccacttcagcagagccttgcaatatgaatatgcctctaaaggaatctttgtacagagtctaatccctttctatgtagccaccagcatgacagcacccagcaactttctgcacaggtgctcgtggttggtgccttcgccaaaagtctatgcacatcatgctgtttctactcttgggatttccaaaaggaccacaggatattggtcccattctattcagtttctttttgcacagtatatgcctgaatggctctgggtgtggggagcaaatattctcaaccgttcactacgtaaggaagccttatcctgcacagcctgagtctggatggccacttgagaagttttgccaactcctgggaacctcgatattctgacatttggaaaaacacatttaatttatctcctgtgtttcattgctgattattcagcatactgttgattcgtcatttgcaaaacacacataataccgtcagagtgctgtgaaaaaccttaagggtgtgtggatggcacaggatcaataatgcctgaggctgattgacgacatctacatttcagtgctttttccctaagctgtttgaaagttacgcttttctgttgttctagagccacagcagtctaatattgaaatataatatgatttgtcaggtcttataatttcagatgttgttttttaagggaaattgaccatttcactagaggagttgtgctggtttttaaatgtgcatcaagaaagactactgaaaagtattattttgtaactaagattgctggtactattaggaaaaatctgtgtgtattgtatagctctagctgtttgactatctgtaatgaaaatgctgcacttcaactggtatttcattagagaaccgtgtgtgtgcgtgtgtgtggtgcctttgagcaactttatttatggttaccatatttttaaaaagattttttgtcagggtgacttaacatggactcttatagggtattaaaacaatctagattattccttttcatcctaaataagcctaccaaatttcatgctgttggtttgccatgaatgatattacttcctacattatatttgtgttttttcaaatctgctatggaatgaacttattcctagatttggatatgtaagagaaacctgcagtcatcttttgatttataaggcaattcttgtggataaatagtgatttctcagcctctgacccattttataactgaaatttagccctttagagcttgttatatctggttttcctacgtttttctatgtaatattattccattccagtagcattattgatagaaatagtaagtatttatggaatagtaaaatatggacaaattacgtgtgtgacatatctgtcaatataagttagaagcttattcttggtttgtgtaatgaatttatgtattgtagtgaatacctttactggtgtgaagataattatgcacaaaccctcacaatacgcgttaacattgaaacctgtgaaatgtccttagtttgggtcatataaagccaaccatttttgaggaccatgtacctagtgctttgaaaactctaagtcactatatgaatatgacaatatgtgcacatttaaaattcagagctcggcattgtgatactgatgcagaagctagtagattggttaaaagtctggacttctgtggcatttttttcgtgacgtgataatctatcataagcagacctaagcacagttttatgaacacaattttgcccatgacattgcctacaggatttccagatgtgacttgcactcagaagatcagtggtcaacttcagaagctcttccacgcttagatcatgtcttcagaacttagatgtgaaaatctacacactgggagatgctgtgagccccaaggttttgatggagtttgcttggaatcctcttgacttcatgccacattgacgtgaactttgatgtataataagcagcagcaacttcatgtgaaaatatggtcaggtagttatatgtaaggttacgtggtccagtaatgtcttagattgataaattaggtatggaatccatcagtgttacgtgatgagaataggtgaacacaccttgtcagtgatgatgtaaacttctctccttggcaggacatgggcaaacatgctgattggtgcaaatgtggtgccgagctgtccatagctgcagtgaaagatgaagagcaagaccttctctaggttttctagctttcattaaatgtatttttttccccagagctaatttgaaagttgattggaccactgtggatggggtgtcattaagaatgtgggaaataggggccgagtgcggtggctcacacctgtaatcccagcagtttggaaggccagggcaggtggatcgcttgatcccaggaggtcgagaccagcctggggaacacatcctgtctctacaaaaaatacaaaaattagccaggcagggtggtgcatgcctgtagtcccagctacttgggaggctgaggcaggagaattttttgagcccaggatgcagaggttgaagtgagccaagatcgtgccactgcactccagccttgagacagagcgagaccctgtctcaaaaaaaaaaaaagaacgtgggaaatatgaacctttgaaagttaatctgtgaattgaaagtttaacaataaaagtagttgtttgtttcctttggaagagttttgttccagatgtttgtaatttggttgtttgtaatttggaatgagagaatttttttttcttaggagtgattgcaagaaattaacatgaacaacagtggtcataactgattaaaagctgacacgtcagtaacaaaattgtttata

SEQ ID NO: 63321 - DNA, 3622 bp, Homo sapiens
cgcgtacgcgggtcacgtgagggcgcggcgcggcagcagctccggcggccgagacgggggcggcggccgcgcgggtctggcgggaccggtttggaagactttgccggcctgcagattggccttaagagaaggacggagccacatactgctgacggcccagaactggcagagagaaggttgccatggctgctgttgacagtttctacctcttgtacagggaaatcgccaggtcttgcaattgctatatggaagctctagctttggttggagcctggtatacggccagaaaaagcatcactgtcatctgtgacttttacagcctgatcaggctgcattttatcccccgcctggggagcagagcagacttgatcaagcagtatggaagatgggccgttgtcagcggtctcaatataatcctgattagtcggaacgaggagaagttgcaggttgttgctaaagacatagccgacacgtacaaagtggaaactgatattatagttgcggacttcagcagcggtcgtgagatctaccttccaattcgagaagccctgaaggacaaagacgttggcatcttggtaaataacgtgggtgtgttttatccctacccgcagtatttcactcagctgtccgaggacaagctctgggacatcataaatgtgaacattgccgccgctagtttgatggtccatgttgtgttaccgggaatggtggagagaaagaaaggtgccatcgtcacgatctcttctggctcctgctgcaaacccactcctcagctggctgcattttctgcttctaaggcttatttagaccacttcagcagagccttgcaatatgaatatgcctctaaaggaatctttgtacagagtctaatccctttctatgtagccaccagcatgacagcacccagcaactttctgcacaggtgctcgtggttggtgccttcgccaaaagtctatgcacatcatgctgtttctactcttgggatttccaaaaggaccacaggatattggtcccattctattcagtttctttttgcacagtatatgcctgaatggctctgggtgtggggagcaaatattctcaaccgttcactacgtaaggaagccttatcctgcacagcctgagtctggatggccacttgagaagttttgccaactcctgggaacctcgatattctgacatttggaaaaacacatttaatttatctcctgtgtttcattgctgattattcagcatactgttgattcgtcatttgcaaaacacacataataccgtcagagtgctgtgaaaaaccttaagggtgtgtggatggcacaggatcaataatgcctgaggctgattgacgacatctacatttcagtgctttttccctaagctgtttgaaagttacgcttttctgttgttctagagccacagcagtctaatattgaaatataatatgatttgtcaggtcttataatttcagatgttgttttttaagggaaattgaccatttcactagaggagttgtgctggtttttaaatgtgcatcaagaaagactactgaaaagtattattttgtaactaagattgctggtactattaggaaaaatctgtgtgtattgtatagctctagctgtttgactatctgtaatgaaaatgctgcacttcaactggtatttcattagagaaccgtgtgtgtgcgtgtgtgtggtgcctttgagcaactttatttatggttaccatatttttaaaaagattttttgtcagggtgacttaacatggactcttatagggtattaaaacaatctagattattccttttcatcctaaataagcctaccaaatttcatgctgttggtttgccatgaatgatattacttcctacattatatttgtgttttttcaaatctgctatggaatgaacttattcctagatttggatatgtaagagaaacctgcagtcatcttttgatttataaggcaattcttgtggataaatagtgatttctcagcctctgacccattttataactgaaatttagccctttagagcttgttatatctggttttcctacgtttttctatgtaatattattccattccagtagcattattgatagaaatagtaagtatttatggaatagtaaaatatggacaaattacgtgtgtgacatatctgtcaatataagttagaagcttattcttggtttgtgtaatgaatttatgtattgtagtgaatacctttactggtgtgaagataattatgcacaaaccctcacaatacgcgttaacattgaaacctgtgaaatgtccttagtttgggtcatataaagccaaccatttttgaggaccatgtacctagtgctttgaaaactctaagtcactatatgaatatgacaatatgtgcacatttaaaattcagagctcggcattgtgatactgatgcagaagctagtagattggttaaaagtctggacttctgtggcatttttttcgtgacgtgataatctatcataagcagacctaagcacagttttatgaacacaattttgcccatgacattgcctacaggatttccagatgtgacttgcactcagaagatcagtggtcaacttcagaagctcttccacgcttagatcatgtcttcagaacttagatgtgaaaatctacacactgggagatgctgtgagccccaaggttttgatggagtttgcttggaatcctcttgacttcatgccacattgacgtgaactttgatgtataataagcagcagcaacttcatgtgaaaatatggtcaggtagttatatgtaaggttacgtggtccagtaatgtcttagattgataaattaggtatggaatccatcagtgttacgtgatgagaataggtgaacacaccttgtcagtgatgatgtaaacttctctccttggcaggacatgggcaaacatgctgattggtgcaaatgtggtgccgagctgtccatagctgcagtgaaagatgaagagcaagaccttctctaggttttctagctttcattaaatgtatttttttccccagagctaatttgaaagttgattggaccactgtggatggggtgtcattaagaatgtgggaaataggggccgagtgcggtggctcacacctgtaatcccagcagtttggaaggccagggcaggtggatcgcttgatcccaggaggtcgagaccagcctggggaacacatcctgtctctacaaaaaatacaaaaattagccaggcagggtggtgcatgcctgtagtcccagctacttgggaggctgaggcaggagaattttttgagcccaggatgcagaggttgaagtgagccaagatcgtgccactgcactccagccttgagacagagcgagaccctgtctcaaaaaaaaaaaaagaacgtgggaaatatgaacctttgaaagttaatctgtgaattgaaagtttaacaataaaagtagttgtttgtttcctttggaagagttttgttccagatgtttgtaatttggttgtttgtaatttggaatgagagaatttttttttcttaggagtgattgcaagaaattaacatgaacaacagtggtcataactgattaaaagctgacacgtcagtaacaaaattgtttata

SEQ ID NO: 63322 - DNA, 3539 bp, Homo sapiens
cgcgtacgcgggtcacgtgagggcgcggcgcggcagcagctccggcggccgagacgggggcggcggccgcgcgggtctggcgggaccggtttggaagactttgccggcctgcagattggccttaagagaaggacggagccacatactgctgacggcccagaactggcagagagaaggttgccatggctgctgttgacagtttctacctcttgtacagggaaatcgccaggtcttgcaattgctatatggaagctctagctttggttggagcctggtatacggccagaaaaagcatcactgtcatctgtgacttttacagcctgatcaggctgcattttatcccccgcctggggagcagagcagacttgatcaagcagtatggaagatgggccgttgtcagcggtgcaacagatgggattggaaaagcctacgctgaagagttagcaagccgaggtctcaatataatcctgattagtcggaacgaggagaagttgcaggttgttgctaaagacatagccgacacgtacaaagtggaaactgatattatagttgcggacttcagcagcggtcgtgagatctaccttccaattcgagaagccctgaaggacaaagacgttggcatcttggtaaataacgtgggtgtgttttatccctacccgcagtatttcactcagctgtccgaggacaagctctgggacatcataaatgtgaacattgccgccgctagtttgatggtccatgttgtgttaccgggaatggtggagagaaagaaaggtgccatcgtcacgatctcttctggctcctgctgcaaacccactcctcagctggctgcattttctgcttctaaggcttatttagaccacttcagcagagccttgcaatatgaatatgcctctaaaggaatctttgtacagagtctaatccctttctatgtagccaccagcatgacagcacccagcaactttctgcacaggtgctcgtggttggtgccttcgccaaaagtctatgcacatcatgctgtttctactcttgggatttccaaaaggaccacaggatattggtcccattctattcagtttctttttgcacagtatatgcctgaatggctctgggtgtggggagcaaatattctcaaccgttcactacgtaaggaagccttatcctgcacagcctgagtctggatggccacttgagaagttttgccaactcctgggaacctcgatattctgacatttggaaaaacacatttaatttatctcctgtgtttcattgctgattattcagcatactgttgattcgtcatttgcaaaacacacataataccgtcagagtgctgtgaaaaaccttaagggtgtgtggatggcacaggatcaataatgcctgaggctgattgacgacatctacatttcagtgctttttccctaagctgtttgaaagttacgcttttctgttgttctagagccacagcagtctaatattgaaatataatatgatttgtcaggtcttataatttcagatgttgttttttaagggaaattgaccatttcactagaggagttgtgctggtttttaaatgtgcatcaagaaagactactgaaaagtattattttgtaactaagattgctggtactattaggaaaaatctgtgtgtattgtatagctctagctgtttgactatctgtaatgaaaatgctgcacttcaactggtatttcattagagaaccgtgtgtgtgcgtgtgtgtggtgcctttgagcaactttatttatggttaccatatttttaaaaagattttttgtcagggtgacttaacatggactcttatagggtattaaaacaatctagattattccttttcatcctaaataagcctaccaaatttcatgctgttggtttgccatgaatgatattacttcctacattatatttgtgttttttcaaatctgctatggaatgaacttattcctagatttggatatgtaagagaaacctgcagtcatcttttgatttataaggcaattcttgtggataaatagtgatttctcagcctctgacccattttataactgaaatttagccctttagagcttgttatatctggttttcctacgtttttctatgtaatattattccattccagtagcattattgatagaaatagtaagtatttatggaatagtaaaatatggacaaattacgtgtgtgacatatctgtcaatataagttagaagcttattcttggtttgtgtaatgaatttatgtattgtagtgaatacctttactggtgtgaagataattatgcacaaaccctcacaatacgcgttaacattgaaacctgtgaaatgtccttagtttgggtcatataaagccaaccatttttgaggaccatgtacctagtgctttgaaaactctaagtcactatatgaatatgacaatatgtgcacatttaaaattcagagctcggcattgtgatactgatgcagaagctagtagattggttaaaagtctggacttctgtggcatttttttcgtgacgtgataatctatcataagcagacctaagcacagttttatgaacacaattttgcccatgacattgcctacaggatttccagatgtgacttgcactcagaagatcagtggtcaacttcagaagctcttccacgcttagatcatgtcttcagaacttagatgtgaaaatctacacactgggagatgctgtgagccccaaggttttgatggagtttgcttggaatcctcttgacttcatgccacattgacgtgaactttgatgtataataagcagcagcaacttcatgtgaaaatatggtcaggacatgggcaaacatgctgattggtgcaaatgtggtgccgagctgtccatagctgcagtgaaagatgaagagcaagaccttctctaggttttctagctttcattaaatgtatttttttccccagagctaatttgaaagttgattggaccactgtggatggggtgtcattaagaatgtgggaaataggggccgagtgcggtggctcacacctgtaatcccagcagtttggaaggccagggcaggtggatcgcttgatcccaggaggtcgagaccagcctggggaacacatcctgtctctacaaaaaatacaaaaattagccaggcagggtggtgcatgcctgtagtcccagctacttgggaggctgaggcaggagaattttttgagcccaggatgcagaggttgaagtgagccaagatcgtgccactgcactccagccttgagacagagcgagaccctgtctcaaaaaaaaaaaaagaacgtgggaaatatgaacctttgaaagttaatctgtgaattgaaagtttaacaataaaagtagttgtttgtttcctttggaagagttttgttccagatgtttgtaatttggttgtttgtaatttggaatgagagaatttttttttcttaggagtgattgcaagaaattaacatgaacaacagtggtcataactgattaaaagctgacacgtcagtaacaaaattgtttata

SEQ ID NO: 63323 - DNA, 2957 bp, Homo sapiens
cgcgtacgcgggtcacgtgagggcgcggcgcggcagcagctccggcggccgagacgggggcggcggccgcgcgggtctggcgggaccggtttggaagactttgccggcctgcagattggccttaagagaaggacggagccacatactgctgacggcccagaactggcagagagaaggttgccatggctgctgttgacagtttctacctcttgtacagggaaatcgccaggtcttgcaattgctatatggaagctctagctttggttggagcctggtatacggccagaaaaagcatcactgtcatctgtgacttttacagcctgatcaggctgcattttatcccccgcctggggagcagagcagacttgatcaagcagtatggaagatgggccgttgtcagcggtgcaacagatgggattggaaaagcctacgctgaagagttagcaagccgaggtctcaatataatcctgattagtcggaacgaggagaagttgcaggttgttgctaaagacatagccgacacgtacaaagtggaaactgatattatagttgcggacttcagcagcggtcgtgagatctaccttccaattcgagaagccctgaaggacaaagacgttggcatcttggtaaataacgtgggtgtgttttatccctacccgcagtatttcactcagctgtccgaggacaagctctgggacatcataaatgtgaacattgccgccgctagtttgatggtccatgttgtgttaccgggaatggtggagagaaagaaaggtgccatcgtcacgatctcttctggctcctgctgcaaacccactcctcagctggctgcattttctgcttctaaggcttatttagaccacttcagcagagccttgcaatatgaatatgcctctaaaggaatctttgtacagagtctaatccctttctatgtagccaccagcatgacagcacccagcaactttctgcacaggtgctcgtggttggtgccttcgccaaaagtctatgcacatcatgctgtttctactcttgggatttccaaaaggaccacaggatattggtcccattctattcagtttctttttgcacagtatatgcctgaatggctctgggtgtggggagcaaatattctcaaccgttcactacgtaaggaagccttatcctgcacagcctgagtctggatggccacttgagaagttttgccaactcctgggaacctcgatattctgacatttggaaaaacacatttaatttatctcctgtgtttcattgctgattattcagcatactgttgattcgtcatttgcaaaacacacataataccgtcagagtgctgtgaaaaaccttaagggtgtgtggatggcacaggatcaataatgcctgaggctgattgacgacatctacatttcagtgctttttccctaagctgtttgaaagttacgcttttctgttgttctagagccacagcagtctaatattgaaatataatatgatttgtcaggtcttataatttcagatgttgttttttaagggaaattgaccatttcactagaggagttgtgctggtttttaaatgtgcatcaagaaagactactgaaaagtattattttgtaactaagattgctggtactattaggaaaaatctgtgtgtattgtatagctctagctgtttgactatctgtaatgaaaatgctgcacttcaactggtatttcattagagaaccgtgtgtgtgcgtgtgtgtggtgcctttgagcaactttatttatggttaccatatttttaaaaagattttttgtcagggtgacttaacatggactcttatagggtattaaaacaatctagattattccttttcatcctaaataagcctaccaaatttcatgctgttggtttgccatgaatgatattacttcctacattatatttgtgttttttcaaatctgctatggaatgaacttattcctagatttggatatgtaagagaaacctgcagtcatcttttgatttataaggcaattcttgtggataaatagtgatttctcagcctctgacccattttataactgaaatttagccctttagagcttgttatatctggttttcctacgtttttctatgtaatattattccattccagtagcattattgatagaaatagtaagtatttatggaatagtaaaatatggacaaattacgtgtgtgacatatctgtcaatataagttagaagcttattcttggtttgtgtaatgaatttatgtattgtagtgaatacctttactggtgtgaagataattatgcacaaaccctcacaatacgcgttaacattgaaacctgtgaaatgtccttagtttgggtcatataaagccaaccatttttgaggaccatgtacctagtgctttgaaaactctaagtcactatatgaatatgacaatatgtgcacatttaaaattcagagctcggcattgtgatactgatgcagaagctagtagattggttaaaagtctggacttctgtggcatttttttcgtgacgtgataatctatcataagcagacctaagcacagttttatgaacacaattttgcccatgacattgcctacaggatttccagatgtgacttgcactcagaagatcagtggtcaacttcagaagctcttccacgcttagatcatgtcttcagaacttagatgtgaaaatctacacactgggagatgctgtgagccccaaggttttgatggagtttgcttggaatcctcttgacttcatgccacattgacgtgaactttgatgtataataagcagcagcaacttcatgtgaaaatatggtcaggacatgggcaaacatgctgattggtgcaaatgtggtgccgagctgtccatagctgcagtgaaagatgaagagcaagaccttctctaggttttctagctttcattaaatgtatttttttccccaga

SEQ ID NO: 63324 - DNA, 1461 bp, Homo sapiens
  misc_feature (20)..(20): n is a, c, g, or t
  misc_feature (37)..(37): n is a, c, g, or t
  misc_feature (39)..(39): n is a, c, g, or t
  misc_feature (51)..(51): n is a, c, g, or t
tctgcttatgatagattatnacgtaacgaaaaaaatncnacaaaagtccanactttaaaccaatctactagcttctgcatcagtatcacaaaaccctcacaatacgcgttaacattgaaacctgtgaaatgtccttagtttgggtcatataaagccaaccatttttgaggaccatgtacctagtgctttgaaaactctaagtcactatatgaatatgacaatatgtgcacatttaaaattcagagctcggcattgtgatactgatgcagaagctagtagattggttaaaagtctggacttctgtggcatttttttcgtgacgtgataatctatcataagcagacctaagcacagttttatgaacacaattttgcccatgacattgcctacaggatttccagatgtgacttgcactcagaagatcagtggtcaacttcagaagctcttccacgcttagatcatgtcttcagaacttagatgtgaaaatctacacactgggagatgctgtgagccccaaggttttgatggagtttgcttggaatcctcttgacttcatgccacattgacgtgaactttgatgtataataagcagcagcaacttcatgtgaaaatatggtcaggtagttatatgtaaggttacgtggtccagtaatgtcttagattgataaattaggtatggaatccatcagtgttacgtgatgagaataggtgaacacaccttgtcagtgatgatgtaaacttctctccttggcaggacatgggcaaacatgctgattggtgcaaatgtggtgccgagctgtccatagctgcagtgaaagatgaagagcaagaccttctctaggttttctagctttcattaaatgtatttttttccccagagctaatttgaaagttgattggaccactgtggatggggtgtcattaagaatgtgggaaataggggccgagtgcggtggctcacacctgtaatcccagcagtttggaaggccagggcaggtggatcgcttgatcccaggaggtcgagaccagcctggggaacacatcctgtctctacaaaaaatacaaaaattagccaggcagggtggtgcatgcctgtagtcccagctacttgggaggctgaggcaggagaattttttgagcccaggatgcagaggttgaagtgagccaagatcgtgccactgcactccagccttgagacagagcgagaccctgtctcaaaaaaaaaaaaagaacgtgggaaatatgaacctttgaaagttaatctgtgaattgaaagtttaacaataaaagtagttgtttgtttcctttggaagagttttgttccagatgtttgtaatttggttgtttgtaatttggaatgagagaatttttttttcttaggagtgattgcaagaaattaacatgaacaacagtggtcataactgattaaaagctgacacgtcagtaacaaaattgtttata

SEQ ID NO: 63325 - DNA, 508 bp, Homo sapiens
tgagcacttggatgttactttaatgtaaagttttcccagctgaactatgaggaagaggaaaggcatttgtttcttgttggttttattcacagattggccttaagagaaggacggagccacatactgctgacggcccagaactggcagagagaaggtaagagaccccagggcagggaacgaccacagcagaaaaactggggccccctttgtggtcaggcgccttttgctagacatttacttcaaaaaggttcagattcttgaaaaaaatcgggcttaaggaggaagcttccatctgtgtgggttcctccatgaggcatgcctgacctcctttttgtagcgagagccttactctataggcttggagcaactcatttccccacaaatactgctttggctacaacccattgatcttgatatgtagtatctgttttttctttctttttttttttttcttttttcttttttgagacggagtctccctctgtcgtccaggctggagtgcagtggc

SEQ ID NO: 63326 - DNA, 534 bp, Homo sapiens
cgcgtacgcgggtcacgtgagggcgcggcgcggcagcagctccggcggccgagacgggggcggcggccgcgcgggtctggcgggaccggtttggaagactttgccggcctgcagattggccttaagagaaggacggagccacatactgctgacggcccagaactggcagagagaaggttgccatggctgctgttgacagtttctacctcttgtacagggaaatcgccaggtcttgcaattgctatatggaagctctagctttggttggagcctggtatacggccagaaaaagcatcactgtcatctgtgacttttacagcctgatcaggctgcattttatcccccgcctggggagcagagcagacttgatcaagcagtatggaagatgggccgttgtcagcggtaacctactttataatcaaaataatcttttctgtgaagtcggatgcattattcaaggagctattgaatttaatgtggtgtttttatgggaacatgctgataaaaaaataaaacttatggctcctgccgtga

SEQ ID NO: 63327 - DNA, 3590 bp, Homo sapiens
cacatctacggagtccctttggccacataagattggccttaagagaaggacggagccacatactgctgacggcccagaactggcagagagaaggttgccatggctgctgttgacagtttctacctcttgtacagggaaatcgccaggtcttgcaattgctatatggaagctctagctttggttggagcctggtatacggccagaaaaagcatcactgtcatctgtgacttttacagcctgatcaggctgcattttatcccccgcctggggagcagagcagacttgatcaagcagtatggaagatgggccgttgtcagcggtgcaacagatgggattggaaaagcctacgctgaagagttagcaagccgaggtctcaatataatcctgattagtcggaacgaggagaagttgcaggttgttgctaaagacatagccgacacgtacaaagtggaaactgatattatagttgcggacttcagcagcggtcgtgagatctaccttccaattcgagaagccctgaaggacaaagacgttggcatcttggtaaataacgtgggtgtgttttatccctacccgcagtatttcactcagctgtccgaggacaagctctgggacatcataaatgtgaacattgccgccgctagtttgatggtccatgttgtgttaccgggaatggtggagagaaagaaaggtgccatcgtcacgatctcttctggctcctgctgcaaacccactcctcagctggctgcattttctgcttctaaggcttatttagaccacttcagcagagccttgcaatatgaatatgcctctaaaggaatctttgtacagagtctaatccctttctatgtagccaccagcatgacagcacccagcaactttctgcacaggtgctcgtggttggtgccttcgccaaaagtctatgcacatcatgctgtttctactcttgggatttccaaaaggaccacaggatattggtcccattctattcagtttctttttgcacagtatatgcctgaatggctctgggtgtggggagcaaatattctcaaccgttcactacgtaaggaagccttatcctgcacagcctgagtctggatggccacttgagaagttttgccaactcctgggaacctcgatattctgacatttggaaaaacacatttaatttatctcctgtgtttcattgctgattattcagcatactgttgattcgtcatttgcaaaacacacataataccgtcagagtgctgtgaaaaaccttaagggtgtgtggatggcacaggatcaataatgcctgaggctgattgacgacatctacatttcagtgctttttccctaagctgtttgaaagttacgcttttctgttgttctagagccacagcagtctaatattgaaatataatatgatttgtcaggtcttataatttcagatgttgttttttaagggaaattgaccatttcactagaggagttgtgctggtttttaaatgtgcatcaagaaagactactgaaaagtattattttgtaactaagattgctggtactattaggaaaaatctgtgtgtattgtatagctctagctgtttgactatctgtaatgaaaatgctgcacttcaactggtatttcattagagaaccgtgtgtgtgcgtgtgtgtggtgcctttgagcaactttatttatggttaccatatttttaaaaagattttttgtcagggtgacttaacatggactcttatagggtattaaaacaatctagattattccttttcatcctaaataagcctaccaaatttcatgctgttggtttgccatgaatgatattacttcctacattatatttgtgttttttcaaatctgctatggaatgaacttattcctagatttggatatgtaagagaaacctgcagtcatcttttgatttataaggcaattcttgtggataaatagtgatttctcagcctctgacccattttataactgaaatttagccctttagagcttgttatatctggttttcctacgtttttctatgtaatattattccattccagtagcattattgatagaaatagtaagtatttatggaatagtaaaatatggacaaattacgtgtgtgacatatctgtcaatataagttagaagcttattcttggtttgtgtaatgaatttatgtattgtagtgaatacctttactggtgtgaagataattatgcacaaaccctcacaatacgcgttaacattgaaacctgtgaaatgtccttagtttgggtcatataaagccaaccatttttgaggaccatgtacctagtgctttgaaaactctaagtcactatatgaatatgacaatatgtgcacatttaaaattcagagctcggcattgtgatactgatgcagaagctagtagattggttaaaagtctggacttctgtggcatttttttcgtgacgtgataatctatcataagcagacctaagcacagttttatgaacacaattttgcccatgacattgcctacaggatttccagatgtgacttgcactcagaagatcagtggtcaacttcagaagctcttccacgcttagatcatgtcttcagaacttagatgtgaaaatctacacactgggagatgctgtgagccccaaggttttgatggagtttgcttggaatcctcttgacttcatgccacattgacgtgaactttgatgtataataagcagcagcaacttcatgtgaaaatatggtcaggtagttatatgtaaggttacgtggtccagtaatgtcttagattgataaattaggtatggaatccatcagtgttacgtgatgagaataggtgaacacaccttgtcagtgatgatgtaaacttctctccttggcaggacatgggcaaacatgctgattggtgcaaatgtggtgccgagctgtccatagctgcagtgaaagatgaagagcaagaccttctctaggttttctagctttcattaaatgtatttttttccccagagctaatttgaaagttgattggaccactgtggatggggtgtcattaagaatgtgggaaataggggccgagtgcggtggctcacacctgtaatcccagcagtttggaaggccagggcaggtggatcgcttgatcccaggaggtcgagaccagcctggggaacacatcctgtctctacaaaaaatacaaaaattagccaggcagggtggtgcatgcctgtagtcccagctacttgggaggctgaggcaggagaattttttgagcccaggatgcagaggttgaagtgagccaagatcgtgccactgcactccagccttgagacagagcgagaccctgtctcaaaaaaaaaaaaagaacgtgggaaatatgaacctttgaaagttaatctgtgaattgaaagtttaacaataaaagtagttgtttgtttcctttggaagagttttgttccagatgtttgtaatttggttgtttgtaatttggaatgagagaatttttttttcttaggagtgattgcaagaaattaacatgaacaacagtggtcataactgattaaaagctgacacgtcagtaacaaaattgtttata

SEQ ID NO: 63328 - DNA, 3091 bp, Homo sapiens
cgcgtacgcgggtcacgtgagggcgcggcgcggcagcagctccggcggccgagacgggggcggcggccgcgcgggtctggcgggaccggtttggaagactttgccggcctgcagattggccttaagagaaggacggagccacatactgctgacggcccagaactggcagagagaaggttgccatggctgctgttgacagtttctacctcttgtacagggaaatcgccaggtcttgcaattgctatatggaagctctagctttggttggagcctggtatacggccagaaaaagcatcactgtcatctgtgacttttacagcctgatcaggctgcattttatcccccgcctggggagcagagcagacttgatcaagcagtatggaagatgggccgttgtcagcggtgcaacagatgggattggaaaagcctacgctgaagagttagcaagccgaggtctcaatataatcctgattagtcggaacgaggagaagttgcaggttgttgctaaagacatagccgacacgtacaaagtggaaactgatattatagttgcggacttcagcagcggtcgtgagatctaccttccaattcgagaagccctgaaggacaaagacgttggcatcttggtaaataacgtgggtgtgttttatccctacccgcagtatttcactcagctgtccgaggacaagctctgggacatcataaatgtgaacattgccgccgctagtttgatggtccatgttgtgttaccgggaatggtggagagaaagaaaggtgccatcgtcacgatctcttctggctcctgctgcaaacccactcctcagctggctgcattttctgcttctaaggcttatttagaccacttcagcagagccttgcaatatgaatatgcctctaaaggaatctttgtacagagtctaatccctttctatgtagccaccagcatgacagcacccagcaactttctgcacaggtgctcgtggttggtgccttcgccaaaagtctatgcacatcatgctgtttctactcttgggatttccaaaaggaccacaggatattggtcccattctattcagtttctttttgcacagtatatgcctgaatggctctgggtgtggggagcaaatattctcaaccgttcactacgtaaggaagccttatcctgcacagcctgagtctggatggccacttgagaagttttgccaactcctgggaacctcgatattctgacatttggaaaaacacatttaatttatctcctgtgtttcattgctgattattcagcatactgttgattcgtcatttgcaaaacacacataataccgtcagagtgctgtgaaaaaccttaagggtgtgtggatggcacaggatcaataatgcctgaggctgattgacgacatctacatttcagtgctttttccctaagctgtttgaaagttacgcttttctgttgttctagagccacagcagtctaatattgaaatataatatgatttgtcaggtcttataatttcagatgttgttttttaagggaaattgaccatttcactagaggagttgtgctggtttttaaatgtgcatcaagaaagactactgaaaagtattattttgtaactaagattgctggtactattaggaaaaatctgtgtgtattgtatagctctagctgtttgactatctgtaatgaaaatgctgcacttcaactggtatttcattagagaaccgtgtgtgtgcgtgtgtgtggtgcctttgagcaactttatttatggttaccatatttttaaaaagattttttgtcagggtgacttaacatggactcttatagggtattaaaacaatctagattattccttttcatcctaaataagcctaccaaatttcatgctgttggtttgccatgaatgatattacttcctacattatatttgtgttttttcaaatctgctatggaatgaacttattcctagatttggatatgtaagagaaacctgcagtcatcttttgatttataaggcaattcttgtggataaatagtgatttctcagcctctgacccattttataactgaaatttagccctttagagcttgttatatctggttttcctacgtttttctatgtaatattattccattccagtagcattattgatagaaatagtaagtatttatggaatagtaaaatatggacaaattacgtgtgtgacatatctgtcaatataagttagaagcttattcttggtttgtgtaatgaatttatgtattgtagtgaatacctttactggtgtgaagataattatgcacaaaccctcacaatacgcgttaacattgaaacctgtgaaatgtccttagtttgggtcatataaagccaaccatttttgaggaccatgtacctagtgctttgaaaactctaagtcactatatgaatatgacaatatgtgcacatttaaaattcagagctcggcattgtgatactgatgcagaagctagtagattggttaaaagtctggacttctgtggcatttttttcgtgacgtgataatctatcataagcagacctaagcacagttttatgaacacaattttgcccatgacattgcctacaggatttccagatgtgacttgcactcagaagatcagtggtcaacttcagaagctcttccacgcttagatcatgtcttcagaacttagatgtgaaaatctacacactgggagatgctgtgagccccaaggttttgatggagtttgcttggaatcctcttgacttcatgccacattgacgtgaactttgatgtataataagcagcagcaacttcatgtgaaaatatggtcaggtagttatatgtaaggttacgtggtccagtaatgtcttagattgataaattaggtatggaatccatcagtgttacgtgatgagaataggtgaacacaccttgtcagtgatgatgtaaacttctctccttggcaggacatgggcaaacatgctgattggtgcaaatgtggtgccgagctgtccatagctgcagtgaaagatgaagagcaagaccttctctaggttttctagctttcattaaatgtatttttttccccaga

SEQ ID NO: 63329 - DNA, 385 bp, Homo sapiens
tcaaggttgacacatcaaggttgacacataaaggtggaggagtcagttcttcaaagaacagagaaaaatgctgcaggaagtagaacagcatggacaaagtcattgaggttaagaaggcacctattcaacaaactgaaggaactcctgcaggaagtagaacagcatggacaaagtcattgaggttaagaaggcacctattcaacaaactgaaggaactccagtatagtgaacgagggaagagtcacataaaaagagatgggaaagcaggtggggtggcacaggcctgttgtcccagctactccataggctgagcatgttatgatcatgtctatgaatagccactgtactccagccagagtgacagagctgagaccccatctccact

SEQ ID NO: 63330 - DNA, 835 bp, Homo sapiens
ggaaatgcaaataaaaaccacaatgaaattatataacactagatggctgtcataaaaaagacaaataataaaaattgttggtgagggtgtggagaaatcagaattctcatacgctgctggtggaaatgtaaaatagtggagagactttggaaaacagtctggcaattcctcaaaaggttaaacatagagttaccacataagcccattctattccatttctaggtatataaccaagagaaatgaaaacatacacccatgcaaaaatttgtgccaaaagttcatagtaacattattcataatagccaaaaagcgcaaacaacccaaatgtcccaaatgtctatcaagtgatgaatggattaaaaattgtgttatacccaaacaccagactattactcagccatacgaaggaggtgcgcactcacgttacaacacaaataaaccttgaaaatattatactaagtgaaagaagctggttaccaaaaaaacccccacatattatatgattcgatttatatgaaatgtccagaacaggcaaatccatacaagcacaaagtagattcttggtttcccagggctggagatggaggagatgagggaagttaaggggtgacagctgaaagggtgacagctaaaagggatggaggtttctctgagaggctggggaagatgtgtgaaattgtactgtggcaatggttggtggcacagctctgtgaatatagtaaaagccactgagtggtacaattgaaaccagtgaattgtgtggtatgtgaattatatttcaataaaaaaagtacatatctaattgatataaaaagactggactggaaacacattt

SEQ ID NO: 63331 - DNA, 321 bp, Homo sapiens
tctgagctggattctaccaacaatcttcttaaggaactgccttttgagatttaaaccttattcctctttaatttcccagcgtcctctctgcctaacgaggctggctgtctactttgggctttagtaatgcctatccccttgcaactcctccatcataccacgcaattacacacctccgggcctttgctgttacttacttcacccagaacttgctcccttctttcctccctgctttttcctagcccattttataacattagacaatttaggagttaccttctctaggaaccctttttggaacctcttatagaggactaaggt

SEQ ID NO: 63332 - DNA, 476 bp, Homo sapiens
agggctgttgtttttgcctgtcatggagttccgttcattctgaacatgtcaccggggactttggaatgtgtatccataactccctgattttcaaccacattccagcctgcctgactcatgaagcgtggagcgacccaggaacatcccagctcctcatgtcccacattcttcaggctttctcttagttttggcatgtgcatgtaaatgtcaacagatcaataaaggcaaaaaccaggtagatcccataaatcccgctgagcctgtcatagctatcaaattatacccagataaagcttctggtggctaatgacatggccatcacccagcgtggacgtgggcaggaggggctctccgggagcatctggtctgctgtggagacacttgtcatctggaggctctgtggctctaatggagggtgatgctttgaacgcgactatctcccccataaaaaaataaataaataataagtataattt

SEQ ID NO: 63333 - DNA, 666 bp, Homo sapiens
agggctgttgtttttgcctgtcatggagttccgttcattctgaacatgtcaccggggactttggaatgtgtatccataactccctgattttcaaccacattccagcctgcctgactcatgaagcgtggagcgacccaggaacatcccagctcctcatgtcccacattcttcaggctttctcttagttttggcatgtgcatgtaaatgtcaacagctgcttctgctgactcctcgtctcaattaatcgcggctctgtcttccgtttgctgaagccgaagacctccccgctctctcagagcccatgtctggcacatcagcgaatctcgttggcactgccgtcaaacacatccatctaggatctccccgcacttcacgccacccaccgcgctagtctgtggatccctgtttctctcttggatgtagtaatagtcacatagctggacttctgccctggcacttcttcagccccttgttagaggaatcctgctaaatgttggatgatttaccccccacctcccgcaccccccgccacacacacataggagctccactggctcctcataactctcagggtgccagcctgtctctgccatgacccgaaagctctccgtcatctgtctcccgcccctccctcactgactctatctgccaccctctccctgttgt

SEQ ID NO: 63334 - DNA, 379 bp, Homo sapiens
ccgcttttagggaagattctctgcctgatgtgtgagcgctctaacctcttcatctgtgttcagtccccttgcaatgcttctctaagatcaataaaggcaaaaaccaggtagatcccataaatcccgctgagcctgtcatagctatcaaattatacccagataaagcttctggtggctaatgacatggccatcacccagcgtggacgtgggcaggaggggctctccgggagcatctggtctgctgtggagacacttgtcatctggaggctctgtggctctaatggagggtgatgctttgaacgcgactatctcccccataaaaaaataaataaataataagtataatttaaaaataaacaaagatctggatttgcaggct

SEQ ID NO: 63335 - DNA, 344 bp, Homo sapiens
gatgtccaatattacaacttccaactgttcacgctgttgtctgtttcttctatcaataaaggcaaaaaccaggtagatcccataaatcccgctgagcctgtcatagctatcaaattatacccagataaagcttctggtggctaatgacatggccatcacccagcgtggacgtgggcaggaggggctctccgggagcatctggtctgctgtggagacacttgtcatctggaggctctgtggctctaatggagggtgatgctttgaacgcgactatctcccccataaaaaaataaataaataataagtataatttaaaaataaacaaagatctggatttgcaggct

SEQ ID NO: 63336 - DNA, 1082 bp, Homo sapiens
tgtatttcttcttttagcttagtgatctctgaaaagagaaggaaagaggtggctgtagacctggactccccttccagaccacaacttccccggtgatatgggaccctggaggaggaagtctacaatgtgggggaggtgagttaccaggaagataacctttgcactcagaaggcttgcgaaccccagaggagactgtctgtctgagagatcaccttacccacactgtggaataaaaatattgcctctaacattagggaactggcattcccctcctccactgtttgaaaaggtcagaactggtccttcaagccaaataagttactgcttttgaggtgaagctggtaagacagatctggggcctgcaggcaaagtgggttcagtttccgtttgtagtcaaggcaacttcttccaaaagaggctttcaacctgcctgggcttctaggcccagttgagatccagtgtgactcacaggttataactagtggaccttccatcctcacggagccttggctccacctaccacttggcctgagtcagaagtaaaacaaaaactaaaacgaacaaacaaagaaacttaaaaacataaaggtagagaaagaaagaaaaccacctcagtttgaatctggggttgtcatgtctagctgtatgacgttgagcaagtcactcgacttctctgagcctcagtttccacagattatagggctgagtgagatgaggttgtgacggtgtttgcacactacattggacaaggggctgagcatcatcatatggccaaaagcctgacaaacaacactggtccccacacaagcaactctggtccctcctgaacccacaccaagccaagtgttctccctgtggcagagcacccgtgcacaagagacctgggtagctggaatcaaggtttcacctctccgctcagactttcactttatatataccttactttttgctctgtatgaagtattttatttcagccataatttttttctactttagaaagccaataagaattaatcaatcaataattgccttgatgggggaaaaaccaataaaagtagagctataacaggacttgaacttaa

SEQ ID NO: 63337 - DNA, 443 bp, Homo sapiens
aaaaaattattctaagacctgcaaatgggaaagtcatggtccaagttgggccatttctcattaacaataagttggagcccagtgctcaatcaacctggctcaaaacaccctgatagtccattctgggatcaccctgtaaatcagaaatcatcccacctactctagacaaatgggagatcctggctagtttacctttttctattcctgtgattttaattgcttgctctaaactagggaagtaatctcccaaaataatagcttgaatgtgctacatactatactacgtgcacttaaaaatattacattgaggctgggcgtggtggctcatgcctgtaatcccagaactttgggaggccaaggtgggaggatcacctgaggtcgggagttcaagaccagcctgaccaacatggataaaccctgtctctattaaaaatacaaaatta

SEQ ID NO: 63338 - DNA, 1409 bp, Homo sapiens
tattgattcctaagtagattgactataatctcatgataagtatgtatatgtgcatgggaaaacaacattcaataatagtctttgtgtttaaaactatcatggtatacattttcttatgtggtgcttgaggagtttcattctacagtttacaaggtgtaggtttgcaccccaaattctcagggtatgctatttcacccaaatacttgaaagaaaaaggtgccctgtattttatcagtactgttgagggggaaattttttgtgtaagttgtttgataaaactgcttataaaaatcaaattcacaaaatatgttaggctttcacataatttctaaggagatatatgtagaaataagatatatattatcaagagactgcttatatattcttaactagcttctgggtcctaagtagacctcacaggtgcataaaatcattaataaagcatgtagcacttgctaattggtgccttaagcttgaatctaatcagaattgcagactcgggtcctctgggaaaaaaacatgtccgtctgtggcacgtgtgagtactaggcccaggggaagagtctgaaaattgaattcttttgtgtgtcctgtgtctcagaagagaactgaatgttcagagcagcgtttgtaagctattaacattcagtatttcgtgttgcaactagaacacattattagatttattcctgtttaattcataatggtgcagaataaaacacacacatctgatttgatttctttttctttttttaagtttcataattgctttttatggctagtgttaatggcaaaaagtcctttccagggctccctgaataatctaccatacctgtatccatagcaggtgatgcttttttttatccccactttgaagacgtgtgtttctgtatttacacataaatcatactattgtatattaaagacagcagtggttgaaaagaatgtgaacactgtagaagttatgttggaaaaaaggagagtaaattgtgtgattaatggggaaggatattggataatgttataccccggactatgaaaaaagctggtggtaaatgggaagaatgtgaaattttaaactgctctcaacgtaggaatcttggtggaaaagttcctacctgaggtctgatatgattcaattatagaatgcaatgagcttggccaaggggactttgaatccagccaaggaaactttgaatctcgacagctctgagaatcacattttcagtgcattgaatatggagtaaactatttagacaaggattctgtgagactaggctacttacctttaattgccagcatttgtaaatgattgtgcaatcttgtgtaatggtcttttattttgactgttttggaaaaaaaatgttttattgtttttttttcccagtaaaaattacttcaaagaaaac

SEQ ID NO: 63339 - DNA, 5872 bp, Homo sapiens
  misc_feature (2888)..(2888): n is a, c, g, or t
  misc_feature (3170)..(3170): n is a, c, g, or t
  misc_feature (3186)..(3186): n is a, c, g, or t
  misc_feature (3217)..(3217): n is a, c, g, or t
cgttccgctaccaagagaggcttccggtcagcggagggtttgctccgtctcttggtgaacttgaacagaggcagaggcaaaagcaaaacatttctgcgccaggagatgaggggcggtagagccctggaatggagatgtccttgacgcctgggcagaggctgcagctgcaggaccctgtggccactggagataagtaatggtgccatttgaacacctactggaaacggggcaggaacagtgagtgaccccaggcgagcacaggcaggtgccaggagccaggatgcaaggatgacgcctccggaggccctggcctcactcccacctgggcgctaggagccatcccggggctccagccaggagccctgctgcccaggggcatggccaaacctttcttccgactccagaagtttctccgccgaacacagttcctgctgttcttcctcacggctgcctacctgatgaccggcagcctgctgctgctgcagcgggtccgcgtggctctcccacagggcccccgggcacccggccccctgcagaccttgccagtggccgccgtggcgctgggcgtgggcttgctggacagcagagccctgcacgaccctcgagtcagcccagagctgctgctgggtgtggacatgctgcagagccccctgacccggccccggcccggcccccgctggctccggagccgcaactcggagctgcgtcagttgcgtcgccgctggttccaccacttcatgagtgactcccagggaccgcccgccctgggccccgaggctgccaggcccgccatccacagccgaggcacctacattggatgcttcagtgacgatggccatgagaggactctgaaaggagctgtgttttatgacttgagaaagatgactgtctcccactgccaggatgcgtgtgctgagcggtcctatgtctacgccggcttggaggccggggcggagtgttactgcgggaaccggctgccagcggtgagcgtggggctggaagagtgtaaccatgagtgcaaaggcgagaagggctctgtgtgcggggctgtggaccggctctccgtgtaccgtgtggacgagctgcagccgggctccaggaagcggcggaccgccacctaccgcggatgcttccgactgccagagaacatcacacatgccttccccagctccctgatacaggccaatgtgaccgtggggacttgctcgggcttttgttcccagaaagagttccccttggccattctcaggggctgggaatgctactgtgcttaccctaccccccggttcaacctgcgggatgccatggacagctcagtatgtggccaggaccctgaggcacagaggctggcagaatactgtgaggtctaccagacacctgtgcaagacactcgttgtacagacaggaggttcctgcctaacaaatccaaagtgtttgtggctttgtcaagcttcccaggagccgggaacacgtgggcacggcacctcattgagcatgccactggcttctatacagggagctactactttgatggaaccctctacaacaaagggttcaagggcgaaaaggaccactggcggagccgacgcaccatctgtgtcaaaacccacgagagtggcaggagggagattgagatgtttgattcagccatcctgctaatccggaacccatacaggtccctggtggcagaattcaacagaaaatgtgccgggcacctgggatatgcagctgaccgcaactggaagagcaaagagtggccggactttgtcaacagctacgcctcgtggtggtcctcgcacgtcctggactggctcaagtacgggaagcggctgctggtggtgcactacgaggagctgcggcgcagcctggtgcccacgttacgggagatggtggccttcctcaacgtgtctgtgagcgaggagcggctgctctgcgtggagaacaacaaggagggcagcttccggcggcgcggccggcgctcccacgaccctgagcccttcaccccggagatgaaagacttgatcaatggctacatccggacggtggaccaagccctgcgtgaccacaactggacggggctgcccagggagtatgtgcccagatgataggcctggcccacgccgccgcccccgctgagtgacgcaatcgcaccacggggctgcgctccccactctgatgctcaggcccgtggcctcactgggacgaacggtgggtggggggctcaccctggtgctgcctcccgcacaaggagacctggacacaacagacacacatcacaaggcgaacacaaatggacacacatacctggccacgaacccacacctcctcagacactcagacaccactccaggctcatagccccgtcttgatgcagagaagccacccacgtggggtgtgccaggcacccccagatacaaatgcagccacgcacagacgtaacacacaggtgccaggccgtgtgctcctggaggctggctggctgtctctctcacacagatacacgtgcgctccctgggatccgggaggccctgggcttcctgtgtgtagccctggcatagacttgctcgtcagggtgttcgactctgggatgctgggccgggcagacatttatgctctgagcagcaaggaccattgggatggaggtgggcacaaagactgctgcttccagggtgtgcggccctggccgtgtgtctgacatcccataaatgtgtgtgtggtgtgactacgggcaccacaaactccgcagccttgcctctcttttctctgtggctgggctggctgcaccatgggcagggttgaggactgccccccaccccgcccaagccaatgcagacactgacctcaagaccagccacaccaagtctgtgcactgcccaccacccccttcnacccctcctacaccatgctcctgggcctggggcctccttgcctggcttcttcctccagctatcctcagggaagctggagattcaagtcatgccccagaagcaaggtgtaagcatgggggcgtggggaagagggcaggagctgaagttccaggggagcccaggacccctggggacctgtacactagcaggatgggtcttgggagttggcatggggagattgtaagggctgtatctccgcgattactggtactggtgctccacccataggggccctgttctctntggggtcccacactgnggtcatgagagctagttctcatgagagcagnacccctaggtctggtcctgccagcctgggatgggggtcaatgtatgctacacatcttgggctcacaagtgaggctgtggaggccaggaggttcaagtatggagggtaggagtgcaacccaggagcaacgctcaaggtggccgagatgcagggaggattgtggcgatccggttgcacactggcctctgtggaggtcagggaggtgggaaggtgggtgggcctgaactcaggcagcccttcagtggcttcttcaggcctaggataaccctggccaggccccatggtcctgctctgggtcagctgtcagggagacctcccttcagcctgagccaagctgcattgggaggagaaggcagggtgagggatctgggagagcaggatgttgagatatcctgaccctctgcttcctagcctgatgatggggaacacagagccacccgctatgagcacaggccgggggtggaaggcccagtagagctgcccttccccagatggaagcttcctccaaccttcagtttggccagtgggtgggtttgggcatctgtgcccctggtggcctccaaatccttcctgggattcccccaaacccacactgatgcgaagctgttcttgaccctcccatagcatcaactcagttcagctcaaagctagaaacaccaaggtctttgaaaatgtttattggctcaggatagcttcagcatccaatctgcgaaggcccctgatggagctatttcttcctagtatcaggagcaattgagacccctcaggagtttccacactgctgtggacgggatagccagggcagacctgcatcccagcgcaagcctagatccttgaaagcaatgtcaggtgtggcagtggggaagccatggaggctgggaagggcaaagtgtggagagaggagtgaccgggactggagccagggtctggggagagcaacagcaccaggcttttcctggtagttggattggtacattcactgctgccaggtacccagagatgtcatctctctccaggtagagcatcaccagctcctgtggccttgtagatgactctgtacctcagtgaagagtgcaggcaagtagagtgatggggtcagtgtccatccagtttacgctgagtcagtccatacagcaagacacctggcacttggcaggtactcctggatgttgatgagcaaggaagagcaacggccctgtcagctggcagtggtcctcacagccttcatcccaggtctgcctacgtgggagatctcatcagaaacaggaacggggatctgtctgtgcttgcaggaaagtccatttgtttttctccaagttaggtctcatctacagctcttagcttctcagtaaagaggatactctcccaaccagccaaggaataaaagctgatctgtatgtagggcagaagtgtggcaaatgcatcaggaaccggttagaacagaacagagaaaccctgactgtctacagattccaactttaatagcaagcctgtggagttacacaaacctgtgttaaaacatgtaatttttatggatttcatctcccgttgtggatcaatttggaaaaaccaaaatatgtaattttaaaaaactaaaacacatcctggtagtcccagtgatgtgtaaatgagagagaagaatagacaggcttccaaaccctgggaagaaagctgcttaattatgtgaacatcttataatgaagtctcttgcagctaaaattagattttgagtgcatgaatctgtgataatgtttgcatatcagaatgcattctccccttaaaagtagcagtagccacttggttcttagggggccccaagaggagaggagaagtgctgaggttgatgttacgactgcaagaattcttgggacacaggtttgttttctgctgacttgctcggaaacccattggaggtatctgaaatgtgatgactccaaaggggttcatttcactatagggagaaattgattcgtctgacttcctatttatcaccactcaatattgggtgagttggtctgaacaaggtggggataaagtagagtggaaataatgtagagtcgtcagactgaaaggccaggttgtagtcccagctcttatctgccatcttggacaaagcttttcccatctccagtctcagtttcccatccataaaatgggggaagtggtaggtcttgctgattgcatccacattcattcctccatttcctttcccagcaaccccccatttctgtttgggaattcatatgatctgccagagcctctccaggggtggaatacatgtcctggactaagccaatgacaccttccatctttccagctatggtgactgggttaggtatgatcttgtgagttaagacaatgaagccagagggaatttcaagacttatgggaatgctgggtagaagctgttttaattcccctgttgaatgtgaaaaaggtagtagtattcctgggtctttatgatgaccaccttgggccttgggatcatgaccaggaatcacgtgaagctgacaccactgaagggagagttgagaggcagaaagagatcaagtccttggtgaaattgtttaagtacaggatcaagccttgcttgagattggccttacctctggactttttttgttatatgagctaataaattctgtttattgtttaa

SEQ ID NO: 63340 - DNA, 5864 bp, Homo sapiens
  misc_feature (2880)..(2880): n is a, c, g, or t
  misc_feature (3162)..(3162): n is a, c, g, or t
  misc_feature (3178)..(3178): n is a, c, g, or t
  misc_feature (3209)..(3209): n is a, c, g, or t
gcggggggctgcgggctcggcgcccggggaaggcgggccatgggcgcgggtgcgggcgccccagccggccgcgatcgcgggatttctgcgccaggagatgaggggcggtagagccctggaatggagatgtccttgacgcctgggcagaggctgcagctgcaggaccctgtggccactggagataagtaatggtgccatttgaacacctactggaaacggggcaggaacagtgagtgaccccaggcgagcacaggcaggtgccaggagccaggatgcaaggatgacgcctccggaggccctggcctcactcccacctgggcgctaggagccatcccggggctccagccaggagccctgctgcccaggggcatggccaaacctttcttccgactccagaagtttctccgccgaacacagttcctgctgttcttcctcacggctgcctacctgatgaccggcagcctgctgctgctgcagcgggtccgcgtggctctcccacagggcccccgggcacccggccccctgcagaccttgccagtggccgccgtggcgctgggcgtgggcttgctggacagcagagccctgcacgaccctcgagtcagcccagagctgctgctgggtgtggacatgctgcagagccccctgacccggccccggcccggcccccgctggctccggagccgcaactcggagctgcgtcagttgcgtcgccgctggttccaccacttcatgagtgactcccagggaccgcccgccctgggccccgaggctgccaggcccgccatccacagccgaggcacctacattggatgcttcagtgacgatggccatgagaggactctgaaaggagctgtgttttatgacttgagaaagatgactgtctcccactgccaggatgcgtgtgctgagcggtcctatgtctacgccggcttggaggccggggcggagtgttactgcgggaaccggctgccagcggtgagcgtggggctggaagagtgtaaccatgagtgcaaaggcgagaagggctctgtgtgcggggctgtggaccggctctccgtgtaccgtgtggacgagctgcagccgggctccaggaagcggcggaccgccacctaccgcggatgcttccgactgccagagaacatcacacatgccttccccagctccctgatacaggccaatgtgaccgtggggacttgctcgggcttttgttcccagaaagagttccccttggccattctcaggggctgggaatgctactgtgcttaccctaccccccggttcaacctgcgggatgccatggacagctcagtatgtggccaggaccctgaggcacagaggctggcagaatactgtgaggtctaccagacacctgtgcaagacactcgttgtacagacaggaggttcctgcctaacaaatccaaagtgtttgtggctttgtcaagcttcccaggagccgggaacacgtgggcacggcacctcattgagcatgccactggcttctatacagggagctactactttgatggaaccctctacaacaaagggttcaagggcgaaaaggaccactggcggagccgacgcaccatctgtgtcaaaacccacgagagtggcaggagggagattgagatgtttgattcagccatcctgctaatccggaacccatacaggtccctggtggcagaattcaacagaaaatgtgccgggcacctgggatatgcagctgaccgcaactggaagagcaaagagtggccggactttgtcaacagctacgcctcgtggtggtcctcgcacgtcctggactggctcaagtacgggaagcggctgctggtggtgcactacgaggagctgcggcgcagcctggtgcccacgttacgggagatggtggccttcctcaacgtgtctgtgagcgaggagcggctgctctgcgtggagaacaacaaggagggcagcttccggcggcgcggccggcgctcccacgaccctgagcccttcaccccggagatgaaagacttgatcaatggctacatccggacggtggaccaagccctgcgtgaccacaactggacggggctgcccagggagtatgtgcccagatgataggcctggcccacgccgccgcccccgctgagtgacgcaatcgcaccacggggctgcgctccccactctgatgctcaggcccgtggcctcactgggacgaacggtgggtggggggctcaccctggtgctgcctcccgcacaaggagacctggacacaacagacacacatcacaaggcgaacacaaatggacacacatacctggccacgaacccacacctcctcagacactcagacaccactccaggctcatagccccgtcttgatgcagagaagccacccacgtggggtgtgccaggcacccccagatacaaatgcagccacgcacagacgtaacacacaggtgccaggccgtgtgctcctggaggctggctggctgtctctctcacacagatacacgtgcgctccctgggatccgggaggccctgggcttcctgtgtgtagccctggcatagacttgctcgtcagggtgttcgactctgggatgctgggccgggcagacatttatgctctgagcagcaaggaccattgggatggaggtgggcacaaagactgctgcttccagggtgtgcggccctggccgtgtgtctgacatcccataaatgtgtgtgtggtgtgactacgggcaccacaaactccgcagccttgcctctcttttctctgtggctgggctggctgcaccatgggcagggttgaggactgccccccaccccgcccaagccaatgcagacactgacctcaagaccagccacaccaagtctgtgcactgcccaccacccccttcnacccctcctacaccatgctcctgggcctggggcctccttgcctggcttcttcctccagctatcctcagggaagctggagattcaagtcatgccccagaagcaaggtgtaagcatgggggcgtggggaagagggcaggagctgaagttccaggggagcccaggacccctggggacctgtacactagcaggatgggtcttgggagttggcatggggagattgtaagggctgtatctccgcgattactggtactggtgctccacccataggggccctgttctctntggggtcccacactgnggtcatgagagctagttctcatgagagcagnacccctaggtctggtcctgccagcctgggatgggggtcaatgtatgctacacatcttgggctcacaagtgaggctgtggaggccaggaggttcaagtatggagggtaggagtgcaacccaggagcaacgctcaaggtggccgagatgcagggaggattgtggcgatccggttgcacactggcctctgtggaggtcagggaggtgggaaggtgggtgggcctgaactcaggcagcccttcagtggcttcttcaggcctaggataaccctggccaggccccatggtcctgctctgggtcagctgtcagggagacctcccttcagcctgagccaagctgcattgggaggagaaggcagggtgagggatctgggagagcaggatgttgagatatcctgaccctctgcttcctagcctgatgatggggaacacagagccacccgctatgagcacaggccgggggtggaaggcccagtagagctgcccttccccagatggaagcttcctccaaccttcagtttggccagtgggtgggtttgggcatctgtgcccctggtggcctccaaatccttcctgggattcccccaaacccacactgatgcgaagctgttcttgaccctcccatagcatcaactcagttcagctcaaagctagaaacaccaaggtctttgaaaatgtttattggctcaggatagcttcagcatccaatctgcgaaggcccctgatggagctatttcttcctagtatcaggagcaattgagacccctcaggagtttccacactgctgtggacgggatagccagggcagacctgcatcccagcgcaagcctagatccttgaaagcaatgtcaggtgtggcagtggggaagccatggaggctgggaagggcaaagtgtggagagaggagtgaccgggactggagccagggtctggggagagcaacagcaccaggcttttcctggtagttggattggtacattcactgctgccaggtacccagagatgtcatctctctccaggtagagcatcaccagctcctgtggccttgtagatgactctgtacctcagtgaagagtgcaggcaagtagagtgatggggtcagtgtccatccagtttacgctgagtcagtccatacagcaagacacctggcacttggcaggtactcctggatgttgatgagcaaggaagagcaacggccctgtcagctggcagtggtcctcacagccttcatcccaggtctgcctacgtgggagatctcatcagaaacaggaacggggatctgtctgtgcttgcaggaaagtccatttgtttttctccaagttaggtctcatctacagctcttagcttctcagtaaagaggatactctcccaaccagccaaggaataaaagctgatctgtatgtagggcagaagtgtggcaaatgcatcaggaaccggttagaacagaacagagaaaccctgactgtctacagattccaactttaatagcaagcctgtggagttacacaaacctgtgttaaaacatgtaatttttatggatttcatctcccgttgtggatcaatttggaaaaaccaaaatatgtaattttaaaaaactaaaacacatcctggtagtcccagtgatgtgtaaatgagagagaagaatagacaggcttccaaaccctgggaagaaagctgcttaattatgtgaacatcttataatgaagtctcttgcagctaaaattagattttgagtgcatgaatctgtgataatgtttgcatatcagaatgcattctccccttaaaagtagcagtagccacttggttcttagggggccccaagaggagaggagaagtgctgaggttgatgttacgactgcaagaattcttgggacacaggtttgttttctgctgacttgctcggaaacccattggaggtatctgaaatgtgatgactccaaaggggttcatttcactatagggagaaattgattcgtctgacttcctatttatcaccactcaatattgggtgagttggtctgaacaaggtggggataaagtagagtggaaataatgtagagtcgtcagactgaaaggccaggttgtagtcccagctcttatctgccatcttggacaaagcttttcccatctccagtctcagtttcccatccataaaatgggggaagtggtaggtcttgctgattgcatccacattcattcctccatttcctttcccagcaaccccccatttctgtttgggaattcatatgatctgccagagcctctccaggggtggaatacatgtcctggactaagccaatgacaccttccatctttccagctatggtgactgggttaggtatgatcttgtgagttaagacaatgaagccagagggaatttcaagacttatgggaatgctgggtagaagctgttttaattcccctgttgaatgtgaaaaaggtagtagtattcctgggtctttatgatgaccaccttgggccttgggatcatgaccaggaatcacgtgaagctgacaccactgaagggagagttgagaggcagaaagagatcaagtccttggtgaaattgtttaagtacaggatcaagccttgcttgagattggccttacctctggactttttttgttatatgagctaataaattctgtttattgtttaa

SEQ ID NO: 63341 - DNA, 5879 bp, Homo sapiens
  misc_feature (44)..(44): n is a, c, g, or t
  misc_feature (2895)..(2895): n is a, c, g, or t
  misc_feature (3177)..(3177): n is a, c, g, or t
  misc_feature (3193)..(3193): n is a, c, g, or t
  misc_feature (3224)..(3224): n is a, c, g, or t
agctcgcgttaagctgtgttcctggaccgcctgggggcctgtgncctatgcactgctccatctctcccatgtttcaggcttcatccatggctctggatttctgcgccaggagatgaggggcggtagagccctggaatggagatgtccttgacgcctgggcagaggctgcagctgcaggaccctgtggccactggagataagtaatggtgccatttgaacacctactggaaacggggcaggaacagtgagtgaccccaggcgagcacaggcaggtgccaggagccaggatgcaaggatgacgcctccggaggccctggcctcactcccacctgggcgctaggagccatcccggggctccagccaggagccctgctgcccaggggcatggccaaacctttcttccgactccagaagtttctccgccgaacacagttcctgctgttcttcctcacggctgcctacctgatgaccggcagcctgctgctgctgcagcgggtccgcgtggctctcccacagggcccccgggcacccggccccctgcagaccttgccagtggccgccgtggcgctgggcgtgggcttgctggacagcagagccctgcacgaccctcgagtcagcccagagctgctgctgggtgtggacatgctgcagagccccctgacccggccccggcccggcccccgctggctccggagccgcaactcggagctgcgtcagttgcgtcgccgctggttccaccacttcatgagtgactcccagggaccgcccgccctgggccccgaggctgccaggcccgccatccacagccgaggcacctacattggatgcttcagtgacgatggccatgagaggactctgaaaggagctgtgttttatgacttgagaaagatgactgtctcccactgccaggatgcgtgtgctgagcggtcctatgtctacgccggcttggaggccggggcggagtgttactgcgggaaccggctgccagcggtgagcgtggggctggaagagtgtaaccatgagtgcaaaggcgagaagggctctgtgtgcggggctgtggaccggctctccgtgtaccgtgtggacgagctgcagccgggctccaggaagcggcggaccgccacctaccgcggatgcttccgactgccagagaacatcacacatgccttccccagctccctgatacaggccaatgtgaccgtggggacttgctcgggcttttgttcccagaaagagttccccttggccattctcaggggctgggaatgctactgtgcttaccctaccccccggttcaacctgcgggatgccatggacagctcagtatgtggccaggaccctgaggcacagaggctggcagaatactgtgaggtctaccagacacctgtgcaagacactcgttgtacagacaggaggttcctgcctaacaaatccaaagtgtttgtggctttgtcaagcttcccaggagccgggaacacgtgggcacggcacctcattgagcatgccactggcttctatacagggagctactactttgatggaaccctctacaacaaagggttcaagggcgaaaaggaccactggcggagccgacgcaccatctgtgtcaaaacccacgagagtggcaggagggagattgagatgtttgattcagccatcctgctaatccggaacccatacaggtccctggtggcagaattcaacagaaaatgtgccgggcacctgggatatgcagctgaccgcaactggaagagcaaagagtggccggactttgtcaacagctacgcctcgtggtggtcctcgcacgtcctggactggctcaagtacgggaagcggctgctggtggtgcactacgaggagctgcggcgcagcctggtgcccacgttacgggagatggtggccttcctcaacgtgtctgtgagcgaggagcggctgctctgcgtggagaacaacaaggagggcagcttccggcggcgcggccggcgctcccacgaccctgagcccttcaccccggagatgaaagacttgatcaatggctacatccggacggtggaccaagccctgcgtgaccacaactggacggggctgcccagggagtatgtgcccagatgataggcctggcccacgccgccgcccccgctgagtgacgcaatcgcaccacggggctgcgctccccactctgatgctcaggcccgtggcctcactgggacgaacggtgggtggggggctcaccctggtgctgcctcccgcacaaggagacctggacacaacagacacacatcacaaggcgaacacaaatggacacacatacctggccacgaacccacacctcctcagacactcagacaccactccaggctcatagccccgtcttgatgcagagaagccacccacgtggggtgtgccaggcacccccagatacaaatgcagccacgcacagacgtaacacacaggtgccaggccgtgtgctcctggaggctggctggctgtctctctcacacagatacacgtgcgctccctgggatccgggaggccctgggcttcctgtgtgtagccctggcatagacttgctcgtcagggtgttcgactctgggatgctgggccgggcagacatttatgctctgagcagcaaggaccattgggatggaggtgggcacaaagactgctgcttccagggtgtgcggccctggccgtgtgtctgacatcccataaatgtgtgtgtggtgtgactacgggcaccacaaactccgcagccttgcctctcttttctctgtggctgggctggctgcaccatgggcagggttgaggactgccccccaccccgcccaagccaatgcagacactgacctcaagaccagccacaccaagtctgtgcactgcccaccacccccttcnacccctcctacaccatgctcctgggcctggggcctccttgcctggcttcttcctccagctatcctcagggaagctggagattcaagtcatgccccagaagcaaggtgtaagcatgggggcgtggggaagagggcaggagctgaagttccaggggagcccaggacccctggggacctgtacactagcaggatgggtcttgggagttggcatggggagattgtaagggctgtatctccgcgattactggtactggtgctccacccataggggccctgttctctntggggtcccacactgnggtcatgagagctagttctcatgagagcagnacccctaggtctggtcctgccagcctgggatgggggtcaatgtatgctacacatcttgggctcacaagtgaggctgtggaggccaggaggttcaagtatggagggtaggagtgcaacccaggagcaacgctcaaggtggccgagatgcagggaggattgtggcgatccggttgcacactggcctctgtggaggtcagggaggtgggaaggtgggtgggcctgaactcaggcagcccttcagtggcttcttcaggcctaggataaccctggccaggccccatggtcctgctctgggtcagctgtcagggagacctcccttcagcctgagccaagctgcattgggaggagaaggcagggtgagggatctgggagagcaggatgttgagatatcctgaccctctgcttcctagcctgatgatggggaacacagagccacccgctatgagcacaggccgggggtggaaggcccagtagagctgcccttccccagatggaagcttcctccaaccttcagtttggccagtgggtgggtttgggcatctgtgcccctggtggcctccaaatccttcctgggattcccccaaacccacactgatgcgaagctgttcttgaccctcccatagcatcaactcagttcagctcaaagctagaaacaccaaggtctttgaaaatgtttattggctcaggatagcttcagcatccaatctgcgaaggcccctgatggagctatttcttcctagtatcaggagcaattgagacccctcaggagtttccacactgctgtggacgggatagccagggcagacctgcatcccagcgcaagcctagatccttgaaagcaatgtcaggtgtggcagtggggaagccatggaggctgggaagggcaaagtgtggagagaggagtgaccgggactggagccagggtctggggagagcaacagcaccaggcttttcctggtagttggattggtacattcactgctgccaggtacccagagatgtcatctctctccaggtagagcatcaccagctcctgtggccttgtagatgactctgtacctcagtgaagagtgcaggcaagtagagtgatggggtcagtgtccatccagtttacgctgagtcagtccatacagcaagacacctggcacttggcaggtactcctggatgttgatgagcaaggaagagcaacggccctgtcagctggcagtggtcctcacagccttcatcccaggtctgcctacgtgggagatctcatcagaaacaggaacggggatctgtctgtgcttgcaggaaagtccatttgtttttctccaagttaggtctcatctacagctcttagcttctcagtaaagaggatactctcccaaccagccaaggaataaaagctgatctgtatgtagggcagaagtgtggcaaatgcatcaggaaccggttagaacagaacagagaaaccctgactgtctacagattccaactttaatagcaagcctgtggagttacacaaacctgtgttaaaacatgtaatttttatggatttcatctcccgttgtggatcaatttggaaaaaccaaaatatgtaattttaaaaaactaaaacacatcctggtagtcccagtgatgtgtaaatgagagagaagaatagacaggcttccaaaccctgggaagaaagctgcttaattatgtgaacatcttataatgaagtctcttgcagctaaaattagattttgagtgcatgaatctgtgataatgtttgcatatcagaatgcattctccccttaaaagtagcagtagccacttggttcttagggggccccaagaggagaggagaagtgctgaggttgatgttacgactgcaagaattcttgggacacaggtttgttttctgctgacttgctcggaaacccattggaggtatctgaaatgtgatgactccaaaggggttcatttcactatagggagaaattgattcgtctgacttcctatttatcaccactcaatattgggtgagttggtctgaacaaggtggggataaagtagagtggaaataatgtagagtcgtcagactgaaaggccaggttgtagtcccagctcttatctgccatcttggacaaagcttttcccatctccagtctcagtttcccatccataaaatgggggaagtggtaggtcttgctgattgcatccacattcattcctccatttcctttcccagcaaccccccatttctgtttgggaattcatatgatctgccagagcctctccaggggtggaatacatgtcctggactaagccaatgacaccttccatctttccagctatggtgactgggttaggtatgatcttgtgagttaagacaatgaagccagagggaatttcaagacttatgggaatgctgggtagaagctgttttaattcccctgttgaatgtgaaaaaggtagtagtattcctgggtctttatgatgaccaccttgggccttgggatcatgaccaggaatcacgtgaagctgacaccactgaagggagagttgagaggcagaaagagatcaagtccttggtgaaattgtttaagtacaggatcaagccttgcttgagattggccttacctctggactttttttgttatatgagctaataaattctgtttattgtttaa

SEQ ID NO: 63342 - DNA, 5809 bp, Homo sapiens
  misc_feature (2825)..(2825): n is a, c, g, or t
  misc_feature (3107)..(3107): n is a, c, g, or t
  misc_feature (3123)..(3123): n is a, c, g, or t
  misc_feature (3154)..(3154): n is a, c, g, or t
cgttccgctaccaagagaggcttccggtcagcggagggtttgctccgtctcttggtgaacttgaacagaggcagaggcaaaagcaaaacatttctgcgccaggagatgaggggcggtagagccctggaatggagatgtccttgacgcctgggcagaggctgcagctgcaggaccctgtggccactggagataagtaatggtgccatttgaacacctactggaaacggggcaggaacagtgagtgaccccaggcgagcacaggcaggtgccaggagccaggatgcaaggatgacgcctccggaggccctggcctcactcccacctgggcgctaggagccatcccggggctccagccaggagccctgctgcccaggggcatggccaaacctttcttccgactccagaagtttctccgccgaacacagttcctgctgttcttcctcacggctgcctacctgatgaccggcagcctgctgctgctgcagcgggtccgcgtggctctcccacagggcccccgggcacccggccccctgcagaccttgccagtggccgccgtggcgctgggcgtgggcttgctggacagcagagccctgcacgaccctcgagtcagcccagagctgctgctgggtgtggacatgctgcagagccccctgacccggccccggcccggcccccgctggctccggagccgcaactcggagctgcgtcagttgcgtcgccgctggttccaccacttcatgagtgactcccagggaccgcccgccctgggccccgaggctgccaggcccgccatccacagccgaggcacctacattggatgcttcagtgacgatggccatgagaggactctgaaaggagctgtgttttatgacttgagaaagatgactgtctcccactgccaggatgcgtgtgctgagcggtcctatgtctacgccggcttggaggccggggcggagtgttactgcgggaaccggctgccagcggtgagcgtggggctggaagagtgtaaccatgagtgcaaaggcgagaagggctctgtgtgcggggctgtggaccggctctccgtgtaccgtgtggacgagctgcagccgggctccaggaagcggcggaccgccacctaccgcggatgcttccgactgccagagaacatcacacatgccttccccagctccctgatacaggccaatgtgaccgtggggacttgctcgggcttttgttcccagaaagagttccccttggccattctcaggggctgggaatgctactgtgcttaccctaccccccggttcaacctgcgggatgccatggacagctcagtatgtggccaggaccctgaggcacagaggctggcagaatactgtgaggtctaccagacacctgtgcaagacactcgttgtacagacaggaggttcctgcctaacaaatccaaagtgtttgtggctttgtcaagcttcccaggagccgggaacacgtgggcacggcacctcattgagcatgccactggcttctatacagggagctactactttgatggaaccctctacaacaaagggttcaagggcgaaaaggaccactggcggagccgacgcaccatctgtgtcaaaacccacgagagtggcaggagggagattgagatgtttgattcagccatcctgctaatccggaacccatacaggtccctggtggcagaattcaacagaaaatgtgccgggcacctgggatatgcagctgaccgcaactggaagagcaaagagtggccggactttgtcaacagctacgcctcgtggtggtcctcgcacgtcctggactggctcaagtacgggaagcggctgctggtggtgcactacgaggagctgcggcgcagcctggtgcccacgttacgggagatggtggccttcctcaacgtgtctgtgagcgaggagcggctgctctgcgtggagaacaacaaggagggcagcttccggcggcgcggccggcgctcccacgaccctgagcccttcaccccggagatgaaagacttgatcaatggctacatccggacggtggaccaagccctgcgtgaccacaactggacggggctgcccagggagtatgtgcccagatgataggcctggcccacgccgccgcccccgctgagtgacgcaatcgcaccacggggtcaccctggtgctgcctcccgcacaaggagacctggacacaacagacacacatcacaaggcgaacacaaatggacacacatacctggccacgaacccacacctcctcagacactcagacaccactccaggctcatagccccgtcttgatgcagagaagccacccacgtggggtgtgccaggcacccccagatacaaatgcagccacgcacagacgtaacacacaggtgccaggccgtgtgctcctggaggctggctggctgtctctctcacacagatacacgtgcgctccctgggatccgggaggccctgggcttcctgtgtgtagccctggcatagacttgctcgtcagggtgttcgactctgggatgctgggccgggcagacatttatgctctgagcagcaaggaccattgggatggaggtgggcacaaagactgctgcttccagggtgtgcggccctggccgtgtgtctgacatcccataaatgtgtgtgtggtgtgactacgggcaccacaaactccgcagccttgcctctcttttctctgtggctgggctggctgcaccatgggcagggttgaggactgccccccaccccgcccaagccaatgcagacactgacctcaagaccagccacaccaagtctgtgcactgcccaccacccccttcnacccctcctacaccatgctcctgggcctggggcctccttgcctggcttcttcctccagctatcctcagggaagctggagattcaagtcatgccccagaagcaaggtgtaagcatgggggcgtggggaagagggcaggagctgaagttccaggggagcccaggacccctggggacctgtacactagcaggatgggtcttgggagttggcatggggagattgtaagggctgtatctccgcgattactggtactggtgctccacccataggggccctgttctctntggggtcccacactgnggtcatgagagctagttctcatgagagcagnacccctaggtctggtcctgccagcctgggatgggggtcaatgtatgctacacatcttgggctcacaagtgaggctgtggaggccaggaggttcaagtatggagggtaggagtgcaacccaggagcaacgctcaaggtggccgagatgcagggaggattgtggcgatccggttgcacactggcctctgtggaggtcagggaggtgggaaggtgggtgggcctgaactcaggcagcccttcagtggcttcttcaggcctaggataaccctggccaggccccatggtcctgctctgggtcagctgtcagggagacctcccttcagcctgagccaagctgcattgggaggagaaggcagggtgagggatctgggagagcaggatgttgagatatcctgaccctctgcttcctagcctgatgatggggaacacagagccacccgctatgagcacaggccgggggtggaaggcccagtagagctgcccttccccagatggaagcttcctccaaccttcagtttggccagtgggtgggtttgggcatctgtgcccctggtggcctccaaatccttcctgggattcccccaaacccacactgatgcgaagctgttcttgaccctcccatagcatcaactcagttcagctcaaagctagaaacaccaaggtctttgaaaatgtttattggctcaggatagcttcagcatccaatctgcgaaggcccctgatggagctatttcttcctagtatcaggagcaattgagacccctcaggagtttccacactgctgtggacgggatagccagggcagacctgcatcccagcgcaagcctagatccttgaaagcaatgtcaggtgtggcagtggggaagccatggaggctgggaagggcaaagtgtggagagaggagtgaccgggactggagccagggtctggggagagcaacagcaccaggcttttcctggtagttggattggtacattcactgctgccaggtacccagagatgtcatctctctccaggtagagcatcaccagctcctgtggccttgtagatgactctgtacctcagtgaagagtgcaggcaagtagagtgatggggtcagtgtccatccagtttacgctgagtcagtccatacagcaagacacctggcacttggcaggtactcctggatgttgatgagcaaggaagagcaacggccctgtcagctggcagtggtcctcacagccttcatcccaggtctgcctacgtgggagatctcatcagaaacaggaacggggatctgtctgtgcttgcaggaaagtccatttgtttttctccaagttaggtctcatctacagctcttagcttctcagtaaagaggatactctcccaaccagccaaggaataaaagctgatctgtatgtagggcagaagtgtggcaaatgcatcaggaaccggttagaacagaacagagaaaccctgactgtctacagattccaactttaatagcaagcctgtggagttacacaaacctgtgttaaaacatgtaatttttatggatttcatctcccgttgtggatcaatttggaaaaaccaaaatatgtaattttaaaaaactaaaacacatcctggtagtcccagtgatgtgtaaatgagagagaagaatagacaggcttccaaaccctgggaagaaagctgcttaattatgtgaacatcttataatgaagtctcttgcagctaaaattagattttgagtgcatgaatctgtgataatgtttgcatatcagaatgcattctccccttaaaagtagcagtagccacttggttcttagggggccccaagaggagaggagaagtgctgaggttgatgttacgactgcaagaattcttgggacacaggtttgttttctgctgacttgctcggaaacccattggaggtatctgaaatgtgatgactccaaaggggttcatttcactatagggagaaattgattcgtctgacttcctatttatcaccactcaatattgggtgagttggtctgaacaaggtggggataaagtagagtggaaataatgtagagtcgtcagactgaaaggccaggttgtagtcccagctcttatctgccatcttggacaaagcttttcccatctccagtctcagtttcccatccataaaatgggggaagtggtaggtcttgctgattgcatccacattcattcctccatttcctttcccagcaaccccccatttctgtttgggaattcatatgatctgccagagcctctccaggggtggaatacatgtcctggactaagccaatgacaccttccatctttccagctatggtgactgggttaggtatgatcttgtgagttaagacaatgaagccagagggaatttcaagacttatgggaatgctgggtagaagctgttttaattcccctgttgaatgtgaaaaaggtagtagtattcctgggtctttatgatgaccaccttgggccttgggatcatgaccaggaatcacgtgaagctgacaccactgaagggagagttgagaggcagaaagagatcaagtccttggtgaaattgtttaagtacaggatcaagccttgcttgagattggccttacctctggactttttttgttatatgagctaataaattctgtttattgtttaa

SEQ ID NO: 63343 - DNA, 5755 bp, Homo sapiens
  misc_feature (2771)..(2771): n is a, c, g, or t
  misc_feature (3053)..(3053): n is a, c, g, or t
  misc_feature (3069)..(3069): n is a, c, g, or t
  misc_feature (3100)..(3100): n is a, c, g, or t
cgttccgctaccaagagaggcttccggtcagcggagggtttgctccgtctcttggtgaacttgaacagaggcagaggcaaaagcaaaacatttctgcgccaggagatgaggggcggtagagccctggaatggagatgtccttgacgcctgggcagaggctgcagctgcaggaccctgtggccactggagataagtaatggtgccatttgaacacctactggaaacggggcaggaacagtgagtgaccccaggcgagcacaggcaggtgccaggagccaggatgcaaggatgacgcctccggaggccctggcctcactcccacctgggcgctaggagccatcccggggctccagccaggagccctgctgcccaggggcatggccaaacctttcttccgactccagaagtttctccgccgaacacagttcctgctgttcttcctcacggctgcctacctgatgaccggcagcctgctgctgctgcagcgggtccgcgtggctctcccacagggcccccgggcacccggccccctgcagaccttgccagtggccgccgtggcgctgggcgtgggcttgctggacagcagagccctgcacgaccctcgagtcagcccagagctgctgctgggtgtggacatgctgcagagccccctgacccggccccggcccggcccccgctggctccggagccgcaactcggagctgcgtcagttgcgtcgccgctggttccaccacttcatgagtgactcccagggaccgcccgccctgggccccgaggctgccaggcccgccatccacagccgagcctatgtctacgccggcttggaggccggggcggagtgttactgcgggaaccggctgccagcggtgagcgtggggctggaagagtgtaaccatgagtgcaaaggcgagaagggctctgtgtgcggggctgtggaccggctctccgtgtaccgtgtggacgagctgcagccgggctccaggaagcggcggaccgccacctaccgcggatgcttccgactgccagagaacatcacacatgccttccccagctccctgatacaggccaatgtgaccgtggggacttgctcgggcttttgttcccagaaagagttccccttggccattctcaggggctgggaatgctactgtgcttaccctaccccccggttcaacctgcgggatgccatggacagctcagtatgtggccaggaccctgaggcacagaggctggcagaatactgtgaggtctaccagacacctgtgcaagacactcgttgtacagacaggaggttcctgcctaacaaatccaaagtgtttgtggctttgtcaagcttcccaggagccgggaacacgtgggcacggcacctcattgagcatgccactggcttctatacagggagctactactttgatggaaccctctacaacaaagggttcaagggcgaaaaggaccactggcggagccgacgcaccatctgtgtcaaaacccacgagagtggcaggagggagattgagatgtttgattcagccatcctgctaatccggaacccatacaggtccctggtggcagaattcaacagaaaatgtgccgggcacctgggatatgcagctgaccgcaactggaagagcaaagagtggccggactttgtcaacagctacgcctcgtggtggtcctcgcacgtcctggactggctcaagtacgggaagcggctgctggtggtgcactacgaggagctgcggcgcagcctggtgcccacgttacgggagatggtggccttcctcaacgtgtctgtgagcgaggagcggctgctctgcgtggagaacaacaaggagggcagcttccggcggcgcggccggcgctcccacgaccctgagcccttcaccccggagatgaaagacttgatcaatggctacatccggacggtggaccaagccctgcgtgaccacaactggacggggctgcccagggagtatgtgcccagatgataggcctggcccacgccgccgcccccgctgagtgacgcaatcgcaccacggggctgcgctccccactctgatgctcaggcccgtggcctcactgggacgaacggtgggtggggggctcaccctggtgctgcctcccgcacaaggagacctggacacaacagacacacatcacaaggcgaacacaaatggacacacatacctggccacgaacccacacctcctcagacactcagacaccactccaggctcatagccccgtcttgatgcagagaagccacccacgtggggtgtgccaggcacccccagatacaaatgcagccacgcacagacgtaacacacaggtgccaggccgtgtgctcctggaggctggctggctgtctctctcacacagatacacgtgcgctccctgggatccgggaggccctgggcttcctgtgtgtagccctggcatagacttgctcgtcagggtgttcgactctgggatgctgggccgggcagacatttatgctctgagcagcaaggaccattgggatggaggtgggcacaaagactgctgcttccagggtgtgcggccctggccgtgtgtctgacatcccataaatgtgtgtgtggtgtgactacgggcaccacaaactccgcagccttgcctctcttttctctgtggctgggctggctgcaccatgggcagggttgaggactgccccccaccccgcccaagccaatgcagacactgacctcaagaccagccacaccaagtctgtgcactgcccaccacccccttcnacccctcctacaccatgctcctgggcctggggcctccttgcctggcttcttcctccagctatcctcagggaagctggagattcaagtcatgccccagaagcaaggtgtaagcatgggggcgtggggaagagggcaggagctgaagttccaggggagcccaggacccctggggacctgtacactagcaggatgggtcttgggagttggcatggggagattgtaagggctgtatctccgcgattactggtactggtgctccacccataggggccctgttctctntggggtcccacactgnggtcatgagagctagttctcatgagagcagnacccctaggtctggtcctgccagcctgggatgggggtcaatgtatgctacacatcttgggctcacaagtgaggctgtggaggccaggaggttcaagtatggagggtaggagtgcaacccaggagcaacgctcaaggtggccgagatgcagggaggattgtggcgatccggttgcacactggcctctgtggaggtcagggaggtgggaaggtgggtgggcctgaactcaggcagcccttcagtggcttcttcaggcctaggataaccctggccaggccccatggtcctgctctgggtcagctgtcagggagacctcccttcagcctgagccaagctgcattgggaggagaaggcagggtgagggatctgggagagcaggatgttgagatatcctgaccctctgcttcctagcctgatgatggggaacacagagccacccgctatgagcacaggccgggggtggaaggcccagtagagctgcccttccccagatggaagcttcctccaaccttcagtttggccagtgggtgggtttgggcatctgtgcccctggtggcctccaaatccttcctgggattcccccaaacccacactgatgcgaagctgttcttgaccctcccatagcatcaactcagttcagctcaaagctagaaacaccaaggtctttgaaaatgtttattggctcaggatagcttcagcatccaatctgcgaaggcccctgatggagctatttcttcctagtatcaggagcaattgagacccctcaggagtttccacactgctgtggacgggatagccagggcagacctgcatcccagcgcaagcctagatccttgaaagcaatgtcaggtgtggcagtggggaagccatggaggctgggaagggcaaagtgtggagagaggagtgaccgggactggagccagggtctggggagagcaacagcaccaggcttttcctggtagttggattggtacattcactgctgccaggtacccagagatgtcatctctctccaggtagagcatcaccagctcctgtggccttgtagatgactctgtacctcagtgaagagtgcaggcaagtagagtgatggggtcagtgtccatccagtttacgctgagtcagtccatacagcaagacacctggcacttggcaggtactcctggatgttgatgagcaaggaagagcaacggccctgtcagctggcagtggtcctcacagccttcatcccaggtctgcctacgtgggagatctcatcagaaacaggaacggggatctgtctgtgcttgcaggaaagtccatttgtttttctccaagttaggtctcatctacagctcttagcttctcagtaaagaggatactctcccaaccagccaaggaataaaagctgatctgtatgtagggcagaagtgtggcaaatgcatcaggaaccggttagaacagaacagagaaaccctgactgtctacagattccaactttaatagcaagcctgtggagttacacaaacctgtgttaaaacatgtaatttttatggatttcatctcccgttgtggatcaatttggaaaaaccaaaatatgtaattttaaaaaactaaaacacatcctggtagtcccagtgatgtgtaaatgagagagaagaatagacaggcttccaaaccctgggaagaaagctgcttaattatgtgaacatcttataatgaagtctcttgcagctaaaattagattttgagtgcatgaatctgtgataatgtttgcatatcagaatgcattctccccttaaaagtagcagtagccacttggttcttagggggccccaagaggagaggagaagtgctgaggttgatgttacgactgcaagaattcttgggacacaggtttgttttctgctgacttgctcggaaacccattggaggtatctgaaatgtgatgactccaaaggggttcatttcactatagggagaaattgattcgtctgacttcctatttatcaccactcaatattgggtgagttggtctgaacaaggtggggataaagtagagtggaaataatgtagagtcgtcagactgaaaggccaggttgtagtcccagctcttatctgccatcttggacaaagcttttcccatctccagtctcagtttcccatccataaaatgggggaagtggtaggtcttgctgattgcatccacattcattcctccatttcctttcccagcaaccccccatttctgtttgggaattcatatgatctgccagagcctctccaggggtggaatacatgtcctggactaagccaatgacaccttccatctttccagctatggtgactgggttaggtatgatcttgtgagttaagacaatgaagccagagggaatttcaagacttatgggaatgctgggtagaagctgttttaattcccctgttgaatgtgaaaaaggtagtagtattcctgggtctttatgatgaccaccttgggccttgggatcatgaccaggaatcacgtgaagctgacaccactgaagggagagttgagaggcagaaagagatcaagtccttggtgaaattgtttaagtacaggatcaagccttgcttgagattggccttacctctggactttttttgttatatgagctaataaattctgtttattgtttaa

SEQ ID NO: 63344 - DNA, 5835 bp, Homo sapiens
  misc_feature (2825)..(2825): n is a, c, g, or t
  misc_feature (3107)..(3107): n is a, c, g, or t
  misc_feature (3123)..(3123): n is a, c, g, or t
  misc_feature (3154)..(3154): n is a, c, g, or t
  misc_feature (5815)..(5816): n is a, c, g, or t
cgttccgctaccaagagaggcttccggtcagcggagggtttgctccgtctcttggtgaacttgaacagaggcagaggcaaaagcaaaacatttctgcgccaggagatgaggggcggtagagccctggaatggagatgtccttgacgcctgggcagaggctgcagctgcaggaccctgtggccactggagataagtaatggtgccatttgaacacctactggaaacggggcaggaacagtgagtgaccccaggcgagcacaggcaggtgccaggagccaggatgcaaggatgacgcctccggaggccctggcctcactcccacctgggcgctaggagccatcccggggctccagccaggagccctgctgcccaggggcatggccaaacctttcttccgactccagaagtttctccgccgaacacagttcctgctgttcttcctcacggctgcctacctgatgaccggcagcctgctgctgctgcagcgggtccgcgtggctctcccacagggcccccgggcacccggccccctgcagaccttgccagtggccgccgtggcgctgggcgtgggcttgctggacagcagagccctgcacgaccctcgagtcagcccagagctgctgctgggtgtggacatgctgcagagccccctgacccggccccggcccggcccccgctggctccggagccgcaactcggagctgcgtcagttgcgtcgccgctggttccaccacttcatgagtgactcccagggaccgcccgccctgggccccgaggctgccaggcccgccatccacagccgaggcacctacattggatgcttcagtgacgatggccatgagaggactctgaaaggagctgtgttttatgacttgagaaagatgactgtctcccactgccaggatgcgtgtgctgagcggtcctatgtctacgccggcttggaggccggggcggagtgttactgcgggaaccggctgccagcggtgagcgtggggctggaagagtgtaaccatgagtgcaaaggcgagaagggctctgtgtgcggggctgtggaccggctctccgtgtaccgtgtggacgagctgcagccgggctccaggaagcggcggaccgccacctaccgcggatgcttccgactgccagagaacatcacacatgccttccccagctccctgatacaggccaatgtgaccgtggggacttgctcgggcttttgttcccagaaagagttccccttggccattctcaggggctgggaatgctactgtgcttaccctaccccccggttcaacctgcgggatgccatggacagctcagtatgtggccaggaccctgaggcacagaggctggcagaatactgtgaggtctaccagacacctgtgcaagacactcgttgtacagacaggaggttcctgcctaacaaatccaaagtgtttgtggctttgtcaagcttcccaggagccgggaacacgtgggcacggcacctcattgagcatgccactggcttctatacagggagctactactttgatggaaccctctacaacaaagggttcaagggcgaaaaggaccactggcggagccgacgcaccatctgtgtcaaaacccacgagagtggcaggagggagattgagatgtttgattcagccatcctgctaatccggaacccatacaggtccctggtggcagaattcaacagaaaatgtgccgggcacctgggatatgcagctgaccgcaactggaagagcaaagagtggccggactttgtcaacagctacgcctcgtggtggtcctcgcacgtcctggactggctcaagtacgggaagcggctgctggtggtgcactacgaggagctgcggcgcagcctggtgcccacgttacgggagatggtggccttcctcaacgtgtctgtgagcgaggagcggctgctctgcgtggagaacaacaaggagggcagcttccggcggcgcggccggcgctcccacgaccctgagcccttcaccccggagatgaaagacttgatcaatggctacatccggacggtggaccaagccctgcgtgaccacaactggacggggctgcccagggagtatgtgcccagatgataggcctggcccacgccgccgcccccgctgagtgacgcaatcgcaccacggggtcaccctggtgctgcctcccgcacaaggagacctggacacaacagacacacatcacaaggcgaacacaaatggacacacatacctggccacgaacccacacctcctcagacactcagacaccactccaggctcatagccccgtcttgatgcagagaagccacccacgtggggtgtgccaggcacccccagatacaaatgcagccacgcacagacgtaacacacaggtgccaggccgtgtgctcctggaggctggctggctgtctctctcacacagatacacgtgcgctccctgggatccgggaggccctgggcttcctgtgtgtagccctggcatagacttgctcgtcagggtgttcgactctgggatgctgggccgggcagacatttatgctctgagcagcaaggaccattgggatggaggtgggcacaaagactgctgcttccagggtgtgcggccctggccgtgtgtctgacatcccataaatgtgtgtgtggtgtgactacgggcaccacaaactccgcagccttgcctctcttttctctgtggctgggctggctgcaccatgggcagggttgaggactgccccccaccccgcccaagccaatgcagacactgacctcaagaccagccacaccaagtctgtgcactgcccaccacccccttcnacccctcctacaccatgctcctgggcctggggcctccttgcctggcttcttcctccagctatcctcagggaagctggagattcaagtcatgccccagaagcaaggtgtaagcatgggggcgtggggaagagggcaggagctgaagttccaggggagcccaggacccctggggacctgtacactagcaggatgggtcttgggagttggcatggggagattgtaagggctgtatctccgcgattactggtactggtgctccacccataggggccctgttctctntggggtcccacactgnggtcatgagagctagttctcatgagagcagnacccctaggtctggtcctgccagcctgggatgggggtcaatgtatgctacacatcttgggctcacaagtgaggctgtggaggccaggaggttcaagtatggagggtaggagtgcaacccaggagcaacgctcaaggtggccgagatgcagggaggattgtggcgatccggttgcacactggcctctgtggaggtcagggaggtgggaaggtgggtgggcctgaactcaggcagcccttcagtggcttcttcaggcctaggataaccctggccaggccccatggtcctgctctgggtcagctgtcagggagacctcccttcagcctgagccaagctgcattgggaggagaaggcagggtgagggatctgggagagcaggatgttgagatatcctgaccctctgcttcctagcctgatgatggggaacacagagccacccgctatgagcacaggccgggggtggaaggcccagtagagctgcccttccccagatggaagcttcctccaaccttcagtttggccagtgggtgggtttgggcatctgtgcccctggtggcctccaaatccttcctgggattcccccaaacccacactgatgcgaagctgttcttgaccctcccatagcatcaactcagttcagctcaaagctagaaacaccaaggtctttgaaaatgtttattggctcaggatagcttcagcatccaatctgcgaaggcccctgatggagctatttcttcctagtatcaggagcaattgagacccctcaggagtttccacactgctgtggacgggatagccagggcagacctgcatcccagcgcaagcctagatccttgaaagcaatgtcaggtgtggcagtggggaagccatggaggctgggaagggcaaagtgtggagagaggagtgaccgggactggagccagggtctggggagagcaacagcaccaggcttttcctggtagttggattggtacattcactgctgccaggtacccagagatgtcatctctctccaggtagagcatcaccagctcctgtggccttgtagatgactctgtacctcagtgaagagtgcaggcaagtagagtgatggggtcagtgtccatccagtttacgctgagtcagtccatacagcaagacacctggcacttggcaggtactcctggatgttgatgagcaaggaagagcaacggccctgtcagctggcagtggtcctcacagccttcatcccaggtctgcctacgtgggagatctcatcagaaacaggaacggggatctgtctgtgcttgcaggaaagtccatttgtttttctccaagttaggtctcatctacagctcttagcttctcagtaaagaggatactctcccaaccagccaaggaataaaagctgatctgtatgtagggcagaagtgtggcaaatgcatcaggaaccggttagaacagaacagagaaaccctgactgtctacagattccaactttaatagcaagcctgtggagttacacaaacctgtgttaaaacatgtaatttttatggatttcatctcccgttgtggatcaatttggaaaaaccaaaatatgtaattttaaaaaactaaaacacatcctggtagtcccagtgatgtgtaaatgagagagaagaatagacaggcttccaaaccctgggaagaaagctgcttaattatgtgaacatcttataatgaagtctcttgcagctaaaattagattttgagtgcatgaatctgtgataatgtttgcatatcagaatgcattctccccttaaaagtagcagtagccacttggttcttagggggccccaagaggagaggagaagtgctgaggttgatgttacgactgcaagaattcttgggacacaggtttgttttctgctgacttgctcggaaacccattggaggtatctgaaatgtgatgactccaaaggggttcatttcactatagggagaaattgattcgtctgacttcctatttatcaccactcaatattgggtgagttggtctgaacaaggtggggataaagtagagtggaaataatgtagagtcgtcagactgaaaggccaggttgtagtcccagctcttatctgccatcttggacaaagcttttcccatctccagtctcagtttcccatccataaaatgggggaagtggtaggtcttgctgattgcatccacattcattcctccatttcctttcccagcaaccccccatttctgtttgggaattcatatgatctgccagagcctctccaggggtggaatacatgtcctggactaagccaatgacaccttccatctttccagctatggtgactgggttaggtatgatcttgtgagttaagacaatgaagccagagggaatttcaagacttatgggaatgctgggtagaagctgttttaattcccctgttgaatgtgaaaaaggtagtagtattcctgggtctttatgatgaccaccttgggccttgggatcatgaccaggaatcacgtgaagctgacaccactgaagggagagttgagaggcagaaagagatcaagtccttggtgaaattgtttaagtacaggatcaagccttgcttgagattggccttacctctggactttttttgttatatgagctaataaattctgtttattgtttaaaaaaannctgcccgaatttgcacgag

SEQ ID NO: 63345 - DNA, 5830 bp, Homo sapiens
  misc_feature (2825)..(2825): n is a, c, g, or t
  misc_feature (3107)..(3107): n is a, c, g, or t
  misc_feature (3123)..(3123): n is a, c, g, or t
  misc_feature (3154)..(3154): n is a, c, g, or t
cgttccgctaccaagagaggcttccggtcagcggagggtttgctccgtctcttggtgaacttgaacagaggcagaggcaaaagcaaaacatttctgcgccaggagatgaggggcggtagagccctggaatggagatgtccttgacgcctgggcagaggctgcagctgcaggaccctgtggccactggagataagtaatggtgccatttgaacacctactggaaacggggcaggaacagtgagtgaccccaggcgagcacaggcaggtgccaggagccaggatgcaaggatgacgcctccggaggccctggcctcactcccacctgggcgctaggagccatcccggggctccagccaggagccctgctgcccaggggcatggccaaacctttcttccgactccagaagtttctccgccgaacacagttcctgctgttcttcctcacggctgcctacctgatgaccggcagcctgctgctgctgcagcgggtccgcgtggctctcccacagggcccccgggcacccggccccctgcagaccttgccagtggccgccgtggcgctgggcgtgggcttgctggacagcagagccctgcacgaccctcgagtcagcccagagctgctgctgggtgtggacatgctgcagagccccctgacccggccccggcccggcccccgctggctccggagccgcaactcggagctgcgtcagttgcgtcgccgctggttccaccacttcatgagtgactcccagggaccgcccgccctgggccccgaggctgccaggcccgccatccacagccgaggcacctacattggatgcttcagtgacgatggccatgagaggactctgaaaggagctgtgttttatgacttgagaaagatgactgtctcccactgccaggatgcgtgtgctgagcggtcctatgtctacgccggcttggaggccggggcggagtgttactgcgggaaccggctgccagcggtgagcgtggggctggaagagtgtaaccatgagtgcaaaggcgagaagggctctgtgtgcggggctgtggaccggctctccgtgtaccgtgtggacgagctgcagccgggctccaggaagcggcggaccgccacctaccgcggatgcttccgactgccagagaacatcacacatgccttccccagctccctgatacaggccaatgtgaccgtggggacttgctcgggcttttgttcccagaaagagttccccttggccattctcaggggctgggaatgctactgtgcttaccctaccccccggttcaacctgcgggatgccatggacagctcagtatgtggccaggaccctgaggcacagaggctggcagaatactgtgaggtctaccagacacctgtgcaagacactcgttgtacagacaggaggttcctgcctaacaaatccaaagtgtttgtggctttgtcaagcttcccaggagccgggaacacgtgggcacggcacctcattgagcatgccactggcttctatacagggagctactactttgatggaaccctctacaacaaagggttcaagggcgaaaaggaccactggcggagccgacgcaccatctgtgtcaaaacccacgagagtggcaggagggagattgagatgtttgattcagccatcctgctaatccggaacccatacaggtccctggtggcagaattcaacagaaaatgtgccgggcacctgggatatgcagctgaccgcaactggaagagcaaagagtggccggactttgtcaacagctacgcctcgtggtggtcctcgcacgtcctggactggctcaagtacgggaagcggctgctggtggtgcactacgaggagctgcggcgcagcctggtgcccacgttacgggagatggtggccttcctcaacgtgtctgtgagcgaggagcggctgctctgcgtggagaacaacaaggagggcagcttccggcggcgcggccggcgctcccacgaccctgagcccttcaccccggagatgaaagacttgatcaatggctacatccggacggtggaccaagccctgcgtgaccacaactggacggggctgcccagggagtatgtgcccagatgataggcctggcccacgccgccgcccccgctgagtgacgcaatcgcaccacggggtcaccctggtgctgcctcccgcacaaggagacctggacacaacagacacacatcacaaggcgaacacaaatggacacacatacctggccacgaacccacacctcctcagacactcagacaccactccaggctcatagccccgtcttgatgcagagaagccacccacgtggggtgtgccaggcacccccagatacaaatgcagccacgcacagacgtaacacacaggtgccaggccgtgtgctcctggaggctggctggctgtctctctcacacagatacacgtgcgctccctgggatccgggaggccctgggcttcctgtgtgtagccctggcatagacttgctcgtcagggtgttcgactctgggatgctgggccgggcagacatttatgctctgagcagcaaggaccattgggatggaggtgggcacaaagactgctgcttccagggtgtgcggccctggccgtgtgtctgacatcccataaatgtgtgtgtggtgtgactacgggcaccacaaactccgcagccttgcctctcttttctctgtggctgggctggctgcaccatgggcagggttgaggactgccccccaccccgcccaagccaatgcagacactgacctcaagaccagccacaccaagtctgtgcactgcccaccacccccttcnacccctcctacaccatgctcctgggcctggggcctccttgcctggcttcttcctccagctatcctcagggaagctggagattcaagtcatgccccagaagcaaggtgtaagcatgggggcgtggggaagagggcaggagctgaagttccaggggagcccaggacccctggggacctgtacactagcaggatgggtcttgggagttggcatggggagattgtaagggctgtatctccgcgattactggtactggtgctccacccataggggccctgttctctntggggtcccacactgnggtcatgagagctagttctcatgagagcagnacccctaggtctggtcctgccagcctgggatgggggtcaatgtatgctacacatcttgggctcacaagtgaggctgtggaggccaggaggttcaagtatggagggtaggagtgcaacccaggagcaacgctcaaggtggccgagatgcagggaggattgtggcgatccggttgcacactggcctctgtggaggtcagggaggtgggaaggtgggtgggcctgaactcaggcagcccttcagtggcttcttcaggcctaggataaccctggccaggccccatggtcctgctctgggtcagctgtcagggagacctcccttcagcctgagccaagctgcattgggaggagaaggcagggtgagggatctgggagagcaggatgttgagatatcctgaccctctgcttcctagcctgatgatggggaacacagagccacccgctatgagcacaggccgggggtggaaggcccagtagagctgcccttccccagatggaagcttcctccaaccttcagtttggccagtgggtgggtttgggcatctgtgcccctggtggcctccaaatccttcctgggattcccccaaacccacactgatgcgaagctgttcttgaccctcccatagcatcaactcagttcagctcaaagctagaaacaccaaggtctttgaaaatgtttattggctcaggatagcttcagcatccaatctgcgaaggcccctgatggagctatttcttcctagtatcaggagcaattgagacccctcaggagtttccacactgctgtggacgggatagccagggcagacctgcatcccagcgcaagcctagatccttgaaagcaatgtcaggtgtggcagtggggaagccatggaggctgggaagggcaaagtgtggagagaggagtgaccgggactggagccagggtctggggagagcaacagcaccaggcttttcctggtagttggattggtacattcactgctgccaggtacccagagatgtcatctctctccaggtagagcatcaccagctcctgtggccttgtagatgactctgtacctcagtgaagagtgcaggcaagtagagtgatggggtcagtgtccatccagtttacgctgagtcagtccatacagcaagacacctggcacttggcaggtactcctggatgttgatgagcaaggaagagcaacggccctgtcagctggcagtggtcctcacagccttcatcccaggtctgcctacgtgggagatctcatcagaaacaggaacggggatctgtctgtgcttgcaggaaagtccatttgtttttctccaagttaggtctcatctacagctcttagcttctcagtaaagaggatactctcccaaccagccaaggaataaaagctgatctgtatgtagggcagaagtgtggcaaatgcatcaggaaccggttagaacagaacagagaaaccctgactgtctacagattccaactttaatagcaagcctgtggagttacacaaacctgtgttaaaacatgtaatttttatggatttcatctcccgttgtggatcaatttggaaaaaccaaaatatgtaattttaaaaaactaaaacacatcctggtagtcccagtgatgtgtaaatgagagagaagaatagacaggcttccaaaccctgggaagaaagctgcttaattatgtgaacatcttataatgaagtctcttgcagctaaaattagattttgagtgcatgaatctgtgataatgtttgcatatcagaatgcattctccccttaaaagtagcagtagccacttggttcttagggggccccaagaggagaggagaagtgctgaggttgatgttacgactgcaagaattcttgggacacaggtttgttttctgctgacttgctcggaaacccattggaggtatctgaaatgtgatgactccaaaggggttcatttcactatagggagaaattgattcgtctgacttcctatttatcaccactcaatattgggtgagttggtctgaacaaggtggggataaagtagagtggaaataatgtagagtcgtcagactgaaaggccaggttgtagtcccagctcttatctgccatcttggacaaagcttttcccatctccagtctcagtttcccatccataaaatgggggaagtggtaggtcttgctgattgcatccacattcattcctccatttcctttcccagcaaccccccatttctgtttgggaattcatatgatctgccagagcctctccaggggtggaatacatgtcctggactaagccaatgacaccttccatctttccagctatggtgactgggttaggtatgatcttgtgagttaagacaatgaagccagagggaatttcaagacttatgggaatgctgggtagaagctgttttaattcccctgttgaatgtgaaaaaggtagtagtattcctgggtctttatgatgaccaccttgggccttgggatcatgaccaggaatcacgtgaagctgacaccactgaagggagagttgagaggcagaaagagatcaagtccttggtgaaattgtttaagtacaggatcaagccttgcttgagattggccttacctctggactttttttgttatatgagctaataaattctgtttattgtttaaaaacaacacaaacaaaaaaaa

SEQ ID NO: 63346 - DNA, 5485 bp, Homo sapiens
  misc_feature (2501)..(2501): n is a, c, g, or t
  misc_feature (2783)..(2783): n is a, c, g, or t
  misc_feature (2799)..(2799): n is a, c, g, or t
  misc_feature (2830)..(2830): n is a, c, g, or t
cgaggctgccaggcccgccatccacagccgaggcacctacattggatgcttcagtgacgatggccatgagaggactctgaaaggagctgtgttttatgacttgagaaagatgactgtctcccacagccaggatgcaaggatgacgcctccggaggccctggcctcactcccacctgggcgctaggagccatcccggggctccagccaggagccctgctgcccaggggcatggccaaacctttcttccgactccagaagtttctccgccgaacacagttcctgctgttcttcctcacggctgcctacctgatgaccggcagcctgctgctgctgcagcgggtccgcgtggctctcccacagggcccccgggcacccggccccctgcagaccttgccagtggccgccgtggcgctgggcgtgggcttgctggacagcagagccctgcacgaccctcgagtcagcccagagctgctgctgggtgtggacatgctgcagagccccctgacccggccccggcccggcccccgctggctccggagccgcaactcggagctgcgtcagttgcgtcgccgctggttccaccacttcatgagtgactcccagggaccgcccaagagtgtaaccatgagtgcaaaggcgagaagggctctgtgtgcggggctgtggaccggctctccgtgtaccgtgtggacgagctgcagccgggctccaggaagcggcggaccgccacctaccgcggatgcttccgactgccagagaacatcacacatgccttccccagctccctgatacaggccaatgtgaccgtggggacttgctcgggcttttgttcccagaaagagttccccttggccattctcaggggctgggaatgctactgtgcttaccctaccccccggttcaacctgcgggatgccatggacagctcagtatgtggccaggaccctgaggcacagaggctggcagaatactgtgaggtctaccagacacctgtgcaagacactcgttgtacagacaggaggttcctgcctaacaaatccaaagtgtttgtggctttgtcaagcttcccaggagccgggaacacgtgggcacggcacctcattgagcatgccactggcttctatacagggagctactactttgatggaaccctctacaacaaagggttcaagggcgaaaaggaccactggcggagccgacgcaccatctgtgtcaaaacccacgagagtggcaggagggagattgagatgtttgattcagccatcctgctaatccggaacccatacaggtccctggtggcagaattcaacagaaaatgtgccgggcacctgggatatgcagctgaccgcaactggaagagcaaagagtggccggactttgtcaacagctacgcctcgtggtggtcctcgcacgtcctggactggctcaagtacgggaagcggctgctggtggtgcactacgaggagctgcggcgcagcctggtgcccacgttacgggagatggtggccttcctcaacgtgtctgtgagcgaggagcggctgctctgcgtggagaacaacaaggagggcagcttccggcggcgcggccggcgctcccacgaccctgagcccttcaccccggagatgaaagacttgatcaatggctacatccggacggtggaccaagccctgcgtgaccacaactggacggggctgcccagggagtatgtgcccagatgataggcctggcccacgccgccgcccccgctgagtgacgcaatcgcaccacggggctgcgctccccactctgatgctcaggcccgtggcctcactgggacgaacggtgggtggggggctcaccctggtgctgcctcccgcacaaggagacctggacacaacagacacacatcacaaggcgaacacaaatggacacacatacctggccacgaacccacacctcctcagacactcagacaccactccaggctcatagccccgtcttgatgcagagaagccacccacgtggggtgtgccaggcacccccagatacaaatgcagccacgcacagacgtaacacacaggtgccaggccgtgtgctcctggaggctggctggctgtctctctcacacagatacacgtgcgctccctgggatccgggaggccctgggcttcctgtgtgtagccctggcatagacttgctcgtcagggtgttcgactctgggatgctgggccgggcagacatttatgctctgagcagcaaggaccattgggatggaggtgggcacaaagactgctgcttccagggtgtgcggccctggccgtgtgtctgacatcccataaatgtgtgtgtggtgtgactacgggcaccacaaactccgcagccttgcctctcttttctctgtggctgggctggctgcaccatgggcagggttgaggactgccccccaccccgcccaagccaatgcagacactgacctcaagaccagccacaccaagtctgtgcactgcccaccacccccttcnacccctcctacaccatgctcctgggcctggggcctccttgcctggcttcttcctccagctatcctcagggaagctggagattcaagtcatgccccagaagcaaggtgtaagcatgggggcgtggggaagagggcaggagctgaagttccaggggagcccaggacccctggggacctgtacactagcaggatgggtcttgggagttggcatggggagattgtaagggctgtatctccgcgattactggtactggtgctccacccataggggccctgttctctntggggtcccacactgnggtcatgagagctagttctcatgagagcagnacccctaggtctggtcctgccagcctgggatgggggtcaatgtatgctacacatcttgggctcacaagtgaggctgtggaggccaggaggttcaagtatggagggtaggagtgcaacccaggagcaacgctcaaggtggccgagatgcagggaggattgtggcgatccggttgcacactggcctctgtggaggtcagggaggtgggaaggtgggtgggcctgaactcaggcagcccttcagtggcttcttcaggcctaggataaccctggccaggccccatggtcctgctctgggtcagctgtcagggagacctcccttcagcctgagccaagctgcattgggaggagaaggcagggtgagggatctgggagagcaggatgttgagatatcctgaccctctgcttcctagcctgatgatggggaacacagagccacccgctatgagcacaggccgggggtggaaggcccagtagagctgcccttccccagatggaagcttcctccaaccttcagtttggccagtgggtgggtttgggcatctgtgcccctggtggcctccaaatccttcctgggattcccccaaacccacactgatgcgaagctgttcttgaccctcccatagcatcaactcagttcagctcaaagctagaaacaccaaggtctttgaaaatgtttattggctcaggatagcttcagcatccaatctgcgaaggcccctgatggagctatttcttcctagtatcaggagcaattgagacccctcaggagtttccacactgctgtggacgggatagccagggcagacctgcatcccagcgcaagcctagatccttgaaagcaatgtcaggtgtggcagtggggaagccatggaggctgggaagggcaaagtgtggagagaggagtgaccgggactggagccagggtctggggagagcaacagcaccaggcttttcctggtagttggattggtacattcactgctgccaggtacccagagatgtcatctctctccaggtagagcatcaccagctcctgtggccttgtagatgactctgtacctcagtgaagagtgcaggcaagtagagtgatggggtcagtgtccatccagtttacgctgagtcagtccatacagcaagacacctggcacttggcaggtactcctggatgttgatgagcaaggaagagcaacggccctgtcagctggcagtggtcctcacagccttcatcccaggtctgcctacgtgggagatctcatcagaaacaggaacggggatctgtctgtgcttgcaggaaagtccatttgtttttctccaagttaggtctcatctacagctcttagcttctcagtaaagaggatactctcccaaccagccaaggaataaaagctgatctgtatgtagggcagaagtgtggcaaatgcatcaggaaccggttagaacagaacagagaaaccctgactgtctacagattccaactttaatagcaagcctgtggagttacacaaacctgtgttaaaacatgtaatttttatggatttcatctcccgttgtggatcaatttggaaaaaccaaaatatgtaattttaaaaaactaaaacacatcctggtagtcccagtgatgtgtaaatgagagagaagaatagacaggcttccaaaccctgggaagaaagctgcttaattatgtgaacatcttataatgaagtctcttgcagctaaaattagattttgagtgcatgaatctgtgataatgtttgcatatcagaatgcattctccccttaaaagtagcagtagccacttggttcttagggggccccaagaggagaggagaagtgctgaggttgatgttacgactgcaagaattcttgggacacaggtttgttttctgctgacttgctcggaaacccattggaggtatctgaaatgtgatgactccaaaggggttcatttcactatagggagaaattgattcgtctgacttcctatttatcaccactcaatattgggtgagttggtctgaacaaggtggggataaagtagagtggaaataatgtagagtcgtcagactgaaaggccaggttgtagtcccagctcttatctgccatcttggacaaagcttttcccatctccagtctcagtttcccatccataaaatgggggaagtggtaggtcttgctgattgcatccacattcattcctccatttcctttcccagcaaccccccatttctgtttgggaattcatatgatctgccagagcctctccaggggtggaatacatgtcctggactaagccaatgacaccttccatctttccagctatggtgactgggttaggtatgatcttgtgagttaagacaatgaagccagagggaatttcaagacttatgggaatgctgggtagaagctgttttaattcccctgttgaatgtgaaaaaggtagtagtattcctgggtctttatgatgaccaccttgggccttgggatcatgaccaggaatcacgtgaagctgacaccactgaagggagagttgagaggcagaaagagatcaagtccttggtgaaattgtttaagtacaggatcaagccttgcttgagattggccttacctctggactttttttgttatatgagctaataaattctgtttattgtttaa

SEQ ID NO: 63347 - DNA, 4142 bp, Homo sapiens
  misc_feature (1158)..(1158): n is a, c, g, or t
  misc_feature (1440)..(1440): n is a, c, g, or t
  misc_feature (1456)..(1456): n is a, c, g, or t
  misc_feature (1487)..(1487): n is a, c, g, or t
gcccgcaactggaagaccaaagagtggccggactttgtcaacagctacgcctcgtggtggtcctcgcacgtcctggactggctcaagtacgggaagcggctgctggtggtgcactacgaggagctgcggcgcagcctggtgcccacgttacgggagatggtggccttcctcaacgtgtctgtgagcgaggagcggctgctctgcgtggagaacaacaaggagggcagcttccggcggcgcggccggcgctcccacgaccctgagcccttcaccccggagatgaaagacttgatcaatggctacatccggacggtggaccaagccctgcgtgaccacaactggacggggctgcccagggagtatgtgcccagatgataggcctggcccacgccgccgcccccgctgagtgacgcaatcgcaccacggggctgcgctccccactctgatgctcaggcccgtggcctcactgggacgaacggtgggtggggggctcaccctggtgctgcctcccgcacaaggagacctggacacaacagacacacatcacaaggcgaacacaaatggacacacatacctggccacgaacccacacctcctcagacactcagacaccactccaggctcatagccccgtcttgatgcagagaagccacccacgtggggtgtgccaggcacccccagatacaaatgcagccacgcacagacgtaacacacaggtgccaggccgtgtgctcctggaggctggctggctgtctctctcacacagatacacgtgcgctccctgggatccgggaggccctgggcttcctgtgtgtagccctggcatagacttgctcgtcagggtgttcgactctgggatgctgggccgggcagacatttatgctctgagcagcaaggaccattgggatggaggtgggcacaaagactgctgcttccagggtgtgcggccctggccgtgtgtctgacatcccataaatgtgtgtgtggtgtgactacgggcaccacaaactccgcagccttgcctctcttttctctgtggctgggctggctgcaccatgggcagggttgaggactgccccccaccccgcccaagccaatgcagacactgacctcaagaccagccacaccaagtctgtgcactgcccaccacccccttcnacccctcctacaccatgctcctgggcctggggcctccttgcctggcttcttcctccagctatcctcagggaagctggagattcaagtcatgccccagaagcaaggtgtaagcatgggggcgtggggaagagggcaggagctgaagttccaggggagcccaggacccctggggacctgtacactagcaggatgggtcttgggagttggcatggggagattgtaagggctgtatctccgcgattactggtactggtgctccacccataggggccctgttctctntggggtcccacactgnggtcatgagagctagttctcatgagagcagnacccctaggtctggtcctgccagcctgggatgggggtcaatgtatgctacacatcttgggctcacaagtgaggctgtggaggccaggaggttcaagtatggagggtaggagtgcaacccaggagcaacgctcaaggtggccgagatgcagggaggattgtggcgatccggttgcacactggcctctgtggaggtcagggaggtgggaaggtgggtgggcctgaactcaggcagcccttcagtggcttcttcaggcctaggataaccctggccaggccccatggtcctgctctgggtcagctgtcagggagacctcccttcagcctgagccaagctgcattgggaggagaaggcagggtgagggatctgggagagcaggatgttgagatatcctgaccctctgcttcctagcctgatgatggggaacacagagccacccgctatgagcacaggccgggggtggaaggcccagtagagctgcccttccccagatggaagcttcctccaaccttcagtttggccagtgggtgggtttgggcatctgtgcccctggtggcctccaaatccttcctgggattcccccaaacccacactgatgcgaagctgttcttgaccctcccatagcatcaactcagttcagctcaaagctagaaacaccaaggtctttgaaaatgtttattggctcaggatagcttcagcatccaatctgcgaaggcccctgatggagctatttcttcctagtatcaggagcaattgagacccctcaggagtttccacactgctgtggacgggatagccagggcagacctgcatcccagcgcaagcctagatccttgaaagcaatgtcaggtgtggcagtggggaagccatggaggctgggaagggcaaagtgtggagagaggagtgaccgggactggagccagggtctggggagagcaacagcaccaggcttttcctggtagttggattggtacattcactgctgccaggtacccagagatgtcatctctctccaggtagagcatcaccagctcctgtggccttgtagatgactctgtacctcagtgaagagtgcaggcaagtagagtgatggggtcagtgtccatccagtttacgctgagtcagtccatacagcaagacacctggcacttggcaggtactcctggatgttgatgagcaaggaagagcaacggccctgtcagctggcagtggtcctcacagccttcatcccaggtctgcctacgtgggagatctcatcagaaacaggaacggggatctgtctgtgcttgcaggaaagtccatttgtttttctccaagttaggtctcatctacagctcttagcttctcagtaaagaggatactctcccaaccagccaaggaataaaagctgatctgtatgtagggcagaagtgtggcaaatgcatcaggaaccggttagaacagaacagagaaaccctgactgtctacagattccaactttaatagcaagcctgtggagttacacaaacctgtgttaaaacatgtaatttttatggatttcatctcccgttgtggatcaatttggaaaaaccaaaatatgtaattttaaaaaactaaaacacatcctggtagtcccagtgatgtgtaaatgagagagaagaatagacaggcttccaaaccctgggaagaaagctgcttaattatgtgaacatcttataatgaagtctcttgcagctaaaattagattttgagtgcatgaatctgtgataatgtttgcatatcagaatgcattctccccttaaaagtagcagtagccacttggttcttagggggccccaagaggagaggagaagtgctgaggttgatgttacgactgcaagaattcttgggacacaggtttgttttctgctgacttgctcggaaacccattggaggtatctgaaatgtgatgactccaaaggggttcatttcactatagggagaaattgattcgtctgacttcctatttatcaccactcaatattgggtgagttggtctgaacaaggtggggataaagtagagtggaaataatgtagagtcgtcagactgaaaggccaggttgtagtcccagctcttatctgccatcttggacaaagcttttcccatctccagtctcagtttcccatccataaaatgggggaagtggtaggtcttgctgattgcatccacattcattcctccatttcctttcccagcaaccccccatttctgtttgggaattcatatgatctgccagagcctctccaggggtggaatacatgtcctggactaagccaatgacaccttccatctttccagctatggtgactgggttaggtatgatcttgtgagttaagacaatgaagccagagggaatttcaagacttatgggaatgctgggtagaagctgttttaattcccctgttgaatgtgaaaaaggtagtagtattcctgggtctttatgatgaccaccttgggccttgggatcatgaccaggaatcacgtgaagctgacaccactgaagggagagttgagaggcagaaagagatcaagtccttggtgaaattgtttaagtacaggatcaagccttgcttgagattggccttacctctggactttttttgttatatgagctaataaattctgtttattgtttaa

SEQ ID NO: 63348 - DNA, 440 bp, Homo sapiens
catgcctgcagtgcactgtaaggatccctgatctgccagagcctctccaggggtggaatacatgtcctggactaagccaatgacaccttccatctttccagctatggtgactgggttaggtatgatcttgtgagttaagacaatgaagccagagggaatttcaagacttatgggaatgctgggtagaagctgttttaattcccctgttgaatgtgaaaaaggtagtagtattcctgggtctttatgatgaccaccttgggccttgggatcatgaccaggaatcacgtgaagctgacaccactgaagggagagttgagaggcagaaagagatcaagtccttggtgaaattgtttaagtacaggatcaagccttgcttgagattggccttacctctggactttttttgttatatgagctaataaattctgtttattgtttaa

SEQ ID NO: 63349 - DNA, 226 bp, Homo sapiens
cgactggtcctatgtcatcccagacattttgccatttaactatcctgaagagccacttgtcatctgaaaatgtgccctcttgagatcaatagtgaacatcgtgtccttttccatctgggagagaaacattatccacactctctttccctctctaagtcactttatctccgattttttctaatgccaagataattaaaatttttaattggctttcttaagactttct

SEQ ID NO: 63350 - DNA, 336 bp, Homo sapiens
tagccacgtttacatgaaaattcctaatatttaaggggagatcgagaaacactgtttccttcccagagctcttctctgaattctacactcatatatccgacaggctactgaaatctccatttggatttctcacaggcacctcaaaagtaatatgtccaaaactgaacccctgatgttttttccctctaaaatcgattcctcctgcaatctgtcccatctcagtaaaggtcaccgccattccccagctcatgagatcaaaacccaagggttgccgcccaggattggcatagtcgaagctgatttttatccccttcgccattaacaactagaaaacta

SEQ ID NO: 63351 - DNA, 342 bp, Homo sapiens
gtgagaagcagcccctcattggcccgctatagagaatcataaagctcaactggcaagagattgggcagggaaaatgtcttctaattagaattctaccatacaacaagaagtaatagtattaacaatactttacacgtggaatcttttgcatctatctacaaatctgcaaggaagacataaagtattatttgagatgtcaggattgatggctgtgaattcatgattatgtccctaggagactacatgctacatctctgtaccacacccccatgatgagcatagagtcctacaccaaagaacttcaccacgttatgtgtgcaataaattttaaagcgctagaat

SEQ ID NO: 63352 - DNA, 2589 bp, Homo sapiens
cgcccgcgcgcgggctcaactttgtagagcgaggggccaacttggcagagcgcgcggccagctttgcagagagcgccctccagggactatgcgtgcggggacacgggtcgctttgggctcttccacccctgcggagcgcactatcccgagccaggggcggtgcaagccccgcccggccctacccagggcggctcctccctccgcagcgccgagacttttagtttcgctttcgctaaaggggccccagacccttgctgcggagcgacggagagagactgtgccagtcccagccgccctaccgccgtgggaacgatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgcttaattcctaa

SEQ ID NO: 63353 - DNA, 2604 bp, Homo sapiens
gtggggtaaaacagcagagatcaatgagatcagagcacaccctcggaggaagggatacatgacaaatgcctgaacggagagagggagtgaactgtgcaaacacacagccaggagttttccaaggacagggaggagaaagtataaggcctgctgtaccctcgatgcaaaacatgagaaagccgactgtgccagtcccagccgccctaccgccgtgggaacgatgctgtaatggactgtgttggttggcctccaggcaggaagtggcacttggaaaagaacaccagctgcggtggtagcagtgggatttgtgcttcttatgttacccagatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgcttaattcctaa

SEQ ID NO: 63354 - DNA, 2663 bp, Homo sapiens
cgcccgcgcgcgggctcaactttgtagagcgaggggccaacttggcagagcgcgcggccagctttgcagagagcgccctccagggactatgcgtgcggggacacgggtcgctttgggctcttccacccctgcggagcgcactatcccgagccaggggcggtgcaagccccgcccggccctacccagggcggctcctccctccgcagcgccgagacttttagtttcgctttcgctaaaggggccccagacccttgctgcggagcgacggagagagactgtgccagtcccagccgccctaccgccgtgggaacggcaggaagtggcacttggaaaagaacaccagctgcggtggtagcagtgggatttgtgcttcttatgttacccagatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgcttaattcctaa

SEQ ID NO: 63355 - DNA, 2392 bp, Homo sapiens
gtccaccagcaagctgggctgctgggtgggtacttccttcaaagctgagggagcgtcctacgcccacgcgcgcaggagggcgccccccgcaaagcaacgtctaggagaccacagtggatgccacagcgggcccgaagcggatcagccttgtgggatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatatcttgctctgtcacccaggctggagtgcagcggcgtgatctcggaagactgcaacctccacctcccaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgcttaattcctaa

SEQ ID NO: 63356 - DNA, 1054 bp, Homo sapiens
cgcccgcgcgcgggctcaactttgtagagcgaggggccaacttggcagagcgcgcggccagctttgcagagagcgccctccagggactatgcgtgcggggacacgggtcgctttgggctcttccacccctgcggagcgcactatcccgagccaggggcggtgcaagccccgcccggccctacccagggcggctcctccctccgcagcgccgagacttttagtttcgctttcgctaaaggggccccagacccttgctgcggagcgacggagagagactgtgccagtcccagccgccctaccgccgtgggaacgatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgatcttgctctgtcacccaggctggagtgcagcggcgtgatctcggaagactgcaacctccacctcccaggttcaagcaatactcctgcctcagcctcctgagtagctgggattacaggcacgcaccaccacgcctggctaatttttgtatttttagaagagaggggtttcgccatgttggccaggctggtctcaaactcctggcgtcaagtgatccacccacctcaggctcccaaagtgctgggattacaggtgtgagcctccacacccagccacaaattatgaaggtttctttaagacattgcaatacttttatttgctttgcttagtcatttgaaacacattcattcatttatcttttcatcaaattatcattgagctcctaagtatgccaggcacagt

SEQ ID NO: 63357 - DNA, 2431 bp, Homo sapiens
gtccaccagcaagctgggctgctgggtgggtacttccttcaaagctgagggagcgtcctacgcccacgcgcgcaggagggcgccccccgcaaagcaacgtctaggagaccacagtggatgccacagcgggcccgaagcggatcagccttgtgggatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgcttaattcctaa

SEQ ID NO: 63358 - DNA, 3009 bp, Homo sapiens
cgcccgcgcgcgggctcaactttgtagagcgaggggccaacttggcagagcgcgcggccagctttgcagagagcgccctccagggactatgcgtgcggggacacgggtcgctttgggctcttccacccctgcggagcgcactatcccgagccaggggcggtgcaagccccgcccggccctacccagggcggctcctccctccgcagcgccgagacttttagtttcgctttcgctaaaggggccccagacccttgctgcggagcgacggagagagactgtgccagtcccagccgccctaccgccgtgggaacgatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgcttaattcctaaaaaaaaaaaaaaaaaaaaaaaaaaaaaaaaaaagggggggggggaaatccggggggcggtggcgttgggcaaaagggtggctcccctatagatagcggagtaggtatttatgtaacaataggaaccttgggcgcgtgtgttttaaccaattgtgcaggaaagggggaaaagtggcttacgtgggagacactcttggtggggaaggaggacccccttacactcggtggggtggtggaacattaatgtggggaacaacgtctctccctacggagagtcttatgacgaagcctcttagggggaacactatacatatttttcaaagggtgttaatacgttggtaaacaatagcggacatattgctggtaggcctgagagatttggggtcagcgggcttgtcttttctgaaaagttttttacgga

SEQ ID NO: 63359 - DNA, 2602 bp, Homo sapiens
gcaccggatcaggtcacacgggcgggtggacgcagagctccgactagccgcaagtccagcgctcttttgtgctgcttctttgtggaaggaaatgtgaagaaaacccagcgtcaccctgtaaaccagacaaaatacaaaacagtggagaagcccagagaaggcaaaacagattccggatatttctcttttaaaagtaaaatggcatcatggaagaaatttggccttccgaaagtggaggataaagtcatgttcaaggggaagaacagcaatacagcatctgcggcttagacatacagagctcgtctgtaatttggagtaagataggagtgggggcggagagggggaaggccatgccctttcagagattctgagaaactccaaccataaaagtccatgacaactcaagtgcagtacccgtgaccccatgtttgtcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgcttaattcctaa

SEQ ID NO: 63360 - DNA, 2248 bp, Homo sapiens
accaggaggctcacctgttgcgggcaggtggcactgttagcctcccctttgagtttgcttcagttcatttaaattgtggccttggaaggcattgtatatacttggagtgtttctgctgcagctggcaccagtacatttagcacccggcccactggcgcccgcatgtagtatacagccaggggatgctcacctgtggattcattgcttgattcccacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgcttaattcctaa

SEQ ID NO: 63361 - DNA, 2094 bp, Homo sapiens
cgcccgcgcgcgggctcaactttgtagagcgaggggccaacttggcagagcgcgcggccagctttgcagagagcgccctccagggactatgcgtgcggggacacgggtcgctttgggctcttccacccctgcggagcgcactatcccgagccaggggcggtgcaagccccgcccggccctacccagggcggctcctccctccgcagcgccgagacttttagtttcgctttcgctaaaggggccccagacccttgctgcggagcgacggagagagactgtgccagtcccagccgccctaccgccgtgggaacgatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacaaaggtattctcttatctgtctcgtcagacc

SEQ ID NO: 63362 - DNA, 551 bp, Homo sapiens
gccatatactcattctcattggtgagtggagcagctgtcagaattagctgatttggtcgtctcctttctttcctgttgaaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctcttt

SEQ ID NO: 63363 - DNA, 2956 bp, Homo sapiens
  misc_feature (17)..(17): n is a, c, g, or t
gccgggggtgaatcggncgagggaagtacgctcaaagccgaagccacagctcctcctgccgcatttctttcctgcttgcgaattccaagctgttaaataagatgtgcaaagggcttgcaggtctgccggcttcttgcttgaggagtgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgggctggcagctttcaaagctttcttgaagtctgaatatagtgaggagaatattgacttctggatcagctgtgaagagtacaagaaaatcaaatcaccatctaaactaagtcccaaggccaaaaagatctataatgaattcatctcagtccaggcaaccaaagaggtgaacctggattcttgcaccagggaagagacaagccggaacatgctagagcctacaataacctgctttgatgaggcccagaagaagattttcaacctgatggagaaggattcctaccgccgcttcctcaagtctcgattctatcttgatttggtcaacccgtccagctgtggggcagaaaagcagaaaggagccaagagttcagcagactgtgcttccctggtccctcagtgtgcctaattctcacctgaaggcagagggatgaaatgccaagactctatgctctggaaaacctgaggccaaatattgatctgtattaagctccagtgctttatccacattgtagcctaatattcatgctgcctgccatgtgtgagtcacttctacgcataaactagatatagcttttggtgtttgagtgttcatcagggtgggaccccattccagtccaattttcctaagtttctttgagggttccatgggagcaaatatctaaataatggcctggtaggtctggattttcaaagattgttggcagtttcctcctcccaacagttttacctcgggatggttggttagtgcatgtcacatgacatccacatgcacatgtattctgttggccagcacgttctccagactctagatgtttagatgaggttgagctatgatatgtgcttgtgtgtatgtctatgtgtatatattatatatacattagacacacatatacattatttctgtatatagatgtctgtgtatacatatgtatgtgtgagtgtatgtatacacacacacacacacacacacacttttgcaagagtgatgggaaagaccctaggtgctcataactagagtatgtgtatgtacttacatgggtgttttgatctctgttctttcatactacatttgaacagggcaaaatgaactaactgccatgtaggctaagaaagaaatgctaacctgtggaaagttggttttgtaaaattccatggatcttgctggagaagcatccaaggaacttcatgcttgatttgaccactgacagcctccaccttgagcactattctaaggagcaaataccttagctcccttgagctggttttctctgatggcacttttgagctcctaagctgccagccttcccttcttttcctgggtgctcagggcatgcttattagcagctgggttggtatggagttggcagacaggatgttcaacttaatgaagaaatacagctaaggccttgccagcaacacctgccgtaagttactggctgagtgagggcatagaagttaaaggttactgtttttatcctctatccttttttcctttcctgatcaaggtgctcttctcattttttcctgagaaccttagccatcagatgaggctccttagtttattgtggttggttgttttttctttataatggctctgggctatatgcccatatttataaaccagcagcaggggaaagattatattttataagagggaacaaattttcacaatttgaaaagcccacataagttttctcttttaaggtagaatcttgttaatttcattccaaacatcggggctaacagagactggaggcatttctttttaggctctgagactaaatgagaggaaaagaaaagaaaaaaaaatgattgtctaaccaattgtgagaattactgtttgaaacttttcaaggcacattgaaatacttgaaaacttctcatttatgttatttatgatgttattttgtacgtgttattattattatattgttttataaatggaggtacaggatatcacctgaattattaatgaatgcccaggaagtaattttcttctcattcttctaaaactactgcctttcaaagtgcacacacacgcgtccacatacactgcattcgttgctccagtataaattacatgcatgagcacctttctggcttttaagccaatataatgggctgcaaaatgaagacaccagagtgtatgcatacaaatctcactgtattaaagatgcaggttttctaattgtacccttcttgtctctctggcaatcttgcccttaatatccctggagttcctcatcagtgtcattttctgttatacacagttccacaattttgtctctagttgacttcaaatgtgtaactttattggtcttgccctattataattgtcatgactttcagattgtatctgaactcacagactgctgtcttactaataggtctggaaggtcacgctgaatgagaagtaaattattttatgtaatacatttttgagtgtgtttttcagttgtatttccctgttatttcatcactatttccaatggtgagcttgcctgctcatgctccctggacagaatactccttccttttgcatgcctgtttctatcatgtgcttgataggcctcaaagctaatgcttccagtgaaacacacgcatcttaataataagggtaaataaacgctccatatgaaacta

SEQ ID NO: 63364 - DNA, 3101 bp, Homo sapiens
tcagtctgtttaaaattttaatatgccctagagctttgtgatatacaatgaaaagtttatgcaggaaccatgtggaaaaccatctctctcatcacaaggaaaaacggaagagagaaaaaaaatgataaatatcaataccttcttgcaaaatcaatctcagtttctctttcccaaattgaccttggtaattgatagctgcataggcatttcagaagcaaaatacttccttgaaagaggcttccaacttgagtaagaatcattaggtagaactgggaaccactggatatcaaacacagattagggttacctgactccaggtgacttgaaaaaagcaggggaaaaagggattgcttgaatccatgctttatcccccaagtacctcagctttatgtgaaatagcatatccaagaggccaaccagtgtgatgacaactgtggtcctttctcctgtatcataggtgggctggcagctttcaaagctttcttgaagtctgaatatagtgaggagaatattgacttctggatcagctgtgaagagtacaagaaaatcaaatcaccatctaaactaagtcccaaggccaaaaagatctataatgaattcatctcagtccaggcaaccaaagaggtgaacctggattcttgcaccagggaagagacaagccggaacatgctagagcctacaataacctgctttgatgaggcccagaagaagattttcaacctgatggagaaggattcctaccgccgcttcctcaagtctcgattctatcttgatttggtcaacccgtccagctgtggggcagaaaagcagaaaggagccaagagttcagcagactgtgcttccctggtccctcagtgtgcctaattctcacctgaaggcagagggatgaaatgccaagactctatgctctggaaaacctgaggccaaatattgatctgtattaagctccagtgctttatccacattgtagcctaatattcatgctgcctgccatgtgtgagtcacttctacgcataaactagatatagcttttggtgtttgagtgttcatcagggtgggaccccattccagtccaattttcctaagtttctttgagggttccatgggagcaaatatctaaataatggcctggtaggtctggattttcaaagattgttggcagtttcctcctcccaacagttttacctcgggatggttggttagtgcatgtcacatgacatccacatgcacatgtattctgttggccagcacgttctccagactctagatgtttagatgaggttgagctatgatatgtgcttgtgtgtatgtctatgtgtatatattatatatacattagacacacatatacattatttctgtatatagatgtctgtgtatacatatgtatgtgtgagtgtatgtatacacacacacacacacacacacacttttgcaagagtgatgggaaagaccctaggtgctcataactagagtatgtgtatgtacttacatgggtgttttgatctctgttctttcatactacatttgaacagggcaaaatgaactaactgccatgtaggctaagaaagaaatgctaacctgtggaaagttggttttgtaaaattccatggatcttgctggagaagcatccaaggaacttcatgcttgatttgaccactgacagcctccaccttgagcactattctaaggagcaaataccttagctcccttgagctggttttctctgatggcacttttgagctcctaagctgccagccttcccttcttttcctgggtgctcagggcatgcttattagcagctgggttggtatggagttggcagacaggatgttcaacttaatgaagaaatacagctaaggccttgccagcaacacctgccgtaagttactggctgagtgagggcatagaagttaaaggttactgtttttatcctctatccttttttcctttcctgatcaaggtgctcttctcattttttcctgagaaccttagccatcagatgaggctccttagtttattgtggttggttgttttttctttataatggctctgggctatatgcccatatttataaaccagcagcaggggaaagattatattttataagagggaacaaattttcacaatttgaaaagcccacataagttttctcttttaaggtagaatcttgttaatttcattccaaacatcggggctaacagagactggaggcatttctttttaggctctgagactaaatgagaggaaaagaaaagaaaaaaaaatgattgtctaaccaattgtgagaattactgtttgaaacttttcaaggcacattgaaatacttgaaaacttctcatttatgttatttatgatgttattttgtacgtgttattattattatattgttttataaatggaggtacaggatatcacctgaattattaatgaatgcccaggaagtaattttcttctcattcttctaaaactactgcctttcaaagtgcacacacacgcgtccacatacactgcattcgttgctccagtataaattacatgcatgagcacctttctggcttttaagccaatataatgggctgcaaaatgaagacaccagagtgtatgcatacaaatctcactgtattaaagatgcaggttttctaattgtacccttcttgtctctctggcaatcttgcccttaatatccctggagttcctcatcagtgtcattttctgttatacacagttccacaattttgtctctagttgacttcaaatgtgtaactttattggtcttgccctattataattgtcatgactttcagattgtatctgaactcacagactgctgtcttactaataggtctggaaggtcacgctgaatgagaagtaaattattttatgtaatacatttttgagtgtgtttttcagttgtatttccctgttatttcatcactatttccaatggtgagcttgcctgctcatgctccctggacagaatactccttccttttgcatgcctgtttctatcatgtgcttgataggcctcaaagctaatgcttccagtgaaacacacgcatcttaataataagggtaaataaacgctccatatgaaacta

SEQ ID NO: 63365 - DNA, 929 bp, Homo sapiens
agaggcagagggagacagaggagctggtactgcagagcggtcgtctgattggctggacggtcgtagctgggctataaaagagacccctacaggcttagcaggaagacgctcagaggattctgacaatatctttaccggagaagaggcaaagtacgctcaaagccgaagccacagctcctcctgccgcatttctttcctgcttgcgaattccaagctgttaaataagatgtgcaaagggcttgcaggtctgccggcttcttgcttgaggagtgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgggctggcagctttcaaagctttcttgaagtctgaatatagtgaggagaatattgacttctggatcagctgtgaagagtacaagaaaatcaaatcaccatctaaactaagtcccaaggccaaaaagatctataatgaattcatctcagtccaggcaaccaaagaggtgaacctggattcttgcaccagggaagagacaagccggaacatgctagagcctacaataacctgctttgatgaggcccagaagaagattttcaacctgatggagaaggattcctaccgccgcttcctcaagtctcgattctatcttgatttggtcaacccgtccagctgtggggcagaaaagcagaaaggagccaagagttcagcagactgtgcttccctggtccctcagtgtgcctaattctcacctgaaggcagagggatgaaatgccgaatctgagatatccatcacactggggggcgtcgagcatgatctagagggccta

SEQ ID NO: 63366 - DNA, 3081 bp, Homo sapiens
agaggcagagggagacagaggagctggtactgcagagcggtcgtctgattggctggacggtcgtagctgggctataaaagagacccctacaggcttagcaggaagacgctcagaggattctgacaatatctttaccggagaagaggcaaagtacgctcaaagccgaagccacagctcctcctgccgcatttctttcctgcttgcgaattccaagctgttaaataagatgtgcaaagggcttgcaggtctgccggcttcttgcttgaggagtgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgggctggcagctttcaaagctttcttgaagtctgaatatagtgaggagaatattgacttctggatcagctgtgaagagtacaagaaaatcaaatcaccatctaaactaagtcccaaggccaaaaagatctataatgaattcatctcagtccaggcaaccaaagaggtgaacctggattcttgcaccagggaagagacaagccggaacatgctagagcctacaataacctgctttgatgaggcccagaagaagattttcaacctgatggagaaggattcctaccgccgcttcctcaagtctcgattctatcttgatttggtcaacccgtccagctgtggggcagaaaagcagaaaggagccaagagttcagcagactgtgcttccctggtccctcagtgtgcctaattctcacctgaaggcagagggatgaaatgccaagactctatgctctggaaaacctgaggccaaatattgatctgtattaagctccagtgctttatccacattgtagcctaatattcatgctgcctgccatgtgtgagtcacttctacgcataaactagatatagcttttggtgtttgagtgttcatcagggtgggaccccattccagtccaattttcctaagtttctttgagggttccatgggagcaaatatctaaataatggcctggtaggtctggattttcaaagattgttggcagtttcctcctcccaacagttttacctcgggatggttggttagtgcatgtcacatgacatccacatgcacatgtattctgttggccagcacgttctccagactctagatgtttagatgaggttgagctatgatatgtgcttgtgtgtatgtctatgtgtatatattatatatacattagacacacatatacattatttctgtatatagatgtctgtgtatacatatgtatgtgtgagtgtatgtatacacacacacacacacacacacacttttgcaagagtgatgggaaagaccctaggtgctcataactagagtatgtgtatgtacttacatgggtgttttgatctctgttctttcatactacatttgaacagggcaaaatgaactaactgccatgtaggctaagaaagaaatgctaacctgtggaaagttggttttgtaaaattccatggatcttgctggagaagcatccaaggaacttcatgcttgatttgaccactgacagcctccaccttgagcactattctaaggagcaaataccttagctcccttgagctggttttctctgatggcacttttgagctcctaagctgccagccttcccttcttttcctgggtgctcagggcatgcttattagcagctgggttggtatggagttggcagacaggatgttcaacttaatgaagaaatacagctaaggccttgccagcaacacctgccgtaagttactggctgagtgagggcatagaagttaaaggttactgtttttatcctctatccttttttcctttcctgatcaaggtgctcttctcattttttcctgagaaccttagccatcagatgaggctccttagtttattgtggttggttgttttttctttataatggctctgggctatatgcccatatttataaaccagcagcaggggaaagattatattttataagagggaacaaattttcacaatttgaaaagcccacataagttttctcttttaaggtagaatcttgttaatttcattccaaacatcggggctaacagagactggaggcatttctttttaggctctgagactaaatgagaggaaaagaaaagaaaaaaaaatgattgtctaaccaattgtgagaattactgtttgaaacttttcaaggcacattgaaatacttgaaaacttctcatttatgttatttatgatgttattttgtacgtgttattattattatattgttttataaatggaggtacaggatatcacctgaattattaatgaatgcccaggaagtaattttcttctcattcttctaaaactactgcctttcaaagtgcacacacacgcgtccacatacactgcattcgttgctccagtataaattacatgcatgagcacctttctggcttttaagccaatataatgggctgcaaaatgaagacaccagagtgtatgcatacaaatctcactgtattaaagatgcaggttttctaattgtacccttcttgtctctctggcaatcttgcccttaatatccctggagttcctcatcagtgtcattttctgttatacacagttccacaattttgtctctagttgacttcaaatgtgtaactttattggtcttgccctattataattgtcatgactttcagattgtatctgaactcacagactgctgtcttactaataggtctggaaggtcacgctgaatgagaagtaaattattttatgtaatacatttttgagtgtgtttttcagttgtatttccctgttatttcatcactatttccaatggtgagcttgcctgctcatgctccctggacagaatactccttccttttgcatgcctgtttctatcatgtgcttgataggcctcaaagctaatgcttccagtgaaacacacgcatcttaataataagggtaaataaacgctccatatgaaacta

SEQ ID NO: 63367 - DNA, 1992 bp, Homo sapiens
agaggcagagggagacagaggagctggtactgcagagcggtcgtctgattggctggacggtcgtagctgggctataaaagagacccctacaggcttagcaggaagacgctcagaggattctgacaatatctttaccggagaagaggcaaagtacgctcaaagccgaagccacagctcctcctgccgcatttctttcctgcttgcgaattccaagctgttaaataagatgtgcaaagggcttgcaggtctgccggcttcttgcttgaggagtgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgggctggcagctttcaaagctttcttgaagtctgaatatagtgaggagaatattgacttctggatcagctgtgaagagtacaagaaaatcaaatcaccatctaaactaagtcccaaggccaaaaagatctataatgaattcatctcagtccaggcaaccaaagaggtgaacctggattcttgcaccagggaagagacaagccggaacatgctagagcctacaataacctgctttgatgaggcccagaagaagattttcaacctgatggagaaggattcctaccgccgcttcctcaagtctcgattctatcttgatttggtcaacccgtccagctgtggggcagaaaagcagaaaggagccaagagttcagcagactgtgcttccctggtccctcagtgtgcctaattctcacctgaaggcagagggatgaaatgccaagactctatgctctggaaaacctgaggccaaatattgatctgtattaagctccagtgctttatccacattgtagcctaatattcatgctgcctgccatgtgtgagtcacttctacgcataaactagatatagcttttggtgtttgagtgttcatcagggtgggaccccattccagtccaattttcctaagtttctttgagggttccatgggagcaaatatctaaataatggcctggtaggtctggattttcaaagattgttggcagtttcctcctcccaacagttttacctcgggatggttggttagtgcatgtcacatgacatccacatgcacatgtattctgttggccagcacgttctccagactctagatgtttagatgaggttgagctatgatatgtgcttgtgtgtatgtctatgtgtatatattatatatacattagacacacatatacattatttctgtatatagatgtctgtgtatacatatgtatgtgtgagtgtatgtatacacacacacacacacacacacacttttgcaagagtgatgggaaagaccctaggtgctcataactagagtatgtgtatgtacttacatgggtgttttgatctctgttctttcatactacatttgaacagggcaaaatgaactaactgccatgtaggctaagaaagaaatgctaacctgtggaaagttggttttgtaaaattccatggatcttgctggagaagcatccaaggaacttcatgcttgatttgaccactgacagcctccaccttgagcactattctaaggagcaaataccttagctcccttgagctggttttctctgatggcacttttgagctcctaagctgccagccttcccttcttttcctgggtgctcagggcatgcttattagcagctgggttggtatggagttggcagacaggatgttcaacttaatgaagaaatacagctaaggccttgccagcaacacctgccgtaagttactggctgagtgagggcatagaagttaaaggttactgtttttatcctctatccttttttcctttcctaaaagcactctgagtcaagatgagtgggaaaccatctcaataaacacattttggat

SEQ ID NO: 63368 - DNA, 3018 bp, Homo sapiens
agcggaatacgctcagagagatgcgtagacggatatctgtacccggaaaagaggtgaagctacgcctcaacaggcggacagcgagcacgtatcttcctgtcagaatccctgacgcgtgcttgcagattccgaagctgttccacataatcatcgtgcacacgggcatcttgctagagtcatggcaggccttctagccttgcaggtcagtgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgggctggcagctttcaaagctttcttgaagtctgaatatagtgaggagaatattgacttctggatcagctgtgaagagtacaagaaaatcaaatcaccatctaaactaagtcccaaggccaaaaagatctataatgaattcatctcagtccaggcaaccaaagaggtgaacctggattcttgcaccagggaagagacaagccggaacatgctagagcctacaataacctgctttgatgaggcccagaagaagattttcaacctgatggagaaggattcctaccgccgcttcctcaagtctcgattctatcttgatttggtcaacccgtccagctgtggggcagaaaagcagaaaggagccaagagttcagcagactgtgcttccctggtccctcagtgtgcctaattctcacctgaaggcagagggatgaaatgccaagactctatgctctggaaaacctgaggccaaatattgatctgtattaagctccagtgctttatccacattgtagcctaatattcatgctgcctgccatgtgtgagtcacttctacgcataaactagatatagcttttggtgtttgagtgttcatcagggtgggaccccattccagtccaattttcctaagtttctttgagggttccatgggagcaaatatctaaataatggcctggtaggtctggattttcaaagattgttggcagtttcctcctcccaacagttttacctcgggatggttggttagtgcatgtcacatgacatccacatgcacatgtattctgttggccagcacgttctccagactctagatgtttagatgaggttgagctatgatatgtgcttgtgtgtatgtctatgtgtatatattatatatacattagacacacatatacattatttctgtatatagatgtctgtgtatacatatgtatgtgtgagtgtatgtatacacacacacacacacacacacacttttgcaagagtgatgggaaagaccctaggtgctcataactagagtatgtgtatgtacttacatgggtgttttgatctctgttctttcatactacatttgaacagggcaaaatgaactaactgccatgtaggctaagaaagaaatgctaacctgtggaaagttggttttgtaaaattccatggatcttgctggagaagcatccaaggaacttcatgcttgatttgaccactgacagcctccaccttgagcactattctaaggagcaaataccttagctcccttgagctggttttctctgatggcacttttgagctcctaagctgccagccttcccttcttttcctgggtgctcagggcatgcttattagcagctgggttggtatggagttggcagacaggatgttcaacttaatgaagaaatacagctaaggccttgccagcaacacctgccgtaagttactggctgagtgagggcatagaagttaaaggttactgtttttatcctctatccttttttcctttcctgatcaaggtgctcttctcattttttcctgagaaccttagccatcagatgaggctccttagtttattgtggttggttgttttttctttataatggctctgggctatatgcccatatttataaaccagcagcaggggaaagattatattttataagagggaacaaattttcacaatttgaaaagcccacataagttttctcttttaaggtagaatcttgttaatttcattccaaacatcggggctaacagagactggaggcatttctttttaggctctgagactaaatgagaggaaaagaaaagaaaaaaaaatgattgtctaaccaattgtgagaattactgtttgaaacttttcaaggcacattgaaatacttgaaaacttctcatttatgttatttatgatgttattttgtacgtgttattattattatattgttttataaatggaggtacaggatatcacctgaattattaatgaatgcccaggaagtaattttcttctcattcttctaaaactactgcctttcaaagtgcacacacacgcgtccacatacactgcattcgttgctccagtataaattacatgcatgagcacctttctggcttttaagccaatataatgggctgcaaaatgaagacaccagagtgtatgcatacaaatctcactgtattaaagatgcaggttttctaattgtacccttcttgtctctctggcaatcttgcccttaatatccctggagttcctcatcagtgtcattttctgttatacacagttccacaattttgtctctagttgacttcaaatgtgtaactttattggtcttgccctattataattgtcatgactttcagattgtatctgaactcacagactgctgtcttactaataggtctggaaggtcacgctgaatgagaagtaaattattttatgtaatacatttttgagtgtgtttttcagttgtatttccctgttatttcatcactatttccaatggtgagcttgcctgctcatgctccctggacagaatactccttccttttgcatgcctgtttctatcatgtgcttgataggcctcaaagctaatgcttccagtgaaacacacgcatcttaataataagggtaaataaacgctccatatgaaacta

SEQ ID NO: 63369 - DNA, 235 bp, Homo sapiens
gatccctatggagagggttcgaatgaggagcgctgggcagggccaggagtgaggaaggaggtaatggcaccaactggctctgcttttatcttggggtattcacccaacctttctggaaaccatctgcaaaatgtctcccatttgtgtgaggactaggagctagaccaggctggggctgtggtctatggagactgagattcagggaggaatcattcagattcagtaaccagaattc

SEQ ID NO: 63370 - DNA, 766 bp, Homo sapiens
ggccagcagaccattaatgaagactcatggtgggctgctgtgttttacatgcaaagcatattttatttatctaacaaacacttctatgatacttaaaatgctccagatagtattctaagcgttttatttatctgaatttatttaatctatacaacaatgccaagaggtagatgctattattgtcataacagaatgaagcaactgagtatcagaaaagttaaggaaatagcgtgaagtcacacagcttttaaattgcagggatgaagtttgaggctagacattctgactgcatatagttcacgctccacttagagaatcatccacattctctgctgctctagaaaggaaatgctaaaaggacctcctcgaatctccctttgtcaatggtcaagtcttcctgctatcacttgtaacacatcatgacctggaaacttatctgcaatgcagatgctcagccccaccccagacctgaagaatcaggcttagcattttcgcaagatccccaagtgcttcccctggtaaaagtaaatgaaatttactgggagatgaacctaatcactccaatttcttatttcagctttgttttccagcagatacaccctaaaacttctgaagtgcacatggatgacctctttactgccttccctggtatggaggccagaatgaccaaaaatcagtgaaagaaagaagagccagtagaaacataagccatctgcgaatggaatcagaccaaaaaataaattgagaataaacttaacagcatttt

SEQ ID NO: 63371 - DNA, 1288 bp, Homo sapiens
aagccacccagcctatgcatccgctcctcaatcctctcctgttggcactgggcctcatggcgcttttgttgaccacggtcattgctctcacttgccttggcggctttgcctccccaggccctgtgcctccctctacagccctcagggagctcattgaggagctggtcaacatcacccagaaccagaaggctccgctctgcaatggcagcatggtatggagcatcaacctgacagctggcatgtactgtgcagccctggaatccctgatcaacgtgtcaggctgcagtgccatcgagaagacccagaggatgctgagcggattctgcccgcacaaggtctcagctgggcagttttccagcttgcatgtccgagacaccaaaatcgaggtggcccagtttgtaaaggacctgctcttacatttaaagaaactttttcgcgagggacggttcaactgaaacttcgaaagcatcattatttgcagagacaggacctgactattgaagttgcagattcatttttctttctgatgtcaaaaatgtcttgggtaggcgggaaggagggttagggaggggtaaaattccttagcttagacctcagcctgtgctgcccgtcttcagcctagccgacctcagccttccccttgcccagggctcagcctggtgggcctcctctgtccagggccctgagctcggtggacccagggatgacatgtccctacacccctcccctgccctagagcacactgtagcattacagtgggtgccccccttgccagacatgtggtgggacagggacccacttcacacacaggcaactgaggcagacagcagctcaggcacacttcttcttggtcttatttattattgtgtgttatttaaatgagtgtgtttgtcaccgttggggattggggaagactgtggctgctggcacttggagccaagggttcagagactcagggccccagcactaaagcagtggaccccaggagtccctggtaataagtactgtgtacagaattctgctacctcactggggtcctggggcctcggagcctcatccgaggcagggtcaggagaggggcagaacagccgctcctgtctgccagccagcagccagctctcagccaacgagtaatttattgtttttcctcgtatttaaatattaaatatgttagcaaagagttaatatatagaagggtaccttgaacactgggggaggggacattgaacaagttgtttcattgactatcaaactgaagccagaaataaagttggtgacagataggcct

SEQ ID NO: 63372 - DNA, 92 bp, Homo sapiens
ttcctaggttatggtgatgctgctgctctgggaaccacactttgagatgagaaccactcatatccaaactaagattatgttctctaataaag

SEQ ID NO: 63373 - DNA, 660 bp, Homo sapiens
tgcccaaaccccttataagtgatacctgtttagctcagttaattataacaacagtaggaggcatagctgtcactcattgagtacttcctgggggctagacatgctaagctctcttcttccgtcttctcaatcatcatgacagctctgatgttgagactgttattgagcccattttgttgatttgaccattgaggcactgagaggtggttgtagagctataaagtggctgagtggggattagaacaggttttccttgggctccagagcctggcttcttgatcacctcacgcctcggtctgaggaaggggctgtgagtctgcccacctgcgagctgctctctgtccaatgacttagtccctctgttctgactcaccctaaattgatgttcccgggagccctgtttcttttattcactgtttcacagggggcatctcattgtaaccctcacatgctcatagcagctaacagatggagaagcacagatgcaagctcaggaccacgctgcagttcaaattccagctcagtcattcactagctattgaccccggacatgtcacatagccactgtgtgcctcagtttactcattcataaaatggagatgatactttataagagtgctgtcacatgaggcaatgttttcaaaaatgcctagcccacca

SEQ ID NO: 63374 - DNA, 291 bp, Homo sapiens
attccaatggtaatactaacgaattgtgctatctaaatattggatagtaaaaacgtcaacatttagaaaatgtatatcacacagggaaccaatatttttcaaattatccacatctaatattaggcaaccacgcgcaagcaaaagacacgttcaaagtacaggagaaatggatggattttaatgtgagatagtacaagaagtttattgatatagtttcagattccatattgtaataaacctttaagaaactatcacttcttgagtttgggtatagaatccaaaaaaaaaaaa

SEQ ID NO: 63375 - DNA, 153 bp, Homo sapiens
tcgacagtgcatcgcctcggagactgcctcgctgcccatgatcgtcagcatcaaggagggaggcaggaccaggccccaggtggtcagcctgcccaacatgagggtgcagaagtgcagctgtgcctcggatggtgcgctcgtgccaaggaggct

SEQ ID NO: 63376 - DNA, 406 bp, Homo sapiens
agcccacttttgacaaatcaacatgtgcaaagtccacattttgaaccacgaggcaaaaattagtatgagatcgtggttatttccttcctgggagtggaagttctgagagagcgaagagagaaaggaatactgatatttctgagagtctgccaggagaaagcctgcctggccagtttagtggcggagctgagtctgaataagggtttcactcttattgcccaggctggagtccaatggtgcgatcttggctcactgcaacctctgcctcctggcttcaagtgattctcatgcctcagcctcccgagcagctgggattacagggagcatcaagacactggcatttggaaatctagaagcaattcaactgaagatgactcatcttttcattaaaaggaagatccattca

SEQ ID NO: 63377 - DNA, 465 bp, Homo sapiens
accctagcagtagtatattgcaagtacccacttaattattttcttgtttcatgaaacataaacttgaaaagctgttattctggtttctttttcttgactttttagtggaatacatacttagtttgcaaatatatgacatgagccaaggtgtcaagctttcacaaagaaggagtaatgaatttgcatactttaaatgatagattcattatgtttgtctcttgattaaagtaatatgaaaactagtacatgcagaacatgaggaatggcaaaatggagccctcagtgtcattcttttcttaagtagtctgcttggtatatgccaacataaacactcgaagtgaactttaatttctttcttcttgttttactgaagctataatcttaaatttgatgtttgcaaattggctgccagtaaataggctttcgggtaaagacgaggtactggaaatcttggaaaggctgaaa

SEQ ID NO: 63378 - DNA, 983 bp, Homo sapiens
  misc_feature (961)..(961): n is a, c, g, or t
agcgggtttgggggcgcgcgtcttcgcgaccctcggctgggcccgccgcccgcttcccgcccctggcgcctcacagctgcagccacttcccgccttgcctccttccgggcctctcgggccccggggagcgcggcgggccggggcaggggccagggcagggaccggggaggccgggcctcccaggctcagcgctgaagcccgagaggactgcggctggaaagcggccgagcacatggacgagctccaggcgcgcctgctgcaggggctggggtctcaggccggggccgcgggcgtcctcggagcctcggcgggacgtgggggctcgggtgtactggccgggccgatgcaggaaagcgggagcgcgtaattcttcggcctgtggtggacacagatgtgtgcaggacttcattgacttaactagagagaccagaccaaggacaaaagatcgcagtggactgtatgtgattgacctgacaagagctgagggagaaaatagacctattgccactcttgacttaactttagaacctgtcactccttcccagaaggagccaaccagtcttcagacatgtgccagcctctctggcaaagcggtgatggaagggcacgtggacagaagctctcagcctacagcacggagaatcattaacagtgatcctgtagatttggacctagtggaagaaaacacctttgtaggtcccccacccgctacatccatcagtggaggctctgtttatccaacagagcctaattgtagctcagccacattcacaggtaacctcagcttcttggcaagtctacagctgtcttcagatgttagctccctctccccaacaagcaataatagtaggagcagcagcagcagcagcaatcaaaaagcacccttgccatgcccacagcaagatgtatctcgcccaccacaggccttgccgtgccccctgcgacctttgccatgcccacngagagctcaccatgtccaccac

SEQ ID NO: 63379 - DNA, 873 bp, Homo sapiens
  misc_feature (851)..(851): n is a, c, g, or t
ttaacagatgctgaagaagcatttgacaaaatgtaatagctcttcccaatttaaactctgagtaaactaggaaaagaagagaacttccttaaaggcatctgtgaaaaccccacagctagaattatacttaatgatggaaatctgaaattctttcttttaagttcaagaacaagcagggaaggcagagcaagatggctgaatagaaccctccagcatttgtcccccaagcaagaacaccaacttgaacaactatccacacaagaaagcactttcagaagaactaaaactcaggacttcattgacttaactagagagaccagaccaaggacaaaagatcgcagtggactgtatgtgattgacctgacaagagctgagggagaaaatagacctattgccactcttgacttaactttagaacctgtcactccttcccagaaggagccaaccagtcttcagacatgtgccagcctctctggcaaagcggtgatggaagggcacgtggacagaagctctcagcctacagcacggagaatcattaacagtgatcctgtagatttggacctagtggaagaaaacacctttgtaggtcccccacccgctacatccatcagtggaggctctgtttatccaacagagcctaattgtagctcagccacattcacaggtaacctcagcttcttggcaagtctacagctgtcttcagatgttagctccctctccccaacaagcaataatagtaggagcagcagcagcagcagcaatcaaaaagcacccttgccatgcccacagcaagatgtatctcgcccaccacaggccttgccgtgccccctgcgacctttgccatgcccacngagagctcaccatgtccaccac

SEQ ID NO: 63380 - DNA, 303 bp, Homo sapiens
gacacacccaggaacaatactttacatccttcaatccaatcaagttgacactcaatattaccatcacacctgataactctctgatttgttcaaatagattttttttattttattgagtttgtttttatttttcttacctggaggcttgtctgacccaccattgctgagagcaaaaattcacatacggttttaaatttttttcacagacactaatgtattttcctgatttaaaaagtcagcctatttgagcaagcagggtgaaaagcagtatactcactatgcaaatatgaaaacagaattagt

SEQ ID NO: 63381 - DNA, 436 bp, Homo sapiens
aattttcttaagggattgatttactcttattaaattataagagattttaatttttttaacccaaagttcaactgtttactcgctgttttctctccccttcaactcgtttgcagctcatataagttattttccttaaattctatttgttatggtctgatgctaacaatgttttctaaaagtctaaagaaaatgttttcttccaaagtaatattctgtgcagtgtagaaggtcttttcttttgcctttgggtaattgacctaacagattttatggcttattgaaacaatgttatgctgttattattaatttttgatttgctcaggaaaaagtatctgagataattttttaaaattaaggttattacatccatgtatatttctgtaggtgctttgaaagtacctgtgacattaagttacaggcctttgactcctgggtc

SEQ ID NO: 63382 - DNA, 148 bp, Homo sapiens
tagtcttgtttcgcttttatttttatttttagaggagtaagaaaactggataaactctatgaactactataaattatagctggcagacgagaaagagcaagaaaaagaactaagaagcataactaagaacttcagtagtacaatttta

SEQ ID NO: 63383 - DNA, 866 bp, Homo sapiens
cttggaaccctctggctcagaggcaggcactgaaggcttctggaggcagaacctgtgcatagctcccacacagccctggccttgctcagctgttgatttgtgggtagctgctgccctctgctggacagagtgaaacgtgctctccttccatttcctaggactcttgtctccctatcacaagttccatttccttcctaggactcttgtctccctatcaccagttccatttccttcctaggactcctgtctccctatcacaagttcacaaactcacagagcagaaaagggccagaaggtcggcaggcccagccccattattcagaggcggatactgaggccagagaggggaaaggccttgtttaaggtcacacagatagttagagtaggagctgggactagaaatgggtggccctccctcagcagggtctggaggtgtggggtcctggaggagaaagagaaggcaccttactcctagtagagacaccagaaggctggtgggcagtgtaaccaggaccaccaggtcagcccacccacgtaggaaaatcccctatcaggctgtgtgagtgatcccagctttgcctaactccacaatcctaaaaagtcacctataaacagaatctttgtcagtcagattattttcccctctaccaccttctgtgtcccagatgcagtttttgtggctgttaccaatttcatcatacaaggcccagggagagtatagtagggcaagcgcattgctctaacaaatagaccccaaatgtataataactcaaagaaaagggaagtttactttttgctcgttaatagttcagtgagcctagcagaaaagggaggggaatggccgggcgccgtagctaaagcctgta

SEQ ID NO: 63384 - DNA, 804 bp, Homo sapiens
cttccatggcctctgccgcgctggagctgctgcggggctgtcctgccagcttgtgctcccgccccgaagcgtcctcctccactggcgacacacgcactgaagcccgagtcttcccgctgggtagttgttttggtcttgcacccaaggagggatttcttgcgcctcttgttccctcagttatttcataaaccaggaccgcaactatactgtcgtgtagcgcggccaccccacagcggtccctgacgttaacccttgccgtgactgctagaagacactggtggagtgtgaattgatgaccaaggcatggcagagcctctctcatctttataatcagttcagcggcggcctccactacagggaactcccagccagtcccgaggcctagggacatccagggagaaacgtggcggtggtaaagggcttgcgcagctcctgaagataaataagactttgggttgctgttgtttttgagacaagggtctcactatgttgtccaggcagcactcgagctcctggcctcaagccatcttttctggcttcagccttctgagtagctgggactacaggaccatgccaccgaatcaggctttaagactttttaatgaccctttcaaatttctgagtcactcccagcattttaggaagccaagtgagaaggatagcttgaggccaggagttcgagaccaacctgggcaacagattcctgagtcaccattgacaagaaactttgaatgaagttgatgatacaaaatattaacatctttttttttacaaccattaaaaatttaccacaggtgaaactaa

SEQ ID NO: 63385 - DNA, 280 bp, Homo sapiens
tctatgcccgggacctcctaactcttctccactttgcatccgaagcaagcatttaaaagcacatacttaaatacatgacttccctccgtggcaggctcctttggttgctgagccagcccctatttcaactcttctctttgcttcctccacctggaagagctaaatgctcattgtctcctgcatggtcaagtgtgcctatgggactaagtgttgacccatgagatgggtggtttcttaggaagactgtttttccctgattaaagggacatattcagctgtc

SEQ ID NO: 63386 - DNA, 792 bp, Homo sapiens
  misc_feature (379)..(379): n is a, c, g, or t
tcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcatggagtccactggcgtcttcaccaaccccccaattggggcaaagaaaggcntttggggggggggcggggggggctcatttgcaggggggagccaaaaaaggggttccaaatttcccaaatttcatcatctctgccccctctgctgatgcccccatgttcgtcatgggtgtgaaccatgagaagtatgacaacaacctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgacggggctctccagaacatcatccctgcctctactggcactgcgaaggctatgggcaaggtcatccctgagctgaacgggaagctcactggcatggcct

SEQ ID NO: 63387 - DNA, 507 bp, Homo sapiens
tcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgaccctcaacgaccactttgtcaagctcatttcctggtatgacaacgaatttggctacagcaacagggtggtggacctcatggcccacatggcctccaaggagtaagacccctggaccaccagccccagcaagagcatcctgggctacactgagcaccaggtggtctcctctgacttcaacagcgacacccactcctccacctttgacgctggggctggcattgccctcaacgaccacactgaatctcccctcctcacagtttccatgtagaccccttgaagaggggaggggcctagggagccgcaccttgtcatgtaccatcaataaagtaccctgtgctcaaccaaaaa

SEQ ID NO: 63388 - DNA, 740 bp, Homo sapiens
tcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcatggagtccactggcgtcttcaccaccatggagaaggctgggcctcatttgcaggggggagccaaaagggtcatcatctctgccccctctgctgatgcccccatgttcgtcatgggtgtgaaccatgagaagtatgacaacaacctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgacggggctctccagaacatcatccctgcctctactggcactgcgaaggctatgggcaaggtcatccctgagctgaacgggaagctcactggcatggcct

SEQ ID NO: 63389 - DNA, 783 bp, Homo sapiens
tcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccagggaagcgggaagaatcccttccaaatctcaatgtgggcgcaagtgcgtgggcgcgtagatatagctgtcaggagagatgctcacatgtggatgtcatatcacaccacacgagtggacgagaggctgggaggcatcacatctgcgaggggagagacgccaagagaagatcatctctgccccctctgctgatgcccccatgttcgtcatgggtgtgaaccatgagaagtatgacaacaacctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgacggggctctccagaacatcatccctgcctctactggcactgcgaaggctatgggcaaggtcatccctgagctgaacgggaagctcactggcatggcct

SEQ ID NO: 63390 - DNA, 467 bp, Homo sapiens
tcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgaccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagtttccatgtagaccccttgaagaggggaggggcctagggagccgcaccttgtcatgtaccatcaataaagtaccctgtgctcaaccaaaaa

SEQ ID NO: 63391 - DNA, 2548 bp, Homo sapiens
gggaggagaagcctgggtgccccccactgataagcaggctccacccagaggccagtcctgtgtgtctggggacaaggcgaaagagcagcagaagtgccccttctccaggatcaaggaactggggcggggggtgtttcctggaccccagtcctccgaatcagctcctagagtggaaccaggaaggattctggagccacagaagatagacagatggaaggtggggaccaaagtgaggaagagccgagggaacgcagccaggcaggtggaatgggaactctctggagccaagagagcactccagaagagaggctgcccgtggaagggagcaggccatgggcagtggccaggcgggtgctgacagctatcctgattttgggcctgctcctttgtttttctgtgcttttgttctacaacttccagaactgtggccctcgcccctgtgagacatctgtgtgtttggatctccgggatcattacctggcctctgggaacacaagtgtggccccctgcaccgacttcttcagctttgcctgtggaagggccaaagagaccaataattcttttcaggagcttgccacaaagaacaaaaaccgacttcggagaatactggaggtccagaattcctggcacccaggctctggggaggagaaagccttccagttctacaactcctgcatggatacacttgccattgaagctgcagggactggtcccctcagacaagttattgaggagcttggaggctggcgcatctctggtaaatggacttccttaaactttaaccgaacgctgagacttctgatgagtcagtatggccatttccctttcttcagagcctacctaggacctcatcctgcctctccacacacaccagtcatccagatagaccagccagagtttgatgttcccctcaagcaagatcaagaacagaagatctatgcccagatctttcgggaatacctgacttacctgaatcagctgggaaccttgctgggaggagacccaagcaaggtgcaagaacactcttccttgtcaatctccatcacttcacggctgttccagtttctgaggcccctggagcagcggcgggcacagggcaagctcttccagatggtcactatcgaccagctcaaggaaatggcccccgccatcgactggttgtcctgcttgcaagcgacattcacaccgatgtccctgagcccttctcagtccctcgtggtccatgacgtggaatatttgaaaaacatgtcacaactggtggaggagatgctgctaaagcagagggactttctgcagagccacatgatcttagggctggtggtgaccctttctccagccctggacagtcaattccaggaggcacgcagaaagctcagccagaaactgcgggaactgacagagcaaccacccatgcctgcccgcccacgatggatgaagtgcgtggaggagacaggcacgttcttcgagcccacgctggcggctttgtttgttcgtgaggcctttggcccgagcacccgaagtgctgccatgaaattattcactgcgatccgggatgccctcatcactcgcctcagaaaccttccctggatgaatgaggagacccagaacatggcccaggacaaggttgctcaactgcaggtggagatgggggcttcagaatgggccctgaagccagagctggcccgacaagaatacaacgatatacagcttggatcgagcttcctgcagtctgtcctgagctgtgtccggtccctccgagctagaattgtccagagcttcttgcagcctcacccccaacacaggtggaaggtgtccccttgggacgtcaatgcttactattcggtatctgaccatgtggtagtctttccagctggactcctccaacccccattcttccaccctggctatcccagagccgtgaactttggcgctgctggcagcatcatggcccacgagctgttgcacatcttctaccagctcttactgcctgggggctgcctcgcctgtgacaaccatgccctccaggaagctcacctgtgcctgaagcgccattatgctgcctttccattacctagcagaacctccttcaatgactccctcacattcttagagaatgctgcagacgttggggggctagccatcgcgctgcaggcatacagcaagaggctgttacggcaccatggggagactgtcctgcccagcctggacctcagcccccagcagatcttctttcgaagctatgcccaggtgatgtgtaggaagcccagcccccaggactctcacgacactcacagccctccacacctccgagtccacgggcccctcagcagcaccccagcctttgccaggtatttccgctgtgcacgtggtgctctcttgaacccctccagccgctgccagctctggtaacttggttaccaaagatgccacagcacagaaatatcgaccaacacctccctggtcacatccatggaatcagagcaagatttcctttctgcttctgttccaaaaataaaagctggcacttggcttccgcttgtctcttaat

SEQ ID NO: 63392 - DNA, 941 bp, Homo sapiens
  misc_feature (925)..(925): n is a, c, g, or t
gggaggagaagcctgggtgccccccactgataagcaggctccacccagaggccagtcctgtgtgtctggggacaaggcgaaagagcagcagaagtgccccttctccaggatcaaggaactggggcggggggtgtttcctggaccccagtcctccgaatcagctcctagagtggaaccaggaaggattctggagccacagaagatagacagatggaaggtggggaccaaagtgaggaagagccgagggaacgcagccaggcaggtggaatgggaactctctggagccaagagagcactccagaagagaggctgcccgtggaagggagcaggccatgggcagtggccaggcgggtgctgacagctatcctgattttgggcctgctcctttgtttttctgtgcttttgttctacaacttccagaactgtggccctcgcccctgtgagacatctgtgtgtttggatctccgggatcattacctggcctctgggaacacaagtgtggccccctgcaccgacttcttcagctttgcctgtggaagggccaaagagaccaataattcttttcaggagcttgccacaaagaacaaaaaccgacttcggagaatactggaggtccagaattcctggcacccaggctctggggaggagaaagccttccagttctacaactcctgcatggatacacttgccattgaagctgcagggactggtcccctcagacaagttattgaggagcttggaggctggcgcatctctggtaaatggacttccttaaactttaaccgaacgctgagacttctgatgagtcagtatggccatttccctttcttcagagcctacctaggacctcatcctgcctctccacacacaccagtcatccagatagacagcaagttgtgtcctaacagatagacgagtttgcaanttcgatctgctactat

SEQ ID NO: 63393 - DNA, 433 bp, Homo sapiens
  misc_feature (17)..(17): n is a, c, g, or t
  misc_feature (26)..(26): n is a, c, g, or t
aaaagctcccatgttgnccttggggnaatttgaatccccctggttcccctctttgtctgctgtccctgatcaccccttgtcaccgggtcagctttgtcctgtggaccctcccccttcaatgacctctcccaggtgatgtgtaggaagcccagcccccaggactctcacgacactcacagccctccacacctccgagtccacgggcccctcagcagcaccccagcctttgccaggtatttccgctgtgcacgtggtgctctcttgaacccctccagccgctgccagctctggtaacttggttaccaaagatgccacagcacagaaatatcgaccaacacctccctggtcacatccatggaatcagagcaagatttcctttctgcttctgttccaaaaataaaagctggcacttggcttccgcttgtctcttaat

SEQ ID NO: 63394 - DNA, 1731 bp, Homo sapiens
catccgccatgctccctgcttctctccagtctctcttgtgcccagatagaccagccagagtttgatgttcccctcaagcaagatcaagaacagaagatctatgcccagatctttcgggaatacctgacttacctgaatcagctgggaaccttgctgggaggagacccaagcaaggtgcaagaacactcttccttgtcaatctccatcacttcacggctgttccagtttctgaggcccctggagcagcggcgggcacagggcaagctcttccagatggtcactatcgaccagctcaagctttgtgtccctcctctaaggaaatggcccccgccatcgactggttgtcctgcttgcaagcgacattcacaccgatgtccctgagcccttctcagtccctcgtggtccatgacgtggaatatttgaaaaacatgtcacaactggtggaggagatgctgctaaagcagagggactttctgcagagccacatgatcttagggctggtggtgaccctttctccagccctggacagtcaattccaggaggcacgcagaaagctcagccagaaactgcgggaactgacagagcaaccacccatgcctgcccgcccacgatggatgaagtgcgtggaggagacaggcacgttcttcgagcccacgctggcggctttgtttgttcgtgaggcctttggcccgagcacccgaagtgctgccatgaaattattcactgcgatccgggatgccctcatcactcgcctcagaaaccttccctggatgaatgaggagacccagaacatggcccaggacaaggttgctcaactgcaggtggagatgggggcttcagaatgggccctgaagccagagctggcccgacaagaatacaacgatatacagcttggatcgagcttcctgcagtctgtcctgagctgtgtccggtccctccgagctagaattgtccagagcttcttgcagcctcacccccaacacaggtggaaggtgtccccttgggacgtcaatgcttactattcggtatctgaccatgtggtagtctttccagctggactcctccaacccccattcttccaccctggctatcccagagccgtgaactttggcgctgctggcagcatcatggcccacgagctgttgcacatcttctaccagctcttactgcctgggggctgcctcgcctgtgacaaccatgccctccaggaagctcacctgtgcctgaagcgccattatgctgcctttccattacctagcagaacctccttcaatgactccctcacattcttagagaatgctgcagacgttggggggctagccatcgcgctgcaggcatacagcaagaggctgttacggcaccatggggagactgtcctgcccagcctggacctcagcccccagcagatcttctttcgaagctatgcccaggtgatgtgtaggaagcccagcccccaggactctcacgacactcacagccctccacacctccgagtccacgggcccctcagcagcaccccagcctttgccaggtatttccgctgtgcacgtggtgctctcttgaacccctccagccgctgccagctctggtaacttggttaccaaagatgccacagcacagaaatatcgaccaacacctccctggtcacatccatggaatcagagcaagatttcctttctgcttctgttccaaaaataaaagctggcacttggcttccgcttgtctcttaat

SEQ ID NO: 63395 - DNA, 1497 bp, Homo sapiens
tctttttctcacacccaaggggaagccctttccccttccttctcttttccttttccccctcagctttgtgtccctcctctaaggaaatggcccccgccatcgactggttgtcctgcttgcaagcgacattcacaccgatgtccctgagcccttctcagtccctcgtggtccatgacgtggaatatttgaaaaacatgtcacaactggtggaggagatgctgctaaagcagagggactttctgcagagccacatgatcttagggctggtggtgaccctttctccagccctggacagtcaattccaggaggcacgcagaaagctcagccagaaactgcgggaactgacagagcaaccacccatgcctgcccgcccacgatggatgaagtgcgtggaggagacaggcacgttcttcgagcccacgctggcggctttgtttgttcgtgaggcctttggcccgagcacccgaagtgctgccatgaaattattcactgcgatccgggatgccctcatcactcgcctcagaaaccttccctggatgaatgaggagacccagaacatggcccaggacaaggttgctcaactgcaggtggagatgggggcttcagaatgggccctgaagccagagctggcccgacaagaatacaacgatatacagcttggatcgagcttcctgcagtctgtcctgagctgtgtccggtccctccgagctagaattgtccagagcttcttgcagcctcacccccaacacaggtggaaggtgtccccttgggacgtcaatgcttactattcggtatctgaccatgtggtagtctttccagctggactcctccaacccccattcttccaccctggctatcccagagccgtgaactttggcgctgctggcagcatcatggcccacgagctgttgcacatcttctaccagctcttactgcctgggggctgcctcgcctgtgacaaccatgccctccaggaagctcacctgtgcctgaagcgccattatgctgcctttccattacctagcagaacctccttcaatgactccctcacattcttagagaatgctgcagacgttggggggctagccatcgcgctgcaggcatacagcaagaggctgttacggcaccatggggagactgtcctgcccagcctggacctcagcccccagcagatcttctttcgaagctatgcccaggtgatgtgtaggaagcccagcccccaggactctcacgacactcacagccctccacacctccgagtccacgggcccctcagcagcaccccagcctttgccaggtatttccgctgtgcacgtggtgctctcttgaacccctccagccgctgccagctctggtaacttggttaccaaagatgccacagcacagaaatatcgaccaacacctccctggtcacatccatggaatcagagcaagatttcctttctgcttctgttccaaaaataaaagctggcacttggcttccgcttgtctcttaat

SEQ ID NO: 63396 - DNA, 1201 bp, Homo sapiens
ccttcctttctccacagatcctttagttgctttagttgagctgctcctctagcagcagctccagcccaggcagctccttggggccaagcccttttccaagggtcagaagctgtgggcagggccaggctgaggcctctcctgatcctgtccccctgtccctggacctcactcccacaggccatgaaattattcactgcgatccgggatgccctcatcactcgcctcagaaaccttccctggatgaatgaggagacccagaacatggcccaggacaaggttgctcaactgcaggtggagatgggggcttcagaatgggccctgaagccagagctggcccgacaagaatacaacgatatacagcttggatcgagcttcctgcagtctgtcctgagctgtgtccggtccctccgagctagaattgtccagagcttcttgcagcctcacccccaacacaggtggaaggtgtccccttgggacgtcaatgcttactattcggtatctgaccatgtggtagtctttccagctggactcctccaacccccattcttccaccctggctatcccagagccgtgaactttggcgctgctggcagcatcatggcccacgagctgttgcacatcttctaccagctcttactgcctgggggctgcctcgcctgtgacaaccatgccctccaggaagctcacctgtgcctgaagcgccattatgctgcctttccattacctagcagaacctccttcaatgactccctcacattcttagagaatgctgcagacgttggggggctagccatcgcgctgcaggcatacagcaagaggctgttacggcaccatggggagactgtcctgcccagcctggacctcagcccccagcagatcttctttcgaagctatgcccaggtgatgtgtaggaagcccagcccccaggactctcacgacactcacagccctccacacctccgagtccacgggcccctcagcagcaccccagcctttgccaggtatttccgctgtgcacgtggtgctctcttgaacccctccagccgctgccagctctggtaacttggttaccaaagatgccacagcacagaaatatcgaccaacacctccctggtcacatccatggaatcagagcaagatttcctttctgcttctgttccaaaaataaaagctggcacttggcttccgcttgtctcttaat

SEQ ID NO: 63397 - DNA, 677 bp, Homo sapiens
tgccatgctcctgggagctgattcagtctgtggtaccacccacatcctcacctaggcagcaccaaccctatgttctcttgctgtatgttctcttgtcccattttcaacagtactgcctgggggctgcctcgcctgtgacaaccatgccctccaggaagctcacctgtgcctgaagcgccattatgctgcctttccattacctagcagaacctccttcaatgactccctcacattcttagagaatgctgcagacgttggggggctagccatcgcgctgcaggcatacagcaagaggctgttacggcaccatggggagactgtcctgcccagcctggacctcagcccccagcagatcttctttcgaagctatgcccaggtgatgtgtaggaagcccagcccccaggactctcacgacactcacagccctccacacctccgagtccacgggcccctcagcagcaccccagcctttgccaggtatttccgctgtgcacgtggtgctctcttgaacccctccagccgctgccagctctggtaacttggttaccaaagatgccacagcacagaaatatcgaccaacacctccctggtcacatccatggaatcagagcaagatttcctttctgcttctgttccaaaaataaaagctggcacttggcttccgcttgtctcttaat

SEQ ID NO: 63398 - DNA, 2450 bp, Homo sapiens
gggaggagaagcctgggtgccccccactgataagcaggctccacccagaggccagtcctgtgtgtctggggacaaggcgaaagagcagcagaagtgccccttctccaggatcaaggaactggggcggggggtgtttcctggaccccagtcctccgaatcagctcctagagtggaaccaggaaggattctggagccacagaagatagacagatggaaggtggggaccaaagtgaggaagagccgagggaacgcagccaggcaggtggaatgggaactctctggagccaagagagcactccagaagagaggctgcccgtggaagggagcaggccatgggcagtggccaggcgggtgctgacagctatcctgattttgggcctgctcctttgtttttctgtgcttttgttctacaacttccagaactgtggccctcgcccctgtgagacatctgtgtgtttggatctccgggatcattacctggcctctgggaacacaagtgtggccccctgcaccgacttcttcagctttgcctgtggaagggccaaagagaccaataattcttttcaggagcttgccacaaagaacaaaaaccgacttcggagaatactggaggtccagaattcctggcacccaggctctggggaggagaaagccttccagttctacaactcctgcatggatacacttgccattgaagctgcagggactggtcccctcagacaagttattgaggagcttggaggctggcgcatctctggtaaatggacttccttaaactttaaccgaacgctgagacttctgatgagtcagtatggccatttccctttcttcagagcctacctaggacctcatcctgcctctccacacacaccagtcatccagatagaccagccagagtttgatgttcccctcaagcaagatcaagaacagaagatctatgcccagatctttcgggaatacctgacttacctgaatcagctgggaaccttgctgggaggagacccaagcaaggtgcaagaacactcttccttgtcaatctccatcacttcacggctgttccagtttctgaggcccctggagcagcggcgggcacagggcaagctcttccagatggtcactatcgaccagctcaaggaaatggcccccgccatcgactggttgtcctgcttgcaagcgacattcacaccgatgtccctgagcccttctcagtccctcgtggtccatgacgtggaatatttgaaaaacatgtcacaactggtggaggagatgctgctaaagcagagggactttctgcagagccacatgatcttagggctggtggtgaccctttctccagccctggacagtcaattccaggaggcacgcagaaagctcagccagaaactgcgggaactgacagagcaaccacccatgcctgcccgcccacgatggatgaagtgcgtggaggagacaggcacgttcttcgagcccacgctggcggctttgtttgttcgtgaggcctttggcccgagcacccgaagtgctgccatgaaattattcactgcgatccgggatgccctcatcactcgcctcagaaaccttccctggatgaatgaggagacccagaacatggcccaggacaaggttgctcaactgcaggtggagatgggggcttcagaatgggccctgaagccagagctggcccgacaagaatacaacgatatacagcttggatcgagcttcctgcagtctgtcctgagctgtgtccggtccctccgagctagaattgtccagagcttcttgcagcctcacccccaacacaggtggaaggtgtccccttgggacgtcaatgcttactattcggtatctgaccatgtggtagtctttccagctggactcctccaacccccattcttccaccctggctatcccagaacctccttcaatgactccctcacattcttagagaatgctgcagacgttggggggctagccatcgcgctgcaggcatacagcaagaggctgttacggcaccatggggagactgtcctgcccagcctggacctcagcccccagcagatcttctttcgaagctatgcaggtaggcagcggccacctcccgccacagcttgctttatgtcagttgaacgccttattactgaagctcatggaagtcccctcttcagacactccgtcaaataccccaaaccctcttctgcagatgtcctcactgttatcttttctcttccctccctaccccttggaatcacccctcagatgactacaggttcttctacctaattcagcacccccacaactcaaaaggtagaaaaaactctattcccaagttcctccaggagaggaggagaccaacttttttttcctctcatacccccaaaatacagatgccttaaaaatgagcctgtggttgggcacagtggctcacacctgtaatcctggcactctaggag

SEQ ID NO: 63399 - DNA, 2383 bp, Homo sapiens
gggaggagaagcctgggtgccccccactgataagcaggctccacccagaggccagtcctgtgtgtctggggacaaggcgaaagagcagcagaagtgccccttctccaggatcaaggaactggggcggggggtgtttcctggaccccagtcctccgaatcagctcctagagtggaaccaggaaggattctggagccacagaagatagacagatggaaggtggggaccaaagtgaggaagagccgagggaacgcagccaggcaggtggaatgggaactctctggagccaagagagcactccagaagagaggctgcccgtggaagggagcaggccatgggcagtggccaggcgggtgctgacagctatcctgattttgggcctgctcctttgtttttctgtgcttttgttctacaacttccagaactgtggccctcgcccctgtgagacatctgtgtgtttggatctccgggatcattacctggcctctgggaacacaagtgtggccccctgcaccgacttcttcagctttgcctgtggaagggccaaagagaccaataattcttttcaggagcttgccacaaagaacaaaaaccgacttcggagaatactggaggtccagaattcctggcacccaggctctggggaggagaaagccttccagttctacaactcctgcatggatacacttgccattgaagctgcagggactggtcccctcagacaagttattgaggagcttggaggctggcgcatctctggtaaatggacttccttaaactttaaccgaacgctgagacttctgatgagtcagtatggccatttccctttcttcagagcctacctaggacctcatcctgcctctccacacacaccagtcatccagatagaccagccagagtttgatgttcccctcaagcaagatcaagaacagaagatctatgcccagatctttcgggaatacctgacttacctgaatcagctgggaaccttgctgggaggagacccaagcaaggtgcaagaacactcttccttgtcaatctccatcacttcacggctgttccagtttctgaggcccctggagcagcggcgggcacagggcaagctcttccagatggtcactatcgaccagctcaaggaaatggcccccgccatcgactggttgtcctgcttgcaagcgacattcacaccgatgtccctgagcccttctcagtccctcgtggtccatgacgtggaatatttgaaaaacatgtcacaactggtggaggagatgctgctaaagcagagggactttctgcagagccacatgatcttagggctggtggtgaccctttctccagccctggacagtcaattccaggaggcacgcagaaagctcagccagaaactgcgggaactgacagagcaaccacccatgcctgcccgcccacgatggatgaagtgcgtggaggagacaggcacgttcttcgagcccacgctggcggctttgtttgttcgtgaggcctttggcccgagcacccgaagtgctgccatgaaattattcactgcgatccgggatgccctcatcactcgcctcagaaaccttccctggatgaatgaggagacccagaacatggcccaggacaaggttgctcaactgcaggtggagatgggggcttcagaatgggccctgaagccagagctggcccgacaagaatacaacgatatacagcttggatcgagcttcctgcagtctgtcctgagctgtgtccggtccctccgagctagaattgtccagagcttcttgcagcctcacccccaacacaggtggaaggtgtccccttgggacgtcaatgcttactattcggtatctgaccatgtggtagtctttccagctggactcctccaacccccattcttccaccctggctatcccagaacctccttcaatgactccctcacattcttagagaatgctgcagacgttggggggctagccatcgcgctgcaggcatacagcaagaggctgttacggcaccatggggagactgtcctgcccagcctggacctcagcccccagcagatcttctttcgaagctatgcccaggtgatgtgtaggaagcccagcccccaggactctcacgacactcacagccctccacacctccgagtccacgggcccctcagcagcaccccagcctttgccaggtatttccgctgtgcacgtggtgctctcttgaacccctccagccgctgccagctctggtaacttggttaccaaagatgccacagcacagaaatatcgaccaacacctccctggtcacatccatggaatcagagcaagatttcctttctgcttctgttccaaaaataaaagctggcacttggcttccgcttgtctcttaat

SEQ ID NO: 63400 - DNA, 458 bp, Homo sapiens
cctggggtatatgtgtgggtctcttttgtctccatagggactttctgcagagccacatgatcttagggctggtggtgaccctttctccagccctggacagtcaattccaggaggcacgcagaaagctcagccagaaactgcgggaactgacagagcaaccacccatggtgaggagaggagcgggtgtatttgcccagatactcgaaaggagtatctactcttttgaggggtaaatgtcggcatctctctctcagggagggggccgtgatggtagatgcccctccatgtcttggctttccatagaagcaggcaagttggacagacaaagtttaacttgaaaaccaagatgccacgtgccagaccttcaggcacacatctcccagcctgactacctctctggcttcttgctgggtgtttgagctcaaatataaaactctgatattatcaaaactgccctt

SEQ ID NO: 63401 - DNA, 419 bp, Homo sapiens
ggtaaaaagtttaagacacatactatctagaatgattggattccagaaatcccagagcaagctttcataagagatctgcctactcaaagccccagggatgcctaactcaataatcttctttgtctttgggaaaggtcctgtgctgttatgttctgtgttctcacttcactgtggaagctgctctcaaagtataagaatagaccagccatgaaaagtgaaatagttcagctatacttgagcatcctgaaacacttagaaatctattcttaaccagcagcatctgttccaaggcagcaggtctagcattgccaatgccctactgagcagccttgagctttggtttttagaagactagggaatgtatttgccacacctcagacttgggaaatgaagatagtactagtgagccacatcctccc

SEQ ID NO: 63402 - DNA, 280 bp, Homo sapiens
tgacctgaaaacaggaccagtaaccccagatcaaccgccagccacaccctgggcaccatctcccccagaagtcctttggtgccccagggccagcacctgctaaggttctccagcccctcagtgctccctggggaatagcagctcatcaggggtgccgtccaatccccaatggggtttcctgtgcggctctggagggctctggttccctcggtctccagagaaacatgtgaggacagcgatggttttgcagtttctggcgccgcccgcaacacaactccag

SEQ ID NO: 63403 - DNA, 173 bp, Homo sapiens
cagcatgaaactgcttttcagtgggataatttcacaatctccttgcagttttaaaattctaccatctgttagctaagcactgatactgtgtttgatttttctactctagttaaacagctcagcttagtgttccttaaatataccttatatttttccaacttcatccagtttct

SEQ ID NO: 63404 - DNA, 685 bp, Homo sapiens
attaggttgattaggggtaaggggtgtaacagaatatacttgcattttttttttctgaattgaggataaataatttagtttctcaactctaattataagggttgctgtaggatttgaatagatgttctttatcaagttgaaagtattaacttctattcctaccttgcagagaatgtttattatgaatgggattttgtcaaatgctttttctgcctcaattaaaatgttcgtgtgaatttcttttttagcgtattgatatgctagattacatttatttgtaaagaataaatgtttagacagatttttcccaagagatctttctgtatgttaagacattgcattagtggaatagagcttacttggctgtagtgtgtagtactttctatgcagtttgtttgtatttatttcgctaagtagatctcagctttaattttctgtattttcctgtccctgcagatttcagtggcagtttaccctgcaacctcagttcttagatgggtccaagaaaagttgttgaattttacagctttttcttgttataaagatgtaactaccaaacactttatatgttggagttaaaatcagaagccccctgctaccccatccagttaaaaaaacaaaaacaaaaacaaaacaaagctagtatcttagtcctcatgaaataatagtgataccctcctgcaaa

SEQ ID NO: 63405 - DNA, 93 bp, Homo sapiens
  misc_feature (49)..(49): n is a, c, g, or t
gagaccaccaagctcatcctgcagttcctggccaccatcagtggccagnattcgtggattgagcagcaggtcctggaagccaaccccatcctg

SEQ ID NO: 63406 - DNA, 441 bp, Homo sapiens
gggagtcagccagacccccatcctgacaaggcttgtggaactgctgactcaggatgtcggggttcaggctgggtgaccacgtgtggctggagcctccttccacccacaagaccagcgtggccatcgggggcatcatcaaagaggcaaagccaggcaaagtcttggttgaagatgacgagggcaaggaacactggatccgagcagaggactttggtgtcctcagtcccatgcaccccaactcagtccagggtgtggacgacatgatccgcctgggggacctgaacgaggcaggcatggtgcacaacctcctgatccgctaccagcagcacaagatctatacatacacaggctccatcctggtggccgtcaacccgttccaggtgctgccgctctacaccctggagcaggtacagctctacccacacacctgaccatatgggc

SEQ ID NO: 63407 - DNA, 571 bp, Homo sapiens
ctaaagacatgaggcttctgggggcagagataaaggactttattattttcagcacagcaggcagcatgaacttaacattcctattaattccctttgctcccaagtgccaagaagatgacatgaaacagtccagtgcagtgaattcttataattctgcatacaagctggactttctcatacaaaaagcagggctcattcacccgacacagtttccagttctatacctcaatgtggttgatccagatatctgccttatataaattcctcctggtaaccacctccctatgggccatctacatatggcctacctgactgaccccccaaccctcataccgcacatggactacacagacatgccacagtgactatctctcagtcactgtgtgacctcctcaatgcatgcctgcttgctttaaacccaccaactaaaactctgtttggataatgccctggacccaataaaggcgttggcccatgggtccctttctctctcttcctgacctccctgtgtggtgttcaggtatgctgtgtacccctaggacttgtaagtaataaaatttttatttccatc

SEQ ID NO: 63408 - DNA, 1490 bp, Homo sapiens
tttacaaagggctcagtcccttcggggaggcttctggtgaaggaggatcgctagaaccaagctgtcctcttaagctagttgcagcagcccctcctcccagccacctccgccaatctctcactcacctttggctcctgcccttagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactgagacatcagggtggcgactctatagactctaggacataaattagaggtctccaaaatcggatctggggctctgggatagctgacccagccccttgagaaaccttattgtacctctcttatagaatatttattacctctgatacctcaacccccatttctatttatttactgagcttctctgtgaacgatttagaaagaagcccaatattataatttttttcaatatttattattttcacctgtttttaagctgtttccatagggtgacacactatggtatttgagtgttttaagataaattataagttacataagggaggaaaaaaaatgttctttggggagccaacagaagcttccattccaagcctgaccacgctttctagctgttgagctgttttccctgacctccctctaatttatcttgtctctgggcttggggcttcctaactgctacaaatactcttaggaagagaaaccagggagcccctttgatgattaattcaccttccagtgtctcggagggattcccctaacctcattccccaaccacttcattcttgaaagctgtggccagcttgttatttataacaacctaaatttggttctaggccgggcgcggtggctcacgcctgtaatcccagcactttgggaggctgaggcgggtggatcacttgaggtcaggagttcctaaccagcctggtcaacatggtgaaaccccgtctctactaaaaatacaaaaattagccgggcatggtggcgcgcacctgtaatcccagctacttgggaggctgaggcaagagaattgcttgaacccaggagatggaagttgcagtgagctgatatcatgcccctgtactccagcctgggtgacagagcaagactctgtctcaaaaaaataaaaataaaaataaatttggttctaatagaactcagttttaactagaatttattcaattcctctgggaatgttacattgtttgtctgtcttcatagcagattttaattttgaataaataaatgtatcttattcacatc

SEQ ID NO: 63409 - DNA, 724 bp, Homo sapiens
acatcattcacctcttttaatctcaatgttttgaaagcaaagctctaagaagggcccaattgactgacaggatttcccctggcattttagaagggacaagggggctattcatccccaggctagtgtctatgagtaattcctccaggtaatttatttctccaactgaaatgatgccctcactactaatggtttcccctgttctgtcaccaatattggaaaatcagttggtgtctatttgtaggacaaggctatgtgaagggtttggtcccagtagcttccctcctcagatgcttagaagtgttcctcggtggctgtgactgacggggaggaacaggagagagaggcagaaaaggacaggctgaagaatgcctcgctcagcactgcaggagatactgtagagttctgggggaggaaggaatcccaagacctgggttgtcatccaagccttgcaaacatcttggagtgagtcctggagaaatacatttaactcccagggccatggaagcagggctcagttctctctgggagctgtgaggcaaggcatttggataaatctggcctcctcatgatgccaccagcttgtcccctaagtgtgatggacatggagctggaagccaggatcaccaacactttctcttttcttccacagcatcagggctgttggcaggtggccttggttcttcttcacagggcttcttgagtgtcctcgcaacatggcagctgt

SEQ ID NO: 63410 - DNA, 1632 bp, Homo sapiens
ctacacatcaggggcttgctcttgcaaaaccaaaccacaagacagacttgcaaaagaaggcatgcacagctcagcactgctctgttgcctggtcctcctgactggggtgagggccagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactgagacatcagggtggcgactctatagactctaggacataaattagaggtctccaaaatcggatctggggctctgggatagctgacccagccccttgagaaaccttattgtacctctcttatagaatatttattacctctgatacctcaacccccatttctatttatttactgagcttctctgtgaacgatttagaaagaagcccaatattataatttttttcaatatttattattttcacctgtttttaagctgtttccatagggtgacacactatggtatttgagtgttttaagataaattataagttacataagggaggaaaaaaaatgttctttggggagccaacagaagcttccattccaagcctgaccacgctttctagctgttgagctgttttccctgacctccctctaatttatcttgtctctgggcttggggcttcctaactgctacaaatactcttaggaagagaaaccagggagcccctttgatgattaattcaccttccagtgtctcggagggattcccctaacctcattccccaaccacttcattcttgaaagctgtggccagcttgttatttataacaacctaaatttggttctaggccgggcgcggtggctcacgcctgtaatcccagcactttgggaggctgaggcgggtggatcacttgaggtcaggagttcctaaccagcctggtcaacatggtgaaaccccgtctctactaaaaatacaaaaattagccgggcatggtggcgcgcacctgtaatcccagctacttgggaggctgaggcaagagaattgcttgaacccaggagatggaagttgcagtgagctgatatcatgcccctgtactccagcctgggtgacagagcaagactctgtctcaaaaaaataaaaataaaaataaatttggttctaatagaactcagttttaactagaatttattcaattcctctgggaatgttacattgtttgtctgtcttcatagcagattttaattttgaataaataaatgtatcttattcacatc

SEQ ID NO: 63411 - DNA, 655 bp, Homo sapiens
agacgagtcgttttaaaaggtagctttgaaaaacaaaaaaggatttaaaattcaaagactttgggaaaattcaacttaaccaataacatgagtaacgactattactatttcctgagtccttaccatatgccaaataccgttgtacattgtacctgcttcacataaattatttcatctcattctcacaacattctgtgaagcgcgggtactttattatctatccctgtttgccagataaggaagctgagacttcatacagtgacttacaagttcggacagcctccagcaaacacaggaaacagaattcgaacccatgcagtctgcctcagagccaaagcccttggccatttttctatcctgccttccacagatcatttctgcctacagcagaggtcagaaactgacaaccagctggccttacctagccttaggtaacagtaatggctattgaacacttactatgtgtcaggattattttacacacattcatgtgttccttcatttaatcttcaaagcaactccatgaggtaggtggcagttattatccccattttacagatgagaaaactgagaccaagaggaagtaacacttcccaaatgttagcagaactaacatccaaatccagactgtctcattccagaatcccctcctctt

SEQ ID NO: 63412 - DNA, 475 bp, Homo sapiens
ggaatttaggatgactgagatttttgccatggcaactgggtagatggtgccatttagcaatataagaatattcatacagtgacttacaagttcggacagcctccagcaaacacaggaaacagaattcgaacccatgcagtctgcctcagagccaaagcccttggccatttttctatcctgccttccacagatcatttctgcctacagcagaggtcagaaactgacaaccagctggccttacctagccttaggtaacagtaatggctattgaacacttactatgtgtcaggattattttacacacattcatgtgttccttcatttaatcttcaaagcaactccatgaggtaggtggcagttattatccccattttacagatgagaaaactgagaccaagaggaagtaacacttcccaaatgttagcagaactaacatccaaatccagactgtctcattccagaatcccctcctctt

SEQ ID NO: 63413 - DNA, 448 bp, Homo sapiens
ataaattttgtagaataaaaggtgaatttgcattaaaggttcactttaatgaaggtgaaagatgagaaacacatgtttgccaagacagtactctgtactcacctaaaattcatccaccttcccattcttcctattatagtacaggaaaggtccttcctgtcaaaggcaaaatcacttatgattgtgtccccatctctcttgccttttcaaggactttgagcctatgctgccactgcttcattgtttttttttgtatgtttgttttgtcttgtttttgttttaacagcagctttattgagatataattcaagttctgccctttggagaaatactgagcaagtctttcattctctgtgtgacagccctctgaatatttgaagttgtttgttgtaacttaaggttataacagcccttagttcatttactctgcatttgttcaataaatatt

SEQ ID NO: 63414 - DNA, 691 bp, Homo sapiens
gtccataaagcgtttcacttatattcttcaaacatgatgctaatttaaattaattacttcctatgatatgttattattcctatgattttgccactgttattagttctctcaaaaatacatctagggaagaggattattttaagtaatttgattatctttctatctcttttatttatttctcatttacttaagaaattcgttccattggttggcattgatacagtaaatttgtaaatgaggagacaatataaaaaatctaaattacttgtgcttaatgactgtagcagaatgccttttctctaaatcagattgtctttcttgcagtttagtttgatagatttgcaagctatgctgcttccatgaagttagctgcgctggtaggaacgcaggcttctttgtctctggttgtagcttgcatgatcgccccattaggcagacaacgtagccggagatcacaaatcaggcccttggctgtagttgctagtgtgtggaggtgcagagcaggttggcagaaactgacctcactgggcaagggtggccatggacctgattctttaatgcactctatgtgttcaggaagccacaggccatttttgactctgggaaagaaaacaagaggaaaaaccccaccaaagtattaaccaacccctttaaggatacatctattttaaagtgaaattaatttttcagt

SEQ ID NO: 63415 - DNA, 3695 bp, Homo sapiens
caggctccaccaagaagctaggtggtttccaggcccctgccctccccttcctcccatccttgtccttctctccctcagaagcctcaggacccaacaggtggcaggcagtggacagggtgcccgccccacagtgctttccccagcaccccagagccagtcgggacaccccccgcagcccgtcctggtggctgtggaactgcactgggtggcgggcagatggtggaaggcagcttaggagacctcaccaaagagaagatggaccggctcttgctcccagctcctattaggcccggggtgggaccagaggtcataggtgcccaacggcagccaaaccaaagacactggtgtgcatggggcagcatggttgtgcacgtgggaccctggggcggacccaggagccaaactcttgaagcaccccctgggtcaggcccagcagcggagtggccagccccagtttcccattgctcctctctgcggccagggccaggtgggttcatatttacagatatgcccagccagtcctggtcggccacaccagtgtcccaaagaggagagcgcagcagagccaggggtctgttctgtagcagccacccccctgcccccactccagggcagccatgatgtgcttgggcccaccagggccttccgggctgctctcttccctgagcccggaaccggcgacgcacatgtgtcttttgttggtgtgtttgtttttttccagggaggtctaattccgaagcagtattccaggttttctctttgttttatcagtgccaagatgacctgttgtgtcatataatttaagcagagcttagcatttattttattctttagaaaacttaagtatttacttttttaaagctatttttcaaggaacctttttttgcagtattattgaatttattttctaaatcaggattgaaacaggaacttttccaggtggtgttaataagccattcaagtgccttacacagctttgaagaaactaggactgcagtgggctcggataggcccattgaggtttttagaaaagcaggatttgttttgttagggaggcatgattttggtgagatctttctggaagagttttccgcctctttgtgatgctgaacacccccaaggttctcccctccccccgctgcccaggtgactggcaggagctgcgactgccacgtagtggtgcctgggcccgacagcggggctctgggcatcccgggtgaccttggcccatctgcctgcattcccacccccttgggcctggctggatcccaggcagagggaccttgctgctgtgtgattggaacattcccaaatatcttgtgaatttgtaatcaaattggtctcattgggaaagactcttaattaagaggctcaggcaagcacagaggcagcccgtgggtctctgtctcagtctggaggcagcagggatgctgctgggagtccatggcacaggccacagcccctcaccttgccgcggtggctggcagcacgcctgccttgctctgccccatgccctgaacaggcatgagagctccacgtcccctagtgcaccctgagagggggctcacaagtgaccgatcctgggtgcctcagggagctcactgagggcgtgcaaagttgaaagtggcaaggctgggggagggtgtcgggtagagggaagagggcagggggctaggggaggactcagaggccatctgcagggccaagccacaggaagggctgagctggaggtgggcagggctgctccaggcaggtcagagcagtgcagggggaggagaggagaaagggaggaagctgggctgtgtggtccccatgaaggcattcagagtccacctgcagacagcgagagccccaggaaggtttgcacagctgtgccccaagcaccttggcctcctctcagctcgccgaggaggcacgctagagccgccttcccggtgggagccctctgtcccacagggagcggggagccagctttgctggggccctacctgcatgcccagccttacccctcattctcacagcacagatgaggttgagaccatgcagtcaatgcattgcttaaggtctcttatttacaaaaaaaaaccttaaacatagtcgctgtcattcagacattcagagaatggttggccacaaacaatgaccaagtattgcttggcttaacttgaaggcctgctgtctccttctgggggtcagggacgcagctccaccctcaccactagcccaccctgcccgtgggcataaaccttgacgaagagagagaatgattggcatctgcttttctcttttctttgctaataattctgttcctggctgccgagagtgaagtttcaccatgtggaggtttggctcctatcacctggtggtctgattcataccctagcctgaggctccactggaagatctcgcagcctcagtgtatgggaaaccctttccccaggcttgtcccagcactgccgctccccacccctgagccaggaccccagaggatgggccatgccccgtgcctggcagaggtctggtgccagcactgggagctgctccgcccttgccttggggccgagggagccctcgtccacccctgcacagcagctgggcacagaggagcgctcttccatcttgaccaggactgcaccaagaagcaccaggtgtcttcagcctccaacctccggggcgaccttctcttccagccacagtcccatgagggcccctagccagggacactggtctgtaaattgtaatcctttctccagcccagctctccacttgttccttgtgtgagctgagcaggcagtgcacctctgagtgtcccttttgtaaggcccaggggttgcactgagtctgcagaggccgcgacctcctagaacgctgtgggtgcaggtgagccggcgtgtcctggggagatgctgccagcacacaggggccctcctgctgccagcaggttggggtggttaagtcttattagtgtctattcttaaaattaagtgggctggagaagaatggagctccacatgccagcaccgtatatggaatacaaaagctggggaagcagggcctgccttacaggtgtggctgactctgagcccaggcctgcaggggtggagggcagtccctcagaatcccagaggcagtcccagcctcagaacccaggataggaaatgggtgtgtttagtggggaaagggacggggtgcagacggcagggccagtatggggccccctccctctcctctcctctcctatggtgagcccagcgtgggcaccgggccgtctcagccgtgttcccagggctgggaggacagctctggcccttcttaggcctagcctcgtcccaagctaaatgtaagccagttgggctgtgttaaaggaagcagtgtttttggttcgattctgcctctgtagctcaaggggggcagcccccagagtcctgtgcattctgccaaggctccatagctttgccaaatgcacggagctctgccattccggtgcagtgcaggccttgcgaagggtttatctgcgttcgtctcggtgggcttctcctgcatgggagttgtgttcctgtgcaagggggagctttgctccaggacaggatgactgtcttccctattcttagggacaagtcccaagatgccagaaaggcagtctcccaaggacccaccatgcagaagtgtcaataaaccacaagttctgaactctg

SEQ ID NO: 63416 - DNA, 2908 bp, Homo sapiens
caggctccaccaagaagctaggtggtttccaggcccctgccctccccttcctcccatccttgtccttctctccctcagaagcctcaggacccaacaggtggcaggcagtggacagggtgcccgccccacagtgctttccccagcaccccagagccagtcgggacaccccccgcagcccgtcctggtggctgtggaactgcactgggtggcgggcagatggtggaaggcagcttaggagacctcaccaaagagaagatggaccggctcttgctcccagctcctattaggcccggggtgggaccagaggtcataggtgcccaacggcagccaaaccaaagacactggtgtgcatggggcagcatggttgtgcacgtgggaccctggggcggacccaggagccaaactcttgaagcaccccctgggtcaggcccagcagcggagtggccagccccagtttcccattgctcctctctgcggccagggccaggtgggttcatatttacagatatgcccagccagtcctggtcggccacaccagtgtcccaaagaggagagcgcagcagagccaggggtctgttctgtagcagccacccccctgcccccactccagggcagccatgatgtgcttgggcccaccagggccttccgggctgctctcttccctgagcccggaaccggcgacgcacatgtgtcttttgttggtgtgtttgtttttttccagggaggtctaattccgaagcagtattccaggttttctctttgttttatcagtgccaagatgacctgttgtgtcatataatttaagcagagcttagcatttattttattctttagaaaacttaagtatttacttttttaaagctatttttcaaggaacctttttttgcagtattattgaatttattttctaaatcaggattgaaacaggaacttttccaggtggtgttaataagccattcaagtgccttacacagctttgaagaaactaggactgcagtgggctcggataggcccattgaggtttttagaaaagcaggatttgttttgttagggaggcatgattttggtgagatctttctggaagagttttccgcctctttgtgatgctgaacacccccaaggttctcccctccccccgctgcccaggtgactggcaggagctgcgactgccacgtagtggtgcctgggcccgacagcggggctctgggcatcccgggtgaccttggcccatctgcctgcattcccacccccttgggcctggctggatcccaggcagagggaccttgctgctgtgtgattggaacattcccaaatatcttgtgaatttgtaatcaaattggtctcattgggaaagactcttaattaagaggctcaggcaagcacagaggcagcccgtgggtctctgtctcagtctggaggcagcagggatgctgctgggagtccatggcacaggccacagcccctcaccttgccgcggtggctggcagcacgcctgccttgctctgccccatgccctgaacaggcatgagagctccacgtcccctagtgcaccctgagagggggctcacaagtgaccgatcctgggtgcctcagggagctcactgagggcgtgcaaagttgaaagtggcaaggctgggggagggtgtcgggtagagggaagagggcagggggctaggggaggactcagaggccatctgcagggccaagccacaggaagggctgagctggaggtgggcagggctgctccaggcaggtcagagcagtgcagggggaggagaggagaaagggaggaagctgggctgtgtggtccccatgaaggcattcagagtccacctgcagacagcgagagccccaggaaggtttgcacagctgtgccccaagcaccttggcctcctctcagctcgccgaggaggcacgctagagccgccttcccggtgggagccctctgtcccacagggagcggggagccagctttgctggggccctacctgcatgcccagccttacccctcattctcacagcacagatgaggttgagaccatgcagtcaatgcattgcttaaggtctcttatttacaaaaaaaaaccttaaacatagtcgctgtcattcagacattcagagaatggttggccacaaacaatgaccaagtattgcttggcttaacttgaaggcctgctgtctccttctgggggtcagggacgcagctccaccctcaccactagcccaccctgcccgtgggcataaaccttgacgaagagagagaatgattggcatctgcttttctcttttctttgctaataattctgttcctggctgccgagagtgaagtttcaccatgtggaggtttggctcctatcacctggtggtctgattcataccctagcctgaggctccactggaagatctcgcagcctcagtgtatgggaaaccctttccccaggcttgtcccagcactgccgctccccacccctgagccaggaccccagaggatgggccatgccccgtgcctggcagaggtctggtgccagcactgggagctgctccgcccttgccttggggccgagggagccctcgtccacccctgcacagcagctgggcacagaggagcgctcttccatcttgaccaggactgcaccaagaagcaccaggtgtcttcagcctccaacctccggggcgaccttctcttccagccacagtcccatgagggcccctagccagggacactggtctgtaaattgtaatcctttctcctgcatgggagttgtgttcctgtgcaagggggagctttgctccaggacaggatgactgtcttccctattcttagggacaagtcccaagatgccagaaaggcagtctcccaaggacccaccatgcagaagtgtcaataaaccacaagttctgaactctg

SEQ ID NO: 63417 - DNA, 2935 bp, Homo sapiens
caggctccaccaagaagctaggtggtttccaggcccctgccctccccttcctcccatccttgtccttctctccctcagaagcctcaggacccaacaggtggcaggcagtggacagggtgcccgccccacagtgctttccccagcaccccagagccagtcgggacaccccccgcagcccgtcctggtggctgtggaactgcactgggtggcgggcagatggtggaaggcagcttaggagacctcaccaaagagaagatggaccggctcttgctcccagctcctattaggcccggggtgggaccagaggtcataggtgcccaacggcagccaaaccaaagacactggtgtgcatggggcagcatggttgtgcacgtgggaccctggggcggacccaggagccaaactcttgaagcaccccctgggtcaggcccagcagcggagtggccagccccagtttcccattgctcctctctgcggccagggccaggtgggttcatatttacagatatgcccagccagtcctggtcggccacaccagtgtcccaaagaggagagcgcagcagagccaggggtctgttctgtagcagccacccccctgcccccactccagggcagccatgatgtgcttgggcccaccagggccttccgggctgctctcttccctgagcccggaaccggcgacgcacatgtgtcttttgttggtgtgtttgtttttttccagggaggtctaattccgaagcagtattccaggttttctctttgttttatcagtgccaagatgacctgttgtgtcatataatttaagcagagcttagcatttattttattctttagaaaacttaagtatttacttttttaaagctatttttcaaggaacctttttttgcagtattattgaatttattttctaaatcaggattgaaacaggaacttttccaggtggtgttaataagccattcaagtgccttacacagctttgaagaaactaggactgcagtgggctcggataggcccattgaggtttttagaaaagcaggatttgttttgttagggaggcatgattttggtgagatctttctggaagagttttccgcctctttgtgatgctgaacacccccaaggttctcccctccccccgctgcccaggtgactggcaggagctgcgactgccacgtagtggtgcctgggcccgacagcggggctctgggcatcccgggtgaccttggcccatctgcctgcattcccacccccttgggcctggctggatcccaggcagagggaccttgctgctgtgtgattggaacattcccaaatatcttgtgaatttgtaatcaaattggtctcattgggaaagactcttaattaagaggctcaggcaagcacagaggcagcccgtgggtctctgtctcagtctggaggcagcagggatgctgctgggagtccatggcacaggccacagcccctcaccttgccgcggtggctggcagcacgcctgccttgctctgccccatgccctgaacaggcatgagagctccacgtcccctagtgcaccctgagagggggctcacaagtgaccgatcctgggtgcctcagggagctcactgagggcgtgcaaagttgaaagtggcaaggctgggggagggtgtcgggtagagggaagagggcagggggctaggggaggactcagaggccatctgcagggccaagccacaggaagggctgagctggaggtgggcagggctgctccaggcaggtcagagcagtgcagggggaggagaggagaaagggaggaagctgggctgtgtggtccccatgaaggcattcagagtccacctgcagacagcgagagccccaggaaggtttgcacagctgtgccccaagcaccttggcctcctctcagctcgccgaggaggcacgctagagccgccttcccggtgggagccctctgtcccacagggagcggggagccagctttgctggggccctacctgcatgcccagccttacccctcattctcacagcacagatgaggttgagaccatgcagtcaatgcattgcttaaggtctcttatttacaaaaaaaaaccttaaacatagtcgctgtcattcagacattcagagaatggttggccacaaacaatgaccaagtattgcttggcttaacttgaaggcctgctgtctccttctgggggtcagggacgcagctccaccctcaccactagcccaccctgcccgtgggcataaaccttgacgaagagagagaatgattggcatctgcttttctcttttctttgctaataattctgttcctggctgccgagagtgaagtttcaccatgtggaggtttggctcctatcacctggtggtctgattcataccctagcctgaggctccactggaagatctcgcagcctcagtgtatgggaaaccctttccccaggcttgtcccagcactgccgctccccacccctgagccaggaccccagaggatgggccatgccccgtgcctggcagaggtctggtgccagcactgggagctgctccgccccttcttaggcctagcctcgtcccaagctaaatgtaagccagttgggctgtgttaaaggaagcagtgtttttggttcgattctgcctctgtagctcaaggggggcagcccccagagtcctgtgcattctgccaaggctccatagctttgccaaatgcacggagctctgccattccggtgcagtgcaggccttgcgaagggtttatctgcgttcgtctcggtgggcttctcctgcatgggagttgtgttcctgtgcaagggggagctttgctccaggacaggatgactgtcttccctattcttagggacaagtcccaagatgccagaaaggcagtctcccaaggacccaccatgcagaagtgtcaataaaccacaagttctgaactctg

SEQ ID NO: 63418 - DNA, 675 bp, Homo sapiens
tccgtctttattaacgaaagtgtttactgcctaagccagacactgagagccaccatgtattcctctctctctctcacctattcccatgtttaatccattatttggattggtccattttatctccattttctcaaatacaggaaaagacagatcatcatcaaccagcaattgtgactatctacatattcacataaggatttcccaacttggggtatttttgtcaagttgagaccaggcatcttggagttagttccatcaggttactgtgactgtcatcgatagcctccaagggaaaacaactcacaagagtcagcctgggacatatgagaaagagatgccggtctcctacctcttgtttcctcacttgaagtgcaacccatttccaaccatcttttctttccaactactcagggtcctgctttgatttttctatgcacacagctgacatatgctgggcctaagaaagggaggctgcaggactggacatgctggtttgctagggaaccagtgaatcctctgtgaagcttgtccagtgaagacccaaatatttacaaattatcaggaaagaactcattctctttctctctgtatattctgtctgtattggctttccattgcttcagtaataaactaccgcaaatttagcagcatacaataaaactttattatcttata

SEQ ID NO: 63419 - DNA, 565 bp, Homo sapiens
aaaaaaaaaagtgcgtaaaatgccttgcttcatgagttcccagctttacagggaatgagtaaaaattgtcactttctggcaggttcaagaaccttattataagcaaaatccaaaggctgctttggtttggtttcctagcctcaagaggttctaaaatctaagatctcctacatcatcaacgggagagaaaaattatgcttctaaggaaagcaaagttacacctgtttttagattttaaccctgtacattgtcttcaagtccttgttatctgcctgtggactgaactagatcctgaattctcctaagttcctccaatattaggttataacagtcctgatggagtcccccaaccctcttgcctcgatcctgactagggatgctccagggacattcaggtgacttccccttcttaaaaatctgaccagctagggacattagataccagaattgggaacaaactagatccataagatactatggtcagtaatgagatcttattggtcagtgacttttttttttttttaaatggagtctcactctgtcacccagagtggagtgcagtggc

SEQ ID NO: 63420 - DNA, 455 bp, Homo sapiens
ttttaagctttgtggaccacatggcctctgatgcagctactcaactttgtaagtttgtgtgatgtaggggagggaagactttccctctagcctcaagttcagtaattcagtagaacttatgattgttcagaacttgagtctataaaataagctgacaagaggcagattttatcagtccattcttacattgctataaatatctgagactgggtaatttaaaacctaggtgatttaaacctgttttaaagaaaacaataacacagggacacagagaggggaacatcacacactggggcctgtcgggggttcgggggctagggaagggatagcattaggagaaatacctaatgtagattacgggttcatgggtgcagcaaaccaccatggcacatatatacctatgtaacaaacctgcatgttctgcacatgtatccaagaacttaatgtatcattta

SEQ ID NO: 63421 - DNA, 121 bp, Homo sapiens
agaagtagaagaaaacagctttattgaagcagcggtgttgcagctttgtgactgtccctgcagagcagggctaccctggaggctgagagcagcagctcagggcaggcctgcagccatgttt

SEQ ID NO: 63422 - DNA, 389 bp, Homo sapiens
gtttggtgaatttggtctgtgataaaattggagttcaagaaacaaacaggaaactacaagtgccccttcgcccccaggtcacccgagtggcagggcagtgaccgctgctctcaggctgcccagtgtggacctgcctgtcggaatgctcctcctccacgtcccctcgctcctgtgtcccagccacatgcaccttccctctacctctgggatccctgcaccaggtctgcccctgtcttctcagggctgctcctcttggcccacaggacctcagctggaatgttgcctcctccaagaggccttcctgactattagctcacagtggccacccagccacactctgccatgtgcttggggattgtctgttactgcaacatactgcagcccatact

SEQ ID NO: 63423 - DNA, 1552 bp, Homo sapiens
tcatcacactaactgcaaaatcaaaccaaataatgccttatcaatgatgcagctcagaggaagtagtgtgtcccccacacccagacagtgccgcgcagctccagggaacgaggtgccgtgtctcgcttccattttgcagtacagggaattttttttttttttttttttttttttgctgcctaatgtaatacatcacaaagtaaaggcaagagtgggcttggccctccgatgccaaccacagggccccttttgtaactgaataatcctccaagtagccagtgctcctactgtttacagtgtccctcgtgcccaagtctctgtcactttcatcctgttccctccaagttcccagtcccatcccagtagccagctttatgagattttggtatttcttccctacagattaaaaacatacacaactcatcattatgctaaactaccagttgtatctcagaggtctccccttctgcccttgcttcgagtgtggacttccatggaaaatatgacatgaaaaagtgtagaacgaaacatcgtgtgaaatacctgccacaaatacctagtgcctcactgcccccatcttaggatccttggagccacccgtcaggcaaaacctagctcccttctgagctaaaggagaaccttgcctgacaactccacattcattcccttgtggtgggcacctgtctgtggggagatgtgtgcaagctcagccactctgaatatggaaaaggtcaggccgggctggtcctgctcttcactccctcttcttgatcctgtagggagtggaaatgtgtttttgcttgctgcctgacccctgatgttccccatctttggtcggggaagactgtgacagaggaaggagaaaaaatagaaggaaacagactgatccctgggctgtgctcaaaatagctgccctttaaaggaaatcaggcagggaggggagggaaaccagcgaaaaagaaatttgctttgcaacaacccacgcacacattcacccctgaagtatatcatgaacagaccaagccatccagaaaggcagccggtcaggagggtgtgggcaaacatgactgcatctgcctcactgttgtctggagtaacgactcaggtggtgtcctgcagcagtgctgtgctttctcattccagatggaagcaagtgagccagggtcaaattcccttctccaggggaatgaatcaagcccaaactgtaacagctaaataagtagaagtttttgcaggtcatcagctctgggcataactaatttgttttattggttctggaagatttccaaaaagccagaatttattattataacagtgtccactccactgccctcacagttgtgtaaaataattatagaagttttaatgatcctgattaagaagaccctagacaaaggcaattccaccttcagagtagactgcctgccctaatgaggtgtttagacattcgtgtctcctatggctgggatggaaattaaaataacactatttaaggacagagcgggccaggagcagtggctcatgcaggtaatcccagcatgggaggctgagg

SEQ ID NO: 63424 - DNA, 1226 bp, Homo sapiens
ctcgtgccgaattcggcacgagtgacagcatttaacaaagcttagagaaacctccaggagactgctaccatggcagagaagcccaagctccactactccaatatacggggcagaatggagtccatccggtggctcctggctgcagctggagtagagtttgaagagaaatttataaaatctgcagaagatttggacaagttaagaaatgatggatatttgatgttccagcaagtgccaatggttgagattgatgggatgaagctggtgcagaccagagccattctcaactacattgccagcaaatacaacctctatgggaaagacataaaggagaaagccctgattgatatgtatatagaaggtatagcagatttgggtgaaatgatccttcttctgccctttagtcaacctgaggaacaagatgccaagcttgccttgatccaagagaaaacaaaaaatcgctacttccctgcctttgaaaaagtcttaaagagccacggacaagactaccttgttggcaacaagctgagccgggctgacattcacctggtggaacttctctactacgtggaagagcttgactctagccttatttccagcttccctctgctgaaggccctgaaaaccagaatcagtaacctgcccacagtgaagaagtttctacagcctggcagcccaaggaagcctcccatggatgagaaatctttagaagaatcaaggaagattttcaggttttaataaaccagccatagaggtcaagaacatgcaagaccagtattctaaagttttgcaacaattaagtgctttacctaagtgttgattgtgcctgttgtgaagctaatgaactctttcaaattatatgctaattaaataatacaactcctattcacccacttagttaaaattgatttcttctcattaggatctgatgtgaattcagttttccaatctcctcctagccaacaattttcttggaattacaaattcagtaaaaatggaaactataaattatgtggtttgtttgacttttccaagaattgccctgtaacatacaatttgtcatacaatctattaaaatgccaatgtaaaaatgcacctctgacattttcaggtatgcacaggagaagagttaccatcctggataatggcataaagacattttcttcttttcctgaacagtcattttatttctgataaaagcattctttctaatgcatttgcaaaac

SEQ ID NO: 63425 - DNA, 964 bp, Homo sapiens
ctcgtgccgaattcggcacgagtgacagcatttaacaaagcttagagaaacctccaggagactgctaccatggcagagaagcccaagctccactactccaatatacggggcagaatggagtccatccggtggctcctggctgcagctggagtagagtttgaagagaaatttataaaatctgcagaagatttggacaagttaagaaatgatggatatttgatgttccagcaagtgccaatggttgagattgatgggatgaagctggtgcagaccagagccattctcaactacattgccagcaaatacaacctctatgggaaagacataaaggagaaagccctgattgatatgtatatagaaggtatagcagatttgggtgaaatgatccttcttctgccctttagtcaacctgaggaacaagatgccaagcttgccttgatccaagagaaaacaaaaaatcgctacttccctgcctttgaaaaagtcttaaagagccacggacaagactaccttgttggcaacaagctgagccgggctgacattcacctggtggaacttctctactacgtggaagagcttgactctagccttatttccagcttccctctgctgaaggccctgaaaaccagaatcagtaacctgcccacagtgaagaagtttctacagcctggcagcccaaggaagcctcccatggatgagaaatctttagaagaatcaaggaagattttcaggttttaataaaccagccatagaggtcaagaacatgcaagaccagtattctaaagttttgcaacaattaagtgctttacctaagtgttgattgtgcctgttgtgaagctaatgaactctttcaaattatatgctaattaaataatacaactcctattcacccacttagttaaaattgatttcttctcattaggatctgatgtgattcgcgaatgggtaccgcagctcggtcgta

SEQ ID NO: 63426 - DNA, 1261 bp, Homo sapiens
gtgctttttccctaacttgacccttctttcagtgggagggaactattgagaggaacaaagagcttataaatacattaggacctggaattcggttgtccagccacaaaggtgacagcatttaacaaagcttagagaaacctccaggagactgctaccatggcagagaagcccaagctccactactccaatatacggggcagaatggagtccatccggtggctcctggctgcagctggagtagagatggatatttgatgttccagcaagtgccaatggttgagattgatgggatgaagctggtgcagaccagagccattctcaactacattgccagcaaatacaacctctatgggaaagacataaaggagaaagccctgattgatatgtatatagaaggtatagcagatttgggtgaaatgatccttcttctgccctttagtcaacctgaggaacaagatgccaagcttgccttgatccaagagaaaacaaaaaatcgctacttccctgcctttgaaaaagtcttaaagagccacggacaagactaccttgttggcaacaagctgagccgggctgacattcacctggtggaacttctctactacgtggaagagcttgactctagccttatttccagcttccctctgctgaaggccctgaaaaccagaatcagtaacctgcccacagtgaagaagtttctacagcctggcagcccaaggaagcctcccatggatgagaaatctttagaagaatcaaggaagattttcaggttttaataaaccagccatagaggtcaagaacatgcaagaccagtattctaaagttttgcaacaattaagtgctttacctaagtgttgattgtgcctgttgtgaagctaatgaactctttcaaattatatgctaattaaataatacaactcctattcacccacttagttaaaattgatttcttctcattaggatctgatgtgaattcagttttccaatctcctcctagccaacaattttcttggaattacaaattcagtaaaaatggaaactataaattatgtggtttgtttgacttttccaagaattgccctgtaacatacaatttgtcatacaatctattaaaatgccaatgtaaaaatgcacctctgacattttcaggtatgcacaggagaagagttaccatcctggataatggcataaagacattttcttcttttcctgaacagtcattttatttctgataaaagcattctttctaatgcatttgcaaaac

SEQ ID NO: 63427 - DNA, 975 bp, Homo sapiens
gtgctttttccctaacttgacccttctttcagtgggagggaactattgagaggaacaaagagcttataaatacattaggacctggaattcggttgtccagccacaaaggtgacagcatttaacaaagcttagagaaacctccaggagactgctaccatggcagagaagcccaagctccactactccaatatacggggcagaatggagtccatccggtggctcctggctgcagctggagtagagtttgaagagaaatttataaaatctgcagaagatttggacaagttaagaaatgatggatatttgatgttccagcaagtgccaatggttgagattgatgggatgaagctggtgcagaccagagccattctcaactacattgccagcaaatacaacctctatgggaaagacataaaggagaaagccctgattgatatgtatatagaaggtatagcagatttgggtgaaatgatccttcttctgccctttagtcaacctgaggaacaagatgccaagcttgccttgatccaagagaaaacaaaaaatcgctacttccctgcctttgaaaaagtcttaaagagccacggacaagactaccttgttggcaacaagctgagccgggctgacattcacctggtggaacttctctactacgtggaagagcttgactctagccttatttccagcttccctctgctgaaggccctgaaaaccagaatcagtaacctgcccacagtgaagaagtttctacagcctggcagcccaaggaagcctcccatggatgagaaatctttagaagaatcaaggaagattttcaggttttaataaaccagccatagaggtcaagaacatgcaagaccagtattctaaagttttgcaacaattaagtgctttacctaagtgttgattgtgcctgttgtgaagctaatgaactctttcaaattatatgctaattaaataatacaactcctattc

SEQ ID NO: 63428 - DNA, 1313 bp, Homo sapiens
gtgctttttccctaacttgacccttctttcagtgggagggaactattgagaggaacaaagagcttataaatacattaggacctggaattcggttgtccagccacaaaggtgacagcatttaacaaagcttagagaaacctccaggagactgctaccatggcagagaagcccaagctccactactccaatatacggggcagaatggagtccatccggtggctcctggctgcagctggagtagagtttgaagagaaatttataaaatctgcagaagatttggacaagttaagaaatgatggatatttgatgttccagcaagtgccaatggttgagattgatgggatgaagctggtgcagaccagagccattctcaactacattgccagcaaatacaacctctatgggaaagacataaaggagaaagccctgattgatatgtatatagaaggtatagcagatttgggtgaaatgatccttcttctgccctttagtcaacctgaggaacaagatgccaagcttgccttgatccaagagaaaacaaaaaatcgctacttccctgcctttgaaaaagtcttaaagagccacggacaagactaccttgttggcaacaagctgagccgggctgacattcacctggtggaacttctctactacgtggaagagcttgactctagccttatttccagcttccctctgctgaaggccctgaaaaccagaatcagtaacctgcccacagtgaagaagtttctacagcctggcagcccaaggaagcctcccatggatgagaaatctttagaagaatcaaggaagattttcaggttttaataaaccagccatagaggtcaagaacatgcaagaccagtattctaaagttttgcaacaattaagtgctttacctaagtgttgattgtgcctgttgtgaagctaatgaactctttcaaattatatgctaattaaataatacaactcctattcacccacttagttaaaattgatttcttctcattaggatctgatgtgaattcagttttccaatctcctcctagccaacaattttcttggaattacaaattcagtaaaaatggaaactataaattatgtggtttgtttgacttttccaagaattgccctgtaacatacaatttgtcatacaatctattaaaatgccaatgtaaaaatgcacctctgacattttcaggtatgcacaggagaagagttaccatcctggataatggcataaagacattttcttcttttcctgaacagtcattttatttctgataaaagcattctttctaatgcatttgcaaaac

SEQ ID NO: 63429 - DNA, 1367 bp, Homo sapiens
gtgctttttccctaacttgacccttctttcagtgggagggaactattgagaggaacaaagagcttataaatacattaggacctggaattcggttgtccagccacaaaggtgacagcatttaacaaagcttagagaaacctccaggagactgctaccatggcagagaagcccaagctccactactccaatatacggggcagaatggagtccatccggtggctcctggctgcagctggagtagagtttgaagagaaatttataaaatctgcagaagatttggacaagttaagaaatgatggatatttgatgttccagcaagtgccaatggttgagattgatgggatgaagctggtgcagaccagagccattctcaactacattgccagcaaatacaacctctatgggaaagacataaaggagaaagccctgattgatatgtatatagaaggtatagcagatttgggtgaaatgatccttcttctgccctttagtcaacctgaggaacaagatgccaagcttgccttgatccaagagaaaacaaaaaatcgctacttccctgcctttgaaaaagtcttaaagagccacggacaagactaccttgttggcaacaagctgagccgggctgacattcacctggtggaacttctctactacgtggaagagcttgactctagccttatttccagcttccctctgctgaaggtgacccatttcacagtcttcagagaggcagacccacatctcccatcttgggatcttgtatctgggccctgggactgagcatgttttgaccccagccttctccaggcctttggtgccccaaggtctccaaaatgagcttccaggctccaattttgaggagtattttgccttttattatggaaaggacccagggcccagcatgtctccccatccctctatttcagtgtggtttctgttcctgagttctctgtgatgtcctttatcccatatgtgcccacattgagtcagtctgagcagagccctttccatctggtttcctccctgggctccggctcctgctgtcagacattttgttcctctctgcccagctctccagcactctgcccccgacaatgtatctctcactgagaaaaggtggtcccatggtttgtctttactattttctataacattttcctttccaactcattttcccatattttcacttctgcttagagactgatctgtgctgatatcaaacaagcacattagtttttcttgtcttatacaagagtcactaatctataggattaatatgtaagaagaaagatagggatgactgaactgattaaaatttcaagacatctttggggaaaataaagtgagctacatgttcttcctcttat

SEQ ID NO: 63430 - DNA, 2547 bp, Homo sapiens
tgcaatgggaagtcatctgtaactaaaggtggtccacaaattgcttatgaacgcggctttaggtggaagcttgctcacttccgttatttgtgccagtctaatgcactacctagtcatgtaaagatcaatgtgtcccggcagacattgtttgaagattccttccaacagattatggcattaaaaccctatgacttgaggaggcgcttatatgtaatatttagaggagaagaaggacttgattatggtggcctagcgagagaatggtttttcttgctttcacatgaagttttgaacccaatgtattgcttatttgagtatgcgggcaagaacaactattgtctgcagataaatccagcatcaaccattaatccagaccatctttcatacttctgtttcattggtcgttttattgccatggcactatttcatggaaagtttatcgatactggtttctctttaccattctacaagcgtatgttaagtaaaaaacttactattaaggatttggaatctattgatactgaattttataactcccttatctggataagagataacaacattgaagaatgtggcttagaaatgtacttttctgttgacatggagattttgggaaaagttacttcacatgacctgaagttgggaggttccaatattctggtgactgaggagaacaaagatgaatatattggtttaatgacagaatggcgtttttctcgaggagtacaagaacagaccaaagctttccttgatggttttaatgaagttgttcctcttcagtggctacagtacttcgatgaaaaagaattagaggttatgttgtgtggcatgcaggaggttgacttggcagattggcagagaaatactgtttatcgacattatacaagaaacagcaagcaaatcatttggttttggcagtttgtgaaagagacagacaatgaagtaagaatgcgactattgcagttcgtcactggaacctgccgtttacctctaggaggatttgctgagctcatgggaagtaatgggcctcaaaagttttgcattgaaaaagttggcaaagacacttggttaccaagaagccatacatgttttaatcgcttggatctaccaccatataagagttatgaacaactaaaggaaaaacttctttttgcaatagaagagacagagggatttggacaagaatgaatgtggcttcttattttggaggagctcttgcatttaaataccccagccaagaaaaattgcacagatagtgtatataagctgttcattctgtacagtgaattttccgaacctctcaaagtatgttttccgttcttccacagaaatatgcaaaacagttcatccttttctactttatttattgttcccttgaaatgactgaccaggaaaaagatcatccttaaattttgaagcaagtgagagactttattaaaaatacatatatatctatataaacatatatgatagtggctctagttttatagagctccaagtgtattaaacatgacagccattcattcataaagatctggatttgctttaccttgttaatattatctaggggaaaaagtgcaaattgctccatgttcttctctcccttatgtaacatctcctgagggtgtttagttgcatggctgttcagaaaggtattaagggcttaggccaaatcttactttgagtatgttaaaaaaaaaaaaatgctgctggcttttctgaagacaggtgcttgaacttgtcagtttgttttaaataaatacaatagttgaaaatttttctctgttacatcagtaatattgttaaagtaatggatagaaccataacttacacatgaaagtcatatactagatccaatactatttagtttattatcgaaattggaaggattcattgagcagcatagaagtttgtttacatgttactttgagatgctaggtatttgtggaattaaaaagaatcaggctcttttgtactttgtttttaaatctgtgatgcttttcaaatttaattcataataaattgatgcaatttcatacttaggaacatacaaaaggtaatgtaaactctgccacttttttgtgttcaaaattttggtttttatgaagccagatggattgaagagttacataagcatttgaatgctctaatataaggctaatgattttctgttagtgtttgaatatcttcattcctctcaaattcataacagttctatttaactgaattaaataaccatatgaaaaatcttttgggtctccccctttttacacagataattatttttgtcataacactttttaattgtttttcatcataggggcctttgctgaactacaaaaatgtgtaacaaattaaaatctgatgtgaatgatattaatgctacttttagcaaactgggcttcctaatacaaaattttaaatttccatttgtatcatgcttttaatatgcactgtaaatttcattaacttaaacattttttaatagccatggaactgacttcttaaaatctgttgcctataaatatttcactgctaagtacatac

SEQ ID NO: 63431 - DNA, 2561 bp, Homo sapiens
gacatacccaagcaaaagtgtggcatacaaataagcatgttatatctatatgaggatcagtgaatttgtagtttggccacatcgaaactagcaggtaacttaaatggagagccagatcatagaagaacttggatagagggccaaagaattgggcagtggagttcttaaagactgttgagcagaggtatgatgtatatatgaatatatttaagatctgtttttaaattcacatattaatgctaaaaaataaccttgacttattttcttatagagaatggtttttcttgctttcacatgaagttttgaacccaatgtattgcttatttgagtatgcgggcaagaacaactattgtctgcagataaatccagcatcaaccattaatccagaccatctttcatacttctgtttcattggtcgttttattgccatggcactatttcatggaaagtttatcgatactggtttctctttaccattctacaagcgtatgttaagtaaaaaacttactattaaggatttggaatctattgatactgaattttataactcccttatctggataagagataacaacattgaagaatgtggcttagaaatgtacttttctgttgacatggagattttgggaaaagttacttcacatgacctgaagttgggaggttccaatattctggtgactgaggagaacaaagatgaatatattggtttaatgacagaatggcgtttttctcgaggagtacaagaacagaccaaagctttccttgatggttttaatgaagttgttcctcttcagtggctacagtacttcgatgaaaaagaattagaggttatgttgtgtggcatgcaggaggttgacttggcagattggcagagaaatactgtttatcgacattatacaagaaacagcaagcaaatcatttggttttggcagtttgtgaaagagacagacaatgaagtaagaatgcgactattgcagttcgtcactggaacctgccgtttacctctaggaggatttgctgagctcatgggaagtaatgggcctcaaaagttttgcattgaaaaagttggcaaagacacttggttaccaagaagccatacatgttttaatcgcttggatctaccaccatataagagttatgaacaactaaaggaaaaacttctttttgcaatagaagagacagagggatttggacaagaatgaatgtggcttcttattttggaggagctcttgcatttaaataccccagccaagaaaaattgcacagatagtgtatataagctgttcattctgtacagtgaattttccgaacctctcaaagtatgttttccgttcttccacagaaatatgcaaaacagttcatccttttctactttatttattgttcccttgaaatgactgaccaggaaaaagatcatccttaaattttgaagcaagtgagagactttattaaaaatacatatatatctatataaacatatatgatagtggctctagttttatagagctccaagtgtattaaacatgacagccattcattcataaagatctggatttgctttaccttgttaatattatctaggggaaaaagtgcaaattgctccatgttcttctctcccttatgtaacatctcctgagggtgtttagttgcatggctgttcagaaaggtattaagggcttaggccaaatcttactttgagtatgttaaaaaaaaaaaaatgctgctggcttttctgaagacaggtgcttgaacttgtcagtttgttttaaataaatacaatagttgaaaatttttctctgttacatcagtaatattgttaaagtaatggatagaaccataacttacacatgaaagtcatatactagatccaatactatttagtttattatcgaaattggaaggattcattgagcagcatagaagtttgtttacatgttactttgagatgctaggtatttgtggaattaaaaagaatcaggctcttttgtactttgtttttaaatctgtgatgcttttcaaatttaattcataataaattgatgcaatttcatacttaggaacatacaaaaggtaatgtaaactctgccacttttttgtgttcaaaattttggtttttatgaagccagatggattgaagagttacataagcatttgaatgctctaatataaggctaatgattttctgttagtgtttgaatatcttcattcctctcaaattcataacagttctatttaactgaattaaataaccatatgaaaaatcttttgggtctccccctttttacacagataattatttttgtcataacactttttaattgtttttcatcataggggcctttgctgaactacaaaaatgtgtaacaaattaaaatctgatgtgaatgatattaatgctacttttagcaaactgggcttcctaatacaaaattttaaatttccatttgtatcatgcttttaatatgcactgtaaatttcattaacttaaacattttttaatagccatggaactgacttcttaaaatctgttgcctataaatatttcactgctaagtacatac

SEQ ID NO: 63432 - DNA, 2234 bp, Homo sapiens
atttgtgccaggtactatagtgtctaatgcactacctagtcatgtaaagatcaatgtgtcccggcagacattgtttgaagattccttccaacagattatggcattaaaaccctatgacttgaggaggcgcttatatgtaatatttagaggagaagaaggacttgattatggtggcctagcgagagaatggtttttcttgctttcacatgaagttttgaacccaatgtattgcttatttgagtatgcgggcaagaacaactattgtctgcagataaatccagcatcaaccattaatccagaccatctttcatacttctgtttcattggtcgttttattgccatggcactatttcatggaaagtttatcgatactggtttctctttaccattctacaagcgtatgttaagtaaaaaacttactattaaggatttggaatctattgatactgaattttataactcccttatctggataagagataacaacattgaagaatgtggcttagaaatgtacttttctgttgacatggagattttgggaaaagttacttcacatgacctgaagttgggaggttccaatattctggtgactgaggagaacaaagatgaatatattggtttaatgacagaatggcgtttttctcgaggagtacaagaacagaccaaagctttccttgatggttttaatgaagttgttcctcttcagtggctacagtacttcgatgaaaaagaattagaggttatgttgtgtggcatgcaggaggttgacttggcagattggcagagaaatactgtttatcgacattatacaagaaacagcaagcaaatcatttggttttggcagtttgtgaaagagacagacaatgaagtaagaatgcgactattgcagttcgtcactggaacctgccgtttacctctaggaggatttgctgagctcatgggaagtaatgggcctcaaaagttttgcattgaaaaagttggcaaagacacttggttaccaagaagccatacatagaaatatgcaaaacagttcatccttttctactttatttattgttcccttgaaatgactgaccaggaaaaagatcatccttaaattttgaagcaagtgagagactttattaaaaatacatatatatctatataaacatatatgatagtggctctagttttatagagctccaagtgtattaaacatgacagccattcattcataaagatctggatttgctttaccttgttaatattatctaggggaaaaagtgcaaattgctccatgttcttctctcccttatgtaacatctcctgagggtgtttagttgcatggctgttcagaaaggtattaagggcttaggccaaatcttactttgagtatgttaaaaaaaaaaaaatgctgctggcttttctgaagacaggtgcttgaacttgtcagtttgttttaaataaatacaatagttgaaaatttttctctgttacatcagtaatattgttaaagtaatggatagaaccataacttacacatgaaagtcatatactagatccaatactatttagtttattatcgaaattggaaggattcattgagcagcatagaagtttgtttacatgttactttgagatgctaggtatttgtggaattaaaaagaatcaggctcttttgtactttgtttttaaatctgtgatgcttttcaaatttaattcataataaattgatgcaatttcatacttaggaacatacaaaaggtaatgtaaactctgccacttttttgtgttcaaaattttggtttttatgaagccagatggattgaagagttacataagcatttgaatgctctaatataaggctaatgattttctgttagtgtttgaatatcttcattcctctcaaattcataacagttctatttaactgaattaaataaccatatgaaaaatcttttgggtctccccctttttacacagataattatttttgtcataacactttttaattgtttttcatcataggggcctttgctgaactacaaaaatgtgtaacaaattaaaatctgatgtgaatgatattaatgctacttttagcaaactgggcttcctaatacaaaattttaaatttccatttgtatcatgcttttaatatgcactgtaaatttcattaacttaaacattttttaatagccatggaactgacttcttaaaatctgttgcctataaatatttcactgctaagtacatac

SEQ ID NO: 63433 - DNA, 2473 bp, Homo sapiens
atttgtgccaggtactatagtgtctaatgcactacctagtcatgtaaagatcaatgtgtcccggcagacattgtttgaagattccttccaacagattatggcattaaaaccctatgacttgaggaggcgcttatatgtaatatttagaggagaagaaggacttgattatggtggcctagcgagagaatggtttttcttgctttcacatgaagttttgaacccaatgtattgcttatttgagtatgcgggcaagaacaactattgtctgcagataaatccagcatcaaccattaatccagaccatctttcatacttctgtttcattggtcgttttattgccatggcactatttcatggaaagtttatcgatactggtttctctttaccattctacaagcgtatgttaagtaaaaaacttactattaaggatttggaatctattgatactgaattttataactcccttatctggataagagataacaacattgaagaatgtggcttagaaatgtacttttctgttgacatggagattttgggaaaagttacttcacatgacctgaagttgggaggttccaatattctggtgactgaggagaacaaagatgaatatattggtttaatgacagaatggcgtttttctcgaggagtacaagaacagaccaaagctttccttgatggttttaatgaagttgttcctcttcagtggctacagtacttcgatgaaaaagaattagaggttatgttgtgtggcatgcaggaggttgacttggcagattggcagagaaatactgtttatcgacattatacaagaaacagcaagcaaatcatttggttttggcagtttgtgaaagagacagacaatgaagtaagaatgcgactattgcagttcgtcactggaacctgccgtttacctctaggaggatttgctgagctcatgggaagtaatgggcctcaaaagttttgcattgaaaaagttggcaaagacacttggttaccaagaagccatacatgttttaatcgcttggatctaccaccatataagagttatgaacaactaaaggaaaaacttctttttgcaatagaagagacagagggatttggacaagaatgaatgtggcttcttattttggaggagctcttgcatttaaataccccagccaagaaaaattgcacagatagtgtatataagctgttcattctgtacagtgaattttccgaacctctcaaagtatgttttccgttcttccacagaaatatgcaaaacagttcatccttttctactttatttattgttcccttgaaatgactgaccaggaaaaagatcatccttaaattttgaagcaagtgagagactttattaaaaatacatatatatctatataaacatatatgatagtggctctagttttatagagctccaagtgtattaaacatgacagccattcattcataaagatctggatttgctttaccttgttaatattatctaggggaaaaagtgcaaattgctccatgttcttctctcccttatgtaacatctcctgagggtgtttagttgcatggctgttcagaaaggtattaagggcttaggccaaatcttactttgagtatgttaaaaaaaaaaaaatgctgctggcttttctgaagacaggtgcttgaacttgtcagtttgttttaaataaatacaatagttgaaaatttttctctgttacatcagtaatattgttaaagtaatggatagaaccataacttacacatgaaagtcatatactagatccaatactatttagtttattatcgaaattggaaggattcattgagcagcatagaagtttgtttacatgttactttgagatgctaggtatttgtggaattaaaaagaatcaggctcttttgtactttgtttttaaatctgtgatgcttttcaaatttaattcataataaattgatgcaatttcatacttaggaacatacaaaaggtaatgtaaactctgccacttttttgtgttcaaaattttggtttttatgaagccagatggattgaagagttacataagcatttgaatgctctaatataaggctaatgattttctgttagtgtttgaatatcttcattcctctcaaattcataacagttctatttaactgaattaaataaccatatgaaaaatcttttgggtctccccctttttacacagataattatttttgtcataacactttttaattgtttttcatcataggggcctttgctgaactacaaaaatgtgtaacaaattaaaatctgatgtgaatgatattaatgctacttttagcaaactgggcttcctaatacaaaattttaaatttccatttgtatcatgcttttaatatgcactgtaaatttcattaacttaaacattttttaatagccatggaactgacttcttaaaatctgttgcctataaatatttcactgctaagtacatac

SEQ ID NO: 63434 - DNA, 1739 bp, Homo sapiens
atttgtgccaggtactatagtgtctaatgcactacctagtcatgtaaagatcaatgtgtcccggcagacattgtttgaagattccttccaacagattatggcattaaaaccctatgacttgaggaggcgcttatatgtaatatttagaggagaagaaggacttgattatggtggcctagcgagagaatggtttttcttgctttcacatgaagttttgaacccaatgtattgcttatttgagtatgcgggcaagaacaactattgtctgcagataaatccagcatcaaccattaatccagaccatctttcatacttctgtttcattggtcgttttattgccatggcactatttcatggaaagtttatcgatactggtttctctttaccattctacaagcgtatgttaagtaaaaaacttactattaaggatttggaatctattgatactgaattttataactcccttatctggataagagataacaacattgaagaatgtggcttagaaatgtacttttctgttgacatggagattttgggaaaagttacttcacatgacctgaagttgggaggttccaatattctggtgactgaggagaacaaagatgaatatattggtttaatgacagaatggcgtttttctcgaggagtacaagaacagaccaaagctttccttgatggttttaatgaagttgttcctcttcagtggctacagtacttcgatgaaaaagaattagaggttatgttgtgtggcatgcaggaggttgacttggcagattggcagagaaatactgtttatcgacattatacaagaaacagcaagcaaatcatttggttttggcagtttgtgaaagagacagacaatgaagtaagaatgcgactattgcagttcgtcactggaacctgccgtttacctctaggaggatttgctgagctcatgggaagtaatgggcctcaaaagttttgcattgaaaaagttggcaaagacacttggttaccaagaagccatacatgttttaatcgcttggatctaccaccatataagagttatgaacaactaaaggaaaaacttctttttgcaatagaagagacagagggatttggacaagaatgaatgtggcttcttattttggaggagctcttgcatttaaataccccagccaagaaaaattgcacagatagtgtatataagctgttcattctgtacagtgaattttccgaacctctcaaagtatgttttccgttcttccacagaaatatgcaaaacagttcatccttttctactttatttattgttcccttgaaatgactgaccaggaaaaagatcatccttaaattttgaagcaagtgagagactttattaaaaatacatatatatctatataaacatatatgatagtggctctagttttatagagctccaagtgtattaaacatgacagccattcattcataaagatctggatttgctttaccttgttaatattatctaggggaaaaagtgcaaattgctccatgttcttctctcccttatgtaacatctcctgagggtgtttagttgcatggctgttcagaaaggtattaagggcttaggccaaatcttactttgagtatgttaaaaaaaaaaaaaaaaattggggcgcgggctggaaaagttaaccatgttgggggccaggaatgaaggtaatggccagaactgaggtgggtccaaaagcgggcgggggaaacgggggtgggca

SEQ ID NO: 63435 - DNA, 705 bp, Homo sapiens
atttgtgccaggtactatagtgtctaatgcactacctagtcatgtaaagatcaatgtgtcccggcagacattgtttgaagattccttccaacagattatggcattaaaaccctatgacttgaggaggcgcttatatgtaatatttagaggagaagaaggacttgattatggtggcctagcgagagaatggtttttcttgctttcacatgaagttttgaacccaatgtattgcttatttgagtatgcgggcaagaacaactattgtctgcagataaatccagcatcaaccattaatccagaccatctttcatacttctgtttcattggtcgttttattgccatggcactatttcatggaaagtttatcgatactggtttctctttaccattctacaagcgtatgttaagtaaaaaacttactattaaggatttggaatctattgatactgaattttataactcccttatctggataagagataacaacattgaagaatgtggcttagaaatgtacttttctgttgacatggagattttgggaaaagttacttcacatgacctgaagttgggaggttccaatattctggtgactgaggagaacaaagatgaatatattggtttaatgacagaatggcgtttttctcgaggagtacaagaacagaccaaagctttccttgatgctggacgacgggatcctctgaacag

SEQ ID NO: 63436 - DNA, 424 bp, Homo sapiens
gcattggcagaagtgccacagtgtgatttctgaggctgggtcaccacaggtgatgcttggagccctgagccactgtgtcaggttcatacctgaggaggccatactgggaggaagcccaagccacacagagatcagaagtccaaccacctgaagacgccatactgggaggaagcccaagctgcacagagaggccaagtgtaggtgttccggccagtcctagctagatctggacttcaaattgtcccgacccagacatcatacatgtgaagaggcctccaggatggtcccagttcccatccatttgagtcttcccagctgaaattccagatgtcatggaagagacaagccatcctgctgtgtcctgtccaagctccttgtaacagaaccagcgagctcaataaaatggtggttgccacgtgaaact

SEQ ID NO: 63437 - DNA, 198 bp, Homo sapiens
ctatcacttcagggaaacaaacaactaacagccatcaattcagagggaagtgattttacagtagagtgaacgaaacttgggaaggaaaacatccaagaggcgtctgtttgacgtgggtaacgtggggaacgcatactgtctggcaagaattctactaggaccacgggaaacaaagcagattaaaacactctctactct

SEQ ID NO: 63438 - DNA, 361 bp, Homo sapiens
ctactttctgtgtctaatgtagccttatgagtctggcctcttttactcaggatgatgcatttgagattcatccatgttgttgtgtatgacattattttgtttccttttattgctgagtagtataccattgcatggctatatcacatttttggtatcatatgtgtcagttgaaggacatttgttctattttcttttcagtttatagtgattatgaataaagctaccataaacattttgtttgaaagattcgggtgaacttaagttttcatttctcctgggtaaatgactaggattaagactgctgggttatatggtctatgtatgctgaactttataacccaaactgtgttccaaagtggct

SEQ ID NO: 63439 - DNA, 362 bp, Homo sapiens
tcaagtaagatgatgtcttatgtagctcaaggacaggatttgttttgcttgttctgtttgtttgcatttacagaaatcacacacacacacacacacacacacacacactcataaatgttgctattggcttctaaataattgcaactttaaatatctaactttctgcaagaagctgatgacagtcactcataatacataaagtgctttaaaatttttgagatatatttagacacattaaattaggctgaaatgaacattatggacagttctttatcagctaaaaggccagaaatgagaagcttaaggaggatatgtagaaaggaggccatcttttgtggaaataatttttgtttgacaatcca

SEQ ID NO: 63440 - DNA, 1794 bp, Homo sapiens
tcgagcccgctttccagggaccctacctgagggcccacaggtgaggcagcctggcctagcaggccccacgccaccgcctctgcctccaggccgcccgctgctgcggggccaccatgctcctgcccaggcctggagactgacccgaccccggcactacctcgaggctccgcccccacctgctggaccccagggtcccaccctggcccaggaggtcagccagggaatcattaacaagaggcagtgacatggcgcagaaggagggtggccggactgtgccatgctgctccagacccaaggtggcagctctcactgcggggaccctgctacttctgacagccatcggggcggcatcctgggccattgtggctgttctcctcaggagtgaccaggagccgctgtacccagtgcaggtcagctctgcggacgctcggctcatggtctttgacaagacggaagggacgtggcggctgctgtgctcctcgcgctccaacgccagggtagccggactcagctgcgaggagatgggcttcctcagggcactgacccactccgagctggacgtgcgaacggcgggcgccaatggcacgtcgggcttcttctgtgtggacgaggggaggctgccccacacccagaggctgctggaggtcatctccgtgtgtgattgccccagaggccgtttcttggccgccatctgccaagactgtggccgcaggaagctgcccgtggaccgcatcgtgggaggccgggacaccagcttgggccggtggccgtggcaagtcagccttcgctatgatggagcacacctctgtgggggatccctgctctccggggactgggtgctgacagccgcccactgcttcccggagcggaaccgggtcctgtcccgatggcgagtgtttgccggtgccgtggcccaggcctctccccacggtctgcagctgggggtgcaggctgtggtctaccacgggggctatcttccctttcgggaccccaacagcgaggagaacagcaacgatattgccctggtccacctctccagtcccctgcccctcacagaatacatccagcctgtgtgcctcccagctgccggccaggccctggtggatggcaagatctgtaccgtgacgggctggggcaacacgcagtactatggccaacaggccggggtactccaggaggctcgagtccccataatcagcaatgatgtctgcaatggcgctgacttctatggaaaccagatcaagcccaagatgttctgtgctggctaccccgagggtggcattgatgcctgccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaagactcactccgaagccagcggcatggtgacccagctctgaccggtggcttctcgctgcgcagcctccagggcccgaggtgatcccggtggtgggatccacgctgggccgaggatgggacgtttttcttcttgggcccggtccacaggtccaaggacaccctccctccagggtcctctcttccacagtggcgggcccactcagccccgagaccacccaacctcaccctcctgacccccatgtaaatattgttctgctgtctgggactcctgtctaggtgcccctgatgatgggatgctctttaaataataaagatggttttgattaaaaaaaaaac

SEQ ID NO: 63441 - DNA, 421 bp, Homo sapiens
gagaaaggattccaatggtggttcatagaagcctttgaaaccacaagaagccacatatgtcattccacagaatcattgaaaaaacatactcactccgaagccagcggcatggtgacccagctctgaccggtggcttctcgctgcgcagcctccagggcccgaggtgatcccggtggtgggatccacgctgggccgaggatgggacgtttttcttcttgggcccggtccacaggtccaaggacaccctccctccagggtcctctcttccacagtggcgggcccactcagccccgagaccacccaacctcaccctcctgacccccatgtaaatattgttctgctgtctgggactcctgtctaggtgcccctgatgatgggatgctctttaaataataaagatggttttgattaaaaaaaaaac

SEQ ID NO: 63442 - DNA, 1781 bp, Homo sapiens
atggtactgcgtcggaagtcgtgtgatgtgaggcagcctggcctagcaggccccacgccaccgcctctgcctccaggccgcccgctgctgcggggccaccatgctcctgcccaggcctggagactgacccgaccccggcactacctcgaggctccgcccccacctgctggaccccagggtcccaccctggcccaggaggtcagccagggaatcattaacaagaggcagtgacatggcgcagaaggagggtggccggactgtgccatgctgctccagacccaaggtggcagctctcactgcggggaccctgctacttctgacagccatcggggcggcatcctgggccattgtggctgttctcctcaggagtgaccaggagccgctgtacccagtgcaggtcagctctgcggacgctcggctcatggtctttgacaagacggaagggacgtggcggctgctgtgctcctcgcgctccaacgccagggtagccggactcagctgcgaggagatgggcttcctcagggcactgacccactccgagctggacgtgcgaacggcgggcgccaatggcacgtcgggcttcttctgtgtggacgaggggaggctgccccacacccagaggctgctggaggtcatctccgtgtgtgattgccccagaggccgtttcttggccgccatctgccaagactgtggccgcaggaagctgcccgtggaccgcatcgtgggaggccgggacaccagcttgggccggtggccgtggcaagtcagccttcgctatgatggagcacacctctgtgggggatccctgctctccggggactgggtgctgacagccgcccactgcttcccggagcggaaccgggtcctgtcccgatggcgagtgtttgccggtgccgtggcccaggcctctccccacggtctgcagctgggggtgcaggctgtggtctaccacgggggctatcttccctttcgggaccccaacagcgaggagaacagcaacgatattgccctggtccacctctccagtcccctgcccctcacagaatacatccagcctgtgtgcctcccagctgccggccaggccctggtggatggcaagatctgtaccgtgacgggctggggcaacacgcagtactatggccaacaggccggggtactccaggaggctcgagtccccataatcagcaatgatgtctgcaatggcgctgacttctatggaaaccagatcaagcccaagatgttctgtgctggctaccccgagggtggcattgatgcctgccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaagactcactccgaagccagcggcatggtgacccagctctgaccggtggcttctcgctgcgcagcctccagggcccgaggtgatcccggtggtgggatccacgctgggccgaggatgggacgtttttcttcttgggcccggtccacaggtccaaggacaccctccctccagggtcctctcttccacagtggcgggcccactcagccccgagaccacccaacctcaccctcctgacccccatgtaaatattgttctgctgtctgggactcctgtctaggtgcccctgatgatgggatgctctttaaataataaagatggttttgattaaaaaaaaaac

SEQ ID NO: 63443 - DNA, 1780 bp, Homo sapiens
gctgtacggtccggagttctttggatgtgaggcagcctggcctagcaggccccacgccaccgcctctgcctccaggccgcccgctgctgcggggccaccatgctcctgcccaggcctggagactgacccgaccccggcactacctcgaggctccgcccccacctgctggaccccagggtcccaccctggcccaggaggtcagccagggaatcattaacaagaggcagtgacatggcgcagaaggagggtggccggactgtgccatgctgctccagacccaaggtggcagctctcactgcggggaccctgctacttctgacagccatcggggcggcatcctgggccattgtggctgttctcctcaggagtgaccaggagccgctgtacccagtgcaggtcagctctgcggacgctcggctcatggtctttgacaagacggaagggacgtggcggctgctgtgctcctcgcgctccaacgccagggtagccggactcagctgcgaggagatgggcttcctcagggcactgacccactccgagctggacgtgcgaacggcgggcgccaatggcacgtcgggcttcttctgtgtggacgaggggaggctgccccacacccagaggctgctggaggtcatctccgtgtgtgattgccccagaggccgtttcttggccgccatctgccaagactgtggccgcaggaagctgcccgtggaccgcatcgtgggaggccgggacaccagcttgggccggtggccgtggcaagtcagccttcgctatgatggagcacacctctgtgggggatccctgctctccggggactgggtgctgacagccgcccactgcttcccggagcggaaccgggtcctgtcccgatggcgagtgtttgccggtgccgtggcccaggcctctccccacggtctgcagctgggggtgcaggctgtggtctaccacgggggctatcttccctttcgggaccccaacagcgaggagaacagcaacgatattgccctggtccacctctccagtcccctgcccctcacagaatacatccagcctgtgtgcctcccagctgccggccaggccctggtggatggcaagatctgtaccgtgacgggctggggcaacacgcagtactatggccaacaggccggggtactccaggaggctcgagtccccataatcagcaatgatgtctgcaatggcgctgacttctatggaaaccagatcaagcccaagatgttctgtgctggctaccccgagggtggcattgatgcctgccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaagactcactccgaagccagcggcatggtgacccagctctgaccggtggcttctcgctgcgcagcctccagggcccgaggtgatcccggtggtgggatccacgctgggccgaggatgggacgtttttcttcttgggcccggtccacaggtccaaggacaccctccctccagggtcctctcttccacagtggcgggcccactcagccccgagaccacccaacctcaccctcctgacccccatgtaaatattgttctgctgtctgggactcctgtctaggtgcccctgatgatgggatgctctttaaataataaagatggttttgattaaaaaaaaaac

SEQ ID NO: 63444 - DNA, 1707 bp, Homo sapiens
gctgtacggtccggagttctttggatgtgaggcagcctggcctagcaggccccacgccaccgcctctgcctccaggccgcccgctgctgcggggccaccatgctcctgcccaggcctggagactgacccgaccccggcactacctcgaggctccgcccccacctgctggaccccagggtcccaccctggcccaggaggtcagccagggaatcattaacaagaggcagtgacatggcgcagaaggaggtgcaggtcagctctgcggacgctcggctcatggtctttgacaagacggaagggacgtggcggctgctgtgctcctcgcgctccaacgccagggtagccggactcagctgcgaggagatgggcttcctcaggtactgggggccctcggaggggtgggagccgggaggggctggggagcaggcctaacccctgccccgcccagggcactgacccactccgagctggacgtgcgaacggcgggcgccaatggcacgtcgggcttcttctgtgtggacgaggggaggctgccccacacccagaggctgctggaggtcatctccgtgtgtgattgccccagaggccgtttcttggccgccatctgccaagactgtggccgcaggaagctgcccgtggaccgcatcgtgggaggccgggacaccagcttgggccggtggccgtggcaagtcagccttcgctatgatggagcacacctctgtgggggatccctgctctccggggactgggtgctgacagccgcccactgcttcccggagcggaaccgggtcctgtcccgatggcgagtgtttgccggtgccgtggcccaggcctctccccacggtctgcagctgggggtgcaggctgtggtctaccacgggggctatcttccctttcgggaccccaacagcgaggagaacagcaacgatattgccctggtccacctctccagtcccctgcccctcacagaatacatccagcctgtgtgcctcccagctgccggccaggccctggtggatggcaagatctgtaccgtgacgggctggggcaacacgcagtactatggccaacaggccggggtactccaggaggctcgagtccccataatcagcaatgatgtctgcaatggcgctgacttctatggaaaccagatcaagcccaagatgttctgtgctggctaccccgagggtggcattgatgcctgccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaagactcactccgaagccagcggcatggtgacccagctctgaccggtggcttctcgctgcgcagcctccagggcccgaggtgatcccggtggtgggatccacgctgggccgaggatgggacgtttttcttcttgggcccggtccacaggtccaaggacaccctccctccagggtcctctcttccacagtggcgggcccactcagccccgagaccacccaacctcaccctcctgacccccatgtaaatattgttctgctgtctgggactcctgtctaggtgcccctgatgatgggatgctctttaaataataaagatggttttgattaaaaaaaaaac

SEQ ID NO: 63445 - DNA, 1817 bp, Homo sapiens
atggtactgcgtcggaagtcgtgtgatgtgaggcagcctggcctagcaggccccacgccaccgcctctgcctccaggccgcccgctgctgcggggccaccatgctcctgcccaggcctggagactgacccgaccccggcactacctcgaggctccgcccccacctgctggaccccagggtcccaccctggcccaggaggtcagccagggaatcattaacaagaggcagtgacatggcgcagaaggagggtggccggactgtgccatgctgctccagacccaaggtggcagctctcactgcggggaccctgctacttctgacagccatcggggcggcatcctgggccattgtggctgttctcctcaggagtgaccaggagccgctgtacccagtgcaggtcagctctgcggacgctcggctcatggtctttgacaagacggaagggacgtggcggctgctgtgctcctcgcgctccaacgccagggtagccggactcagctgcgaggagatgggcttcctcagggcactgacccactccgagctggacgtgcgaacggcgggcgccaatggcacgtcgggcttcttctgtgtggacgaggggaggctgccccacacccagaggctgctggaggtcatctccgtgtgtgattgccccagaggccgtttcttggccgccatctgccaagactgtggccgcaggaagctgcccgtggaccgcatcgtgggaggccgggacaccagcttgggccggtggccgtggcaagtcagccttcgctatgatggagcacacctctgtgggggatccctgctctccggggactgggtgctgacagccgcccactgcttcccggagcggaaccgggtcctgtcccgatggcgagtgtttgccggtgccgtggcccaggcctctccccacggtctgcagctgggggtgcaggctgtggtctaccacgggggctatcttccctttcgggaccccaacagcgaggagaacagcaacgatattgccctggtccacctctccagtcccctgcccctcacagaatacatccagcctgtgtgcctcccagctgccggccaggccctggtggatggcaagatctgtaccgtgacgggctggggcaacacgcagtactatggccaacaggccggggtactccaggaggctcgagtccccataatcagcaatgatgtctgcaatggcgctgacttctatggaaaccagatcaagcccaagatgttctgtgctggctaccccgagggtggcattgatgcctgccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaagacctcgggagcccccagctgtctttccccagactcaactcactccgaagccagcggcatggtgacccagctctgaccggtggcttctcgctgcgcagcctccagggcccgaggtgatcccggtggtgggatccacgctgggccgaggatgggacgtttttcttcttgggcccggtccacaggtccaaggacaccctccctccagggtcctctcttccacagtggcgggcccactcagccccgagaccacccaacctcaccctcctgacccccatgtaaatattgttctgctgtctgggactcctgtctaggtgcccctgatgatgggatgctctttaaataataaagatggttttgattaaaaaaaaaac

SEQ ID NO: 63446 - DNA, 2566 bp, Homo sapiens
gctgtacggtccggagttctttggatgtgaggcagcctggcctagcaggccccacgccaccgcctctgcctccaggccgcccgctgctgcggggccaccatgctcctgcccaggcctggagactgacccgaccccggcactacctcgaggctccgcccccacctgctggaccccagggtaaggacaagggcccccagactcacagttccagccctgaggacaggggttccctcatccccccacccagcctaatgcccacctcctaatagaggggttcctggggacctgaagagggggcactatgacgtccccccaagcacctaggtgttctgtcctgctcttccttcagactcagccgttggaccccagtcctttcctccccagacccaggagttccagccctcaggcccctcctccctcatactagggagtcctggcccccaaattcctcctttcccaagacttatgatttcaggtcctcagctgtctcctccctcaaaccgggatcctcagtcccctgctccaccaggctcaggcatgggggtccccatccctgcaaatccaggcgtccccccgctgctggtcagacactgaccccatccttgaacccagcccaatctgcgtccgtgatcacggcgtgctctggccaaggcccagtccctacagcctgcctggatggacgcctgggactgggggcgccaggactgggctgggctgggctcccccaggccctgcctccccgtccatctcctcacaggtcgtcccaccctggcccaggaggtcagccagggaatcattaacaagaggcagtgacatggcgcagaaggagggtggccggactgtgccatgctgctccagacccaaggtggcagctctcactgcggggaccctgctacttctgacagccatcggggcggcatcctgggccattgtggctgttctcctcaggagtgaccaggagccgctgtacccagtgcaggtcagctctgcggacgctcggctcatggtctttgacaagacggaagggacgtggcggctgctgtgctcctcgcgctccaacgccagggtagccggactcagctgcgaggagatgggcttcctcaggtactgggggccctcggaggggtgggagccgggaggggctggggagcaggcctaacccctgccccgcccagggcactgacccactccgagctggacgtgcgaacggcgggcgccaatggcacgtcgggcttcttctgtgtggacgaggggaggctgccccacacccagaggctgctggaggtcatctccgtgtggtgaggagggcagcgggcaggtggggcaacacctcagacccccaaggcactccctctccccgttttccttccacctgtcttaactggtctctatttcctttctttctgtgtctccaatcccatctctcccagtgattgccccagaggccgtttcttggccgccatctgccaagactgtggccgcaggaagctgcccgtggaccgcatcgtgggaggccgggacaccagcttgggccggtggccgtggcaagtcagccttcgctatgatggagcacacctctgtgggggatccctgctctccggggactgggtgctgacagccgcccactgcttcccggagcggaaccgggtcctgtcccgatggcgagtgtttgccggtgccgtggcccaggcctctccccacggtctgcagctgggggtgcaggctgtggtctaccacgggggctatcttccctttcgggaccccaacagcgaggagaacagcaacgatattgccctggtccacctctccagtcccctgcccctcacagaatacatccagcctgtgtgcctcccagctgccggccaggccctggtggatggcaagatctgtaccgtgacgggctggggcaacacgcagtactatggccaacaggccggggtactccaggaggctcgagtccccataatcagcaatgatgtctgcaatggcgctgacttctatggaaaccagatcaagcccaagatgttctgtgctggctaccccgagggtggcattgatgcctgccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaagactcactccgaagccagcggcatggtgacccagctctgaccggtggcttctcgctgcgcagcctccagggcccgaggtgatcccggtggtgggatccacgctgggccgaggatgggacgtttttcttcttgggcccggtccacaggtccaaggacaccctccctccagggtcctctcttccacagtggcgggcccactcagccccgagaccacccaacctcaccctcctgacccccatgtaaatattgttctgctgtctgggactcctgtctaggtgcccctgatgatgggatgctctttaaataataaagatggttttgattaaaaaaaaaac

SEQ ID NO: 63447 - DNA, 686 bp, Homo sapiens
cagcttgggccggtggccgtggcaagtcagccttcgctatgatggagcacacctctgtgggggatccctgctctccggggactgggtgctgacagccgcccactgcttcccggagtgagtgccccccaatggcgctgatgatggggaggcagaggagcggagagacagtggggaggagggcggattgtgcccaggcaggtggccaccctccacccctttccctggtaggcggaaccgggtcctgtcccgatggcgagtgtttgccggtgccgtggcccaggcctctccccacggtctgcagctgggggtgcaggctgtggtctaccacgggggctatcttccctttcgggaccccaacagcgaggagaacagcaacgatattgccctggtccacctctccagtcccctgcccctcacaggtaagtctaagggctgagccatggggcttgaggacccgaggccaggaggacagaggaggggaccaggggcacaaggcaatcaacttatggctcaggcatccttggcaataaggggaatgatctcgagggagcacaaagtgggccttaactatcaatgatcagtgcagccaatttggaaaatttgccagcatttccccaagaagtatacataaagttaccattggacccaacacttccactcccaggacaggaggtatatacctaaga

SEQ ID NO: 63448 - DNA, 2377 bp, Homo sapiens
tcgagcccgctttccagggaccctacctgagggcccacaggtgaggcagcctggcctagcaggccccacgccaccgcctctgcctccaggccgcccgctgctgcggggccaccatgctcctgcccaggcctggagactgacccgaccccggcactacctcgaggctccgcccccacctgctggaccccagggtaaggacaagggcccccagactcacagttccagccctgaggacaggggttccctcatccccccacccagcctaatgcccacctcctaatagaggggttcctggggacctgaagagggggcactatgacgtccccccaagcacctaggtgttctgtcctgctcttccttcagactcagccgttggaccccagtcctttcctccccagacccaggagttccagccctcaggcccctcctccctcatactagggagtcctggcccccaaattcctcctttcccaagacttatgatttcaggtcctcagctgtctcctccctcaaaccgggatcctcagtcccctgctccaccaggctcaggcatgggggtccccatccctgcaaatccaggcgtccccccgctgctggtcagacactgaccccatccttgaacccagcccaatctgcgtccgtgatcacggcgtgctctggccaaggcccagtccctacagcctgcctggatggacgcctgggactgggggcgccaggactgggctgggctgggctcccccaggccctgcctccccgtccatctcctcacaggtcgtcccaccctggcccaggaggtcagccagggaatcattaacaagaggcagtgacatggcgcagaaggagggtggccggactgtgccatgctgctccagacccaaggtggcagctctcactgcggggaccctgctacttctgacagccatcggggcggcatcctgggccattgtggctgttctcctcaggagtgaccaggagccgctgtacccagtgcaggtcagctctgcggacgctcggctcatggtctttgacaagacggaagggacgtggcggctgctgtgctcctcgcgctccaacgccagggtagccggactcagctgcgaggagatgggcttcctcagggcactgacccactccgagctggacgtgcgaacggcgggcgccaatggcacgtcgggcttcttctgtgtggacgaggggaggctgccccacacccagaggctgctggaggtcatctccgtgtgtgattgccccagaggccgtttcttggccgccatctgccaagactgtggccgcaggaagctgcccgtggaccgcatcgtgggaggccgggacaccagcttgggccggtggccgtggcaagtcagccttcgctatgatggagcacacctctgtgggggatccctgctctccggggactgggtgctgacagccgcccactgcttcccggagcggaaccgggtcctgtcccgatggcgagtgtttgccggtgccgtggcccaggcctctccccacggtctgcagctgggggtgcaggctgtggtctaccacgggggctatcttccctttcgggaccccaacagcgaggagaacagcaacgatattgccctggtccacctctccagtcccctgcccctcacagaatacatccagcctgtgtgcctcccagctgccggccaggccctggtggatggcaagatctgtaccgtgacgggctggggcaacacgcagtactatggccaacaggccggggtactccaggaggctcgagtccccataatcagcaatgatgtctgcaatggcgctgacttctatggaaaccagatcaagcccaagatgttctgtgctggctaccccgagggtggcattgatgcctgccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaagactcactccgaagccagcggcatggtgacccagctctgaccggtggcttctcgctgcgcagcctccagggcccgaggtgatcccggtggtgggatccacgctgggccgaggatgggacgtttttcttcttgggcccggtccacaggtccaaggacaccctccctccagggtcctctcttccacagtggcgggcccactcagccccgagaccacccaacctcaccctcctgacccccatgtaaatattgttctgctgtctgggactcctgtctaggtgcccctgatgatgggatgctctttaaataataaagatggttttgattaaaaaaaaaac

SEQ ID NO: 63449 - DNA, 1853 bp, Homo sapiens
  misc_feature (405)..(405): n is a, c, g, or t
gcacgacagctcagctgttgaggggccaacatgctcgtgtacagggctggcatagtgaaccgaggccgcgcattatgtctaggcttctacccctagcgtgactggaccgctcagtggttcaccaaccgctcggtgcacatgggagagatacacgtcgcataggcaattgcagtatatctaatgatgagacaggaagaccattggctgtcatgatagggtaggtgatcggtacagtgagcgtagctgacaccatagccttgacctacgcagaattccaaaaggcttgcgtaagggtcatacagtattacagagaggtacccatggctgatatacttggatgtcacaatctaggcgtggatattgtgggcctcgcttgttaggacgtgtttcgtcttacacgtgagntgatgccatgtgagtgacaacatgtatattactagcatgacggagtcatacttcatgtatgcaggtcagctctgcggacgctcggctcatggtctttgacaagacggaagggacgtggcggctgctgtgctcctcgcgctccaacgccagggtagccggactcagctgcgaggagatgggcttcctcagggcactgacccactccgagctggacgtgcgaacggcgggcgccaatggcacgtcgggcttcttctgtgtggacgaggggaggctgccccacacccagaggctgctggaggtcatctccgtgtgtgattgccccagaggccgtttcttggccgccatctgccaagactgtggccgcaggaagctgcccgtggaccgcatcgtgggaggccgggacaccagcttgggccggtggccgtggcaagtcagccttcgctatgatggagcacacctctgtgggggatccctgctctccggggactgggtgctgacagccgcccactgcttcccggagcggaaccgggtcctgtcccgatggcgagtgtttgccggtgccgtggcccaggcctctccccacggtctgcagctgggggtgcaggctgtggtctaccacgggggctatcttccctttcgggaccccaacagcgaggagaacagcaacgatattgccctggtccacctctccagtcccctgcccctcacagaatacatccagcctgtgtgcctcccagctgccggccaggccctggtggatggcaagatctgtaccgtgacgggctggggcaacacgcagtactatggccaacaggccggggtactccaggaggctcgagtccccataatcagcaatgatgtctgcaatggcgctgacttctatggaaaccagatcaagcccaagatgttctgtgctggctaccccgagggtggcattgatgcctgccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaagactcactccgaagccagcggcatggtgacccagctctgaccggtggcttctcgctgcgcagcctccagggcccgaggtgatcccggtggtgggatccacgctgggccgaggatgggacgtttttcttcttgggcccggtccacaggtccaaggacaccctccctccagggtcctctcttccacagtggcgggcccactcagccccgagaccacccaacctcaccctcctgacccccatgtaaatattgttctgctgtctgggactcctgtctaggtgcccctgatgatgggatgctctttaaataataaagatggttttgattaaaaaaaaaac

SEQ ID NO: 63450 - DNA, 2002 bp, Homo sapiens
atggtactgcgtcggaagtcgtgtgatgtgaggcagcctggcctagcaggccccacgccaccgcctctgcctccaggccgcccgctgctgcggggccaccatgctcctgcccaggcctggagactgacccgaccccggcactacctcgaggctccgcccccacctgctggaccccagggtcccaccctggcccaggaggtcagccagggaatcattaacaagaggcagtgacatggcgcagaaggagggtggccggactgtgccatgctgctccagacccaaggtggcagctctcactgcggggaccctgctacttctgacagccatcggggcggcatcctgggccattgtggctgttctcctcaggagtgaccaggagccgctgtacccagtgcaggtcagctctgcggacgctcggctcatggtctttgacaagacggaagggacgtggcggctgctgtgctcctcgcgctccaacgccagggtagccggactcagctgcgaggagatgggcttcctcagggcactgacccactccgagctggacgtgcgaacggcgggcgccaatggcacgtcgggcttcttctgtgtggacgaggggaggctgccccacacccagaggctgctggaggtcatctccgtgtgtgattgccccagaggccgtttcttggccgccatctgccaagactgtggccgcaggaagctgcccgtggaccgcatcgtgggaggccgggacaccagcttgggccggtggccgtggcaagtcagccttcgctatgatggagcacacctctgtgggggatccctgctctccggggactgggtgctgacagccgcccactgcttcccggagcggaaccgggtcctgtcccgatggcgagtgtttgccggtgccgtggcccaggcctctccccacggtctgcagctgggggtgcaggctgtggtctaccacgggggctatcttccctttcgggaccccaacagcgaggagaacagcaacgatattgccctggtccacctctccagtcccctgcccctcacagaatacatccagcctgtgtgcctcccagctgccggccaggccctggtggatggcaagatctgtaccgtgacgggctggggcaacacgcagtactatggccaacaggccggggtactccaggaggctcgagtccccataatcagcaatgatgtctgcaatggcgctgacttctatggaaaccagatcaagcccaagatgttctgtgctggctaccccgagggtggcattgatgcctgccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaaggtgaaagttgggtccagatgggagccagggtggggacgtttgggtgtctaatgggggaagggaggcagagatttgttttaggaaacctacgctcaggcctagaagagggccccccttgggaacagatggactttgaagggttcctggggaagggaagccagtggtgggacgtggaagcctctcagacctcgggagcccccagctgtctttccccagactcaactcactccgaagccagcggcatggtgacccagctctgaccggtggcttctcgctgcgcagcctccagggcccgaggtgatcccggtggtgggatccacgctgggccgaggatgggacgtttttcttcttgggcccggtccacaggtccaaggacaccctccctccagggtcctctcttccacagtggcgggcccactcagccccgagaccacccaacctcaccctcctgacccccatgtaaatattgttctgctgtctgggactcctgtctaggtgcccctgatgatgggatgctctttaaataataaagatggttttgattaaaaaaaaaac

SEQ ID NO: 63451 - DNA, 416 bp, Homo sapiens
tggccccagcatggtgtctgttgcaggtggccggactgtgccatgctgctccagacccaaggtggcagctctcactgcggggaccctgctacttctgacagccatcggggcggcatcctgggccattggtgagagcggttcctgtgcctctgacctcccctggcccctgcagcctccagcctgcctgccctcacccctcccttctctgcagtggctgttctcctcaggagtgaccaggagccgctgtacccaggtgagtggagcaggctgggaccctctgggggagccctggaggacacgtgtatctggcgggagctcaacaagcgtatttgttgaataaatgcacaaatgcatgcagaaatgctaatcataatagtgcatttgtattgagtgcctgctatgtaccaggcactatt

SEQ ID NO: 63452 - DNA, 355 bp, Homo sapiens
cttagtggcctagagagcagaagcctagggcccattttctgtcccaactttgcccagatcccccctctactgaaccttgtccaggtctgaccccacactgaaatacctcacagaactgcttagagaagatcagagtttggagtagctattcctactgcctctccagagctggtgctcccaatttcctgaaacacaaaagctgataaatggagaaaggcaatgtactttgaatttaatgtacttaaattattttatgtaaaattaaaaccagtatttctagagacatcccatccagcaacctgttctccatctttgcagtttcagtggatttttcacaagtctcaaagtaactata

SEQ ID NO: 63453 - DNA, 258 bp, Homo sapiens
aatcttgtattatgttaatattaaaatctaataaaaatactgtgaagtattttcatttttgtgtataggcacaaatatatcatttaaatattagtaatagaattgaacaattaactataaaatattatatcataataaactgttgttttatcccaagggtagagggactctaagtaaaactgtaacagaatcaaaaggttactgaaagttagaatgggttgagaactattttaacttgggaactttaaagagtaatct

SEQ ID NO: 63454 - DNA, 253 bp, Homo sapiens
gtggtgcctctggaacatctttgcaggtcttgattcaaaagctgccattatttacaatatagattctaaactctatttgaagtccaacagaaccaagtactaagtagctagcatgtattgaacacatacaggatgccaagacctgttgtaagccttttatgtattaggtcattaaatccctattacaatcttagaatatgtactattattacagcaacccattttacaggcaatgaaactggacaagattatc

SEQ ID NO: 63455 - DNA, 978 bp, Homo sapiens
gctgggttgagcagagctgggctgggctgggctgagttgagccaggctgacctgggctgagccaagctgggttgagccaaactgggctgggctgggctgagccaggctggattgagctgggctgggctgggctaagctgagccgagcaaggttgagcgatggcctgggctgggatgaactggattgagctggcctgggctgggatgaactggaggacatggcactgggccaatcttcatgatcttgttggacatagatggatagcctcagctgagtctacactgcgttccccatcacacccaccctccctatactcactcccaggcctgggttgtctgcctggggagacttcagggtagctggagtgtgactgagctgggggcagcagaagctgggctggagggactctattggctgcctgcggggtgtgtggctccaggcttcacattcaggtatgcaacctgggccctccagctgcatgtgctgggagctgagtgtgtgcagcacctacgtgctgatgcctcgggggaaagcaggcctggtccacccaaacctgagccctcagccattctgagcagggagccaggggcagtcaggcctcagagtgcagcagggcagccagctgaatggtggcagggatggctcagcctgctccaggagaccccaggtctgtccaggtgttcagtgctgggccctgcagcaggatgggctgaggcctgcagccccagcagccttggacaaagacctgaggcctcaccacggccccgccacccctgatagccatgacagtctgggctttggaggcctgcaggtgggctcggccttggtggggcagccacagcgggacgcaagtagtgagggcactcagaacgccactcagccctgacaggcagggcacgaggaggcagctcctcaccctccctttctcttttgtcctgcgggtcctcagggagtgcatccgccccaacccttttcccc

SEQ ID NO: 63456 - DNA, 242 bp, Homo sapiens
agataacggctcccatcccatgctagagactccatctctaatttccccaagtctgtcaatgagaggcagggactgaaatcccaagttctgtctcaccggatattttccaggaatgcctctcttccaaatcatcagcgacatttaacatgaccctgagcagcaaacttctgccccagaggaaagcagaaaaccaatttatgtaaaattaaaagcgatttgcttgatccatcacttgcttccac

SEQ ID NO: 63457 - DNA, 305 bp, Homo sapiens
agaaatctctgaggtattgaagaattagatatccagttagtgcaacatggtatttaaaatttctagctctcaacaaacaattacaaaacatacaaaaaaagaggaaaacatggtccattcacagaaaaaaagaagtttacagaaatcttttctaagaaagaccagacattggaattattagtcaatggcattaagtcaactgccttaaatatgtttaatgagataaggaaaaccataaaccaagaactaaaaggaatcagtagaattatatatgaacaaagaaagaatatcaattaataaataga

SEQ ID NO: 63458 - DNA, 339 bp, Homo sapiens
gacggagtctcactctgtcaccaggctggagtgcagtggcgaaatctcggctcgctgcaacctccaaaaagaaaaagaaaaatgttatatagaattcataaacacgttctaaaagccagtgcatttgtttagcatatgtgtcaaatgcaaacagaagcaatagtgatattcctttctcattctataaccattggggaaacaatataccaacattcttaggcattaaagagatccctcttatcttgttgattaattctaattctctcattctaaatctgagtgctactcccagataggacataatacttactgggatgggcactgcttggagtggcagag

SEQ ID NO: 63459 - DNA, 700 bp, Homo sapiens
aaggacattatctcagtgacattcaagcctgcagtgcaaagagcttctccggtaagaaagttaacagggatttctaacatctggagtgcacaagtgttacacaaggaaaagagaagtttgtgtcaattaaagctagaaaagatagtgttaaaaagttggaaaaataaaagaaatctaaagctcgagtctaacataaaatccttctcacagcttagaaaagctttcctctgtgttgacaggtcaaagagcaactctgcaaatgagctaataattgtcaaaactttagccagacctttccaccatgtgccaggactaagtggctttacccagagaacagcagcttgaaaaagtcttggggttcaaatagatttgaaactacctcattgttttgtgaactaaggaaaattaaatagctaggcaacctccaaaaagaaaaagaaaaatgttatatagaattcataaacacgttctaaaagccagtgcatttgtttagcatatgtgtcaaatgcaaacagaagcaatagtgatattcctttctcattctataaccattggggaaacaatataccaacattcttaggcattaaagagatccctcttatcttgttgattaattctaattctctcattctaaatctgagtgctactcccagataggacataatacttactgggatgggcactgcttggagtggcagag

SEQ ID NO: 63460 - DNA, 1676 bp, Homo sapiens
gacagagctgagacagccacccagggggtccactccaggacagactgtgccgcctgagagtgcagaggatgcatcttatcgactacctgctcctcctgctggttggactactggccctttctcatggccagctgcacgttgagcatgatggtgagagttgcagtaacagctcccaccagcagattctggagacaggtgagggctcccccagcctcaagatagcccctgccaatgctgactttgccttccgcttctactacctgatcgcttcggagaccccggggaagaacatctttttctccccgctgagcatctcggcggcctacgccatgctttccctgggggcctgctcacacagccgcagccagatccttgagggcctgggcttcaacctcaccgagctgtctgagtccgatgtccataggggcttccagcacctcctgcacactctcaacctccccggccatgggctggaaacacgcgtgggcagtgctctgttcctgagccacaacctgaagttccttgcaaaattcctgaatgacaccatggccgtctatgaggctaaactcttccacaccaacttctacgacactgtgggcacaatccagcttatcaacgaccacgtcaagaaggaaactcgagggaagattgtggatttggtcagtgagctcaagaaggacgtcttgatggtgctggtgaattacatttacttcaaagccctgtgggagaaaccattcatttcctcaaggaccactcccaaagacttctatgttgatgagaacacaacagtccgggtgcccatgatgctgcaggaccaggagcatcactggtatcttcatgacagatacttgccctgctcggtgctacggatggattacaaaggagacgcaaccgtgtttttcattctccctaaccaaggcaaaatgagggagattgaagaggttctgactccagagatgctaatgaggtggaacaacttgttgcggaagaggaatttttacaagaagctagagttgcatcttcccaagttctccatttctggctcctatgtattagatcagattttgcccaggctgggcttcacggatctgttctccaagtgggctgacttatccggcatcaccaaacagcaaaaactggaggcatccaaaagtttccacaaggccaccttggacgtggatgaggctggcaccgaggctgcagcagccaccagcttcgcgatcaaattcttctctgcccagaccaatcgccacatcctgcgattcaaccggcccttccttgtggtgatcttttccaccagcacccagagtgtcctctttctgggcaaggtcgtcgaccccacgaaaccatagccctcccagggctgctcatctgttccaagcaggaggatgtggcaggggagggctgggagtgagtagctctgtgtttagagttggggacaaggatgacaccgaaggtccaggagtccaggacagcaggtgctggccggtggggagcggggaggggcactgagatgggcagggcctggacattccacaccctggtgctgtgcagcctctggcagagcatccgacctcttggagcaagtttctgcctctggaaagggggcgggcccttttcacaacaggctggttgtaccgagtaaacaacacgatgccatgaagaccctgattcag

SEQ ID NO: 63461 - DNA, 304 bp, Homo sapiens
attctcttccctcccataggcctgagagtgcagaggatgcatcttatcgactacctgctcctcctgctggttggactactggccctttctcatggccagctgcacgttgagcatgatggtgagagttgcagtaacagctcccaccagcagattctggagacaggtgagggctcccccagcctcaagatagcccctgccaatgctgactttgccttccgcttctactacctgatcgcttcggagaccccggggaagaacatctttttctccccgctgagcatctcggcggcctacgccatgcttt

SEQ ID NO: 63462 - DNA, 379 bp, Homo sapiens
agcctcaagatagcccctgccaatgctgactttgccttccgcttctactacctgatcgcttcggagaccccggggaagaacatctttttctccccgctgagcatctcggcggcctacgccatgctttccctgggggcctgctcacacagccgcagccagatccttgagggcctgggcttcaacctcaccgagctgtctgagtccgatgtccataggggcttccagcacctcctgcacactctcaacctccccggccatgggctggaaacacgcgtgggcagtgctctgttcctgagccacaacctgaagttccttgcaaaattcctgaatgacaccatggccgtctatgaggctaaactcttccacaccaacttctacg

SEQ ID NO: 63463 - DNA, 1622 bp, Homo sapiens
gacagagctgagacagccacccagggggtccactccaggacagactgtgccgcctgagagtgcagaggatgcatcttatcgactacctgctcctcctgctggttggactactggccctttctcatggccagctgcacgttgagcatgatggtgagagttgcagtaacagctcccaccagcagattctggagacaggtgagggctcccccagcctcaagatagcccctgccaatgctgactttgccttccgcttctactacctgatcgcttcggagaccccggggaagaacatctttttctccccgctgagcatctcggcggcctacgccatgctttccctgggggcctgctcacacagccgcagccagatccttgagggcctgggcttcaacctcaccgagctgtctgagtccgatgtccataggggcttccagcacctcctgcacactctcaacctccccggccatgggctggaaacacgcgtgggcagtgctctgttcctgagccacaacctgaagttccttgcattctacgacactgtgggcacaatccagcttatcaacgaccacgtcaagaaggaaactcgagggaagattgtggatttggtcagtgagctcaagaaggacgtcttgatggtgctggtgaattacatttacttcaaagccctgtgggagaaaccattcatttcctcaaggaccactcccaaagacttctatgttgatgagaacacaacagtccgggtgcccatgatgctgcaggaccaggagcatcactggtatcttcatgacagatacttgccctgctcggtgctacggatggattacaaaggagacgcaaccgtgtttttcattctccctaaccaaggcaaaatgagggagattgaagaggttctgactccagagatgctaatgaggtggaacaacttgttgcggaagaggaatttttacaagaagctagagttgcatcttcccaagttctccatttctggctcctatgtattagatcagattttgcccaggctgggcttcacggatctgttctccaagtgggctgacttatccggcatcaccaaacagcaaaaactggaggcatccaaaagtttccacaaggccaccttggacgtggatgaggctggcaccgaggctgcagcagccaccagcttcgcgatcaaattcttctctgcccagaccaatcgccacatcctgcgattcaaccggcccttccttgtggtgatcttttccaccagcacccagagtgtcctctttctgggcaaggtcgtcgaccccacgaaaccatagccctcccagggctgctcatctgttccaagcaggaggatgtggcaggggagggctgggagtgagtagctctgtgtttagagttggggacaaggatgacaccgaaggtccaggagtccaggacagcaggtgctggccggtggggagcggggaggggcactgagatgggcagggcctggacattccacaccctggtgctgtgcagcctctggcagagcatccgacctcttggagcaagtttctgcctctggaaagggggcgggcccttttcacaacaggctggttgtaccgagtaaacaacacgatgccatgaagaccctgattcag

SEQ ID NO: 63464 - DNA, 666 bp, Homo sapiens
gctcactgcagctgggctcaagcaagcctcccacctcagcctcccaactagctgggacttcaggcgcgcaccaccacgcttggctaattttttatttttagtagagttgggggtcttgatttgttacccaggctggtctggaatgccccaagtgattctcccacttcgcccgcccaaagtactgggagccaccacgccgggctagactgtggggtttttggggggcaagaattgtactcatatctctgtttccacagtgggtcttacactgtggacaaacagcagctgatgttctcacccggccttgttctaagaggactccaaaaagcaagtcgtagccccagtgactgggaaaggcttccccgggagagcggccgacacagctgccgcagtagtaagggtttatttatcaagactgatttatttatcagttcaagacacagttacacagagtgtgggggatggttcatcagcagctggcacgtccagtggcgcgtgtgcctcgggaaggcctgggagggggacacaggtgctccgcggggaaagctgcccccaccccagcccaaagaagccttccaagctccatcagtcatgcagtcatgtacttttcctcatcagcacaaaccccgcttccttgaagagaagcgtgaggctgggcacggtggc

SEQ ID NO: 63465 - DNA, 439 bp, Homo sapiens
ctgaataatggagtcagacactttccacagcatttctagaacagaatcttggagaatggcctgggctgggtctcaggctgaggatcaaaggttggtgtgttcactcgatgtagtcatctcagatttctgccttcattccctcagttttgacctacctactttgtggacttacatggtttactttgtaagccttagcaaatgaagctacgattaatttgtacgtggaaaaccttttgtctttttgattaaagatccagacctcaggatgtacttcattcagaggctacatttgcagaagaaaagtccgtttaaaatgaggaaaacaaagttgttaatagttaaaactaactagccttattgggactggcaaaaatactgaaaactttgataaggctaataaataccttgtttatgaacatcagtcattgaccttgtaagc

SEQ ID NO: 63466 - DNA, 321 bp, Homo sapiens
ggagaaaccagctataatcaggctggattcaaggggggctgcaggtcagggtcctgctgcttcctgtgactctgcggcctcattaataaacacgcactgagtctaggttccccacctccaagctcaggggctcacatctgtctgagtgctgacggcaggaaaggagtggaagtgaccgaggaagaaggatggaacagccaggcagcggctgagaacagcttggagccgacataactgtgtgataggaaaagccaaagttgcagggaaccggggatgggaatccatccagatttttcagtttaaactgattgggggaaaaaa

SEQ ID NO: 63467 - DNA, 1292 bp, Homo sapiens
  misc_feature (72)..(72): n is a, c, g, or t
  misc_feature (104)..(104): n is a, c, g, or t
  misc_feature (651)..(651): n is a, c, g, or t
cggagatcacagagcaatattattctctggatttattgggtttgctgcattctgttagcatcattcatattnttctcccatgggtaccactttcctctcttttnctaataccaagatatggagactcatttatgccgtggagtgtgatgctgggaaatgaatgcttgcttattacctctctccacaggacctttcatgaccatacgtcgatgtctgccgcctcagtataaataggcacattcagaaatgtgttctctagtgaaggacatgttggcttggtggaaagcacagggacttcacgtctggactgcgagtcagagctgtgcgtcatgtgcttactggctgtgtgaccttggataaatttgcctcagttttctcatttgtaaaacagacagtcgctatttctgggaatagatgagataataaggaaagaacctagaatggtacctggctcctgccagttgcacagaatgtttgttttgcagtgtgatgcgtccagtagggacacttaggggacagtgtactgtcatgctgttgccctgttttgtaagagtgactgatggctacgtgacatcaccacactccctgcaagagctgcggtgtatggcacgtggctaagctgtaggtgcacatggccttcaactccacctnagctccagccttctttttgggagaactggcctctgggtccacctatgaagcaggaaggttgattattacttaaacccatagtcttataacctcttgggaaaagattctctcaaaatgactcttgatggtcaacatgggtgtgcatttacgcagctttcattcccatcgcttcttgcaggcagtgttgttcctgattgccccagtctagtttatcgcaagggaatttctttgcggggcagtgagctcccttttggcagaagaaagagtcaagcagaggctgggaggttcccttacccacagtggtggctggctctgtagtgcctcccggctctgggttctactttcctagtctcctgcctttccgcaagtgtctccacccagctccgatagagtgggtagcatcaggagaagggagggcagggatgagtgttgtagcatctcaacatttaagagcagaggacggggggctggggaagagcatacactggggccggtgtgaggagggagaacattagaaaaaaaaagctaatgcctgctgggcttaatacgtaggtaatgggttgataggtaaatgtgtgccatggtggtttgctgcacctatgtaataaacctgcacatcctgcacatgtacctcagaactt

SEQ ID NO: 63468 - DNA, 280 bp, Homo sapiens
ggctcagtcacacagcgacgtagaggtgactggaggtatatacttgtcctcacctggatcatgctgatgtggccccaaccccacctccctacccatccccacctccctacccatccccacctccctacccatccccacctccctacccatccccacctccctacccatcctatgatgtccaaagaaaccagacagagcaaattggccgaggccaaggaacagttgacagaccatcatccccagaccaaccctagtgttggtacagcagcaagcgacacca

SEQ ID NO: 63469 - DNA, 117 bp, Homo sapiens
gaagctgggcaccatgcctccctgccactctgaggacacccaagcagcgcatgaagaggcccaggtggaaaggaattaagagccctggcaagcaacctacaacaattttcctgccat

SEQ ID NO: 63470 - DNA, 1575 bp, Homo sapiens
atgatgggctcagcaaacctcacttgtgtagacaatgtccccccaaattataaattttctatgcctcagaacgtgtctataacaacatgtttaaaaggtagaaaggatacacatcccctgtagaagagtgacctgaactggagttgcatttgacatctgatgtcagcatgagggtgctggtcaccggggacttgagtacgtactttcctttcaaaagcacaatagatcaagatacaggtacacacatagctacagatatagatccagccacagatccagattagatatagatgcatatagaagcctagaaaagccaatatggaaaactctggcagtgtttgattctgagtggcaagcatattggtgactgtaattatttcttgcagttttctatattttttagtttcccaaactgcaaaaaatacccacaacagttaccagagaaaatgctggatgccataagaaggaagaacctcaaggggcaggaggcaaagttgtcttcttggaggagggggtgttagaaataacccaggcctcctggaaaatgacccaaatacagcctggctctgccagccccaggcccttccccacccccagggcaccctttctgtcccagtagagaaggtgacctggagtcaggccttgtgtgtgctccaagcgtttggagctttaccgtgggatgtggggagccaggggtgttgtttgctggcatttctgtggctgggtctttctggctgtggagctgtgtttgtgggcagtggctgagatggaggacctggggcaggtgtctcagtgacagcgcagtatcctccagcctcttccagggccccacgctactggctacctggcaatacagtccagcagttgctgcttctctaggcccctggtgcattcagaaacctcctgaaggccagcggagggtaagccaggaacagatcatgtccattgcacttcactagctgagcgagttggttctgcccttctgatccttggtccctcagggccaggacaggcccggtgaccccataatcatgcagccgtcatgctccgtcatctgaaattcacaaggaaggcaaggattcaaaggaagatgtctgagatgctgaactccagctcagccacttgtcaactccttgaccttggacaagttacttaaattaagccttgattttttttcatctgaataaatagagataaaaatacttatttcatggacactttccatatcagtttatttggatttaacctccctagatttttttttagcacatgatagcaacttccttaataaatactgggtcccttctcctagccttccccattgctgttctttttaattccatcccacatgtcctgtgcctgaaatatcctgtgccatgtgcctgaaattccattcttctcctggaacccttaacaggccacattgctatgctccgttagtcccctgcatggcttaatgtattaggtaacatgaagcatgtaaggaagaactttctaacacaggtgctgaaatgggacaggaaatgctgatggagtgagctctttgtcaatagaagtattcaagcaaaaaaaaaa

SEQ ID NO: 63471 - DNA, 767 bp, Homo sapiens
  misc_feature (92)..(92): n is a, c, g, or t
  misc_feature (105)..(106): n is a, c, g, or t
tacagtccagcagttgctgcttctctaggcccctggtgctgttttcgcccaagagggggaaaaaaaaaacccccccctttcccccctccttnggaaaaggccagnncggagggtaagccaggaacagatcatgtccattgcacttcactagctgagcgagttggttctgcccttctgatccttggtccctcagggccaggacaggcccggtgaccccataatcatgcagccgtcatgctccgtcatctgaaattcacaaggaaggcaaggattcaaaggaagatgtctgagatgctgaactccagctcagccacttgtcaactccttgaccttggacaagttacttaaattaagccttgattttttttcatctgaataaatagagataaaaatacttatttcatggacactttccatatcagtttatttggatttaacctccctagatttttttttagcacatgatagcaacttccttaataaatactgggtcccttctcctagccttccccattgctgttctttttaattccatcccacatgtcctgtgcctgaaatatcctgtgccatgtgcctgaaattccattcttctcctggaacccttaacaggccacattgctatgctccgttagtcccctgcatggcttaatgtattaggtaacatgaagcatgtaaggaagaactttctaacacaggtgctgaaatgggacaggaaatgctgatggagtgagctctttgtcaatagaagtattcaagcaaaaaaaaaa

SEQ ID NO: 63472 - DNA, 363 bp, Homo sapiens
gattagtgaaattaatcataccttgagcatgtttgagatcttagcaattgagaggccagagagtgaaccagaaagtcagtcccgaggtcctcagctacctgggcggggctcccttacattcccatactttgtacccattgtaaaaagccagttgtatgctaggtttgtaggatatttgccagacttacagagaggcttgcttctgaagagccacgttcagaggcatggtggtgtggtactaagatcgcccagctggaggtcagaagacaggtttgaaatccaggattagcctctgactagctctttgactctaagtgagtcaggccccacgaagcctcagtttccccacctatgaaatgaaaa

SEQ ID NO: 63473 - DNA, 1593 bp, Homo sapiens
cagcacatgtccatgttggggtaaagacgtggagtggtcgtctcgcccatccgatatagagtccagaggcgcagggctcattcccaaggtcccttggccgacggcggccgggtccggcctagaccaggctcctgtgaggcagcccagcgactctgtctcctctggctctgcccacagacacactgtcacccaatgctaggagccactgcttgaggaagcctgggtttgtcactgcctgcagccacagactactcctgcctcaaaacgacgtcacgacactgcagagcaggccagctccagctgcacatggccgcctccatctctacacaactttgagtcacagaaatgtcacgtgacctgcagaagccaagggtcctcctccttgggggtctcttttactgactctgtgactcccagccggggatcttctgcccccaggggacaccgggccatgtctggggacatctgtggttgtcttgactaggggagctcctggcatggagtgggtggaggccagggatgctgctcggcaccctgcagtgcccaggacggccccacccttgagaacggttcagtcccaatgtccacagggcccagggggagacacccagcccaactcacagaagacccaggacaggtgatggtggtctatgtcaaccacctgttcatgagagagacacagggaggagagggggcacctgccaaccgtttcatgcgctggtagagaccgggaatagcttggacagattgttcctggataacacaagacagcttcctgtttaaaaaacaaaactccggcccggagcaggggctcacgcctataatcccagcactttgggaggctgaggcgggcagattacttgagcccacaagttggagaccagcctgactaacatggcgaaaccccgtctctactaaaaatacaaaaattagctgggtgtggacgcaggtgcctgtaatcccagcaacttgggaggccgaggcaggagaatcgcttgaacccgggaggcagaggttgcagtgagccgagattgcactactgcactccagcctgggcgacagagcaagacttggtctcaaaaacacacacaaaaaaccaaaactccaagcgcagagcacccagtgccatcttcgtccgaatgcagcactcctggctgggtcacggccacccctaggccagtgcctggccaggggcttctcttgtctatgaccaggcaggtcacaggcgggagggacccaggtcaggctcagctgctgccccaccggaaacagacccagcagccttgcctagaccccaggtgggtccaggtttttctattggggcagagagagtgggccaggatgggggcgtctctcagctctgcaagctggagaattaactccgggacttgagctcggggtccccgctgggcgcaggcgtgggctccagcgggaaggaagcccctcgttgggttctcagcatggacagctggatggcatcactggattccctcacctggatccggagacaaaaggggagaaaatgatgaggcagcgcccaggcctgcggggttgagtcagccgtaataacagcctgttggccctaagtgtctg

SEQ ID NO: 63474 - DNA, 665 bp, Homo sapiens
agcgggggcaggggcgtgggcggggcgtggaccagccgcgccgagcggggcctctccgggccgcgtctgtggggtcgagactgcgcggccgttgggcgtgcagcggcgccagtcggcggacgaggggcccccgggagttgctggactgagacatgagcctccaactgtgtggttgggctcggtagcacatcgtgggacttgggtgtgcgcccacagggccaggctctcagtcacccctggaaaatggtgcctggttcacagctcccgtgcatctgcctcatctctcctgatcaacgtctgtctcttgggagtagctagagttcctcatgagcttgtcctcaagcgaggcatgcatgaggcctccagccggtggtcagtgagggagttaagtggcttctccgtggaaacacagccttctgctgcagcagaggctcacccagcgtgaactgcccccagggaacactgggcgatgcctggggacattgtggttgtcacgatggggggtgctcctggcctggagtgggtggaggccagagacactgctcagcagcaccctgcagtgcccaggacggccccgtcccagagaacaatccagccccgaatgtcagcaccttccccctacccgagttgtgaaaataaaaaatgtttccagacattaccaggtg

SEQ ID NO: 63475 - DNA, 1837 bp, Homo sapiens
agcgggggcaggggcgtgggcggggcgtggaccagccgcgccgagcggggcctctccgggccgcgtctgtggggtcgagactgcgcggccgttgggcgtgcagcggcgccagtcggcggacgaggggcccccgggagttgctggactgagacatgagcctccaactgtgtggttgggctcggtagcacatcgtgggacttgggtgtgcgcccacagatggtttggccctgcagtgaccagagcagcccaagccgccaccatggtgaaattgctagtggccaaaatcctgtgcatggtgggcgtgttcttcttcatgctgctcggctccctgctccccgtgaagatcatcgagacagattttgagaaggcccatcgctcgaaaaagatcctctctctctgcaacacctttggaggaggggtgtttctggccacgtgcttcaacgctctgctgcccgctgtgagggaaaagctccagaaggtcctgagcctcggccacatcagcaccgactacccgctggccgaaaccatcctcctgctgggcttcttcatgaccgtcttcctggagcagctgatcctgaccttccgcaaggagaagccgtccttcatcgacctggagaccttcaacgccggatcggacgtgggcagcgactcggagtatgagagccccttcatggggggcgcgcggggccacgcgctgtacgtggagccccacggccacggccccagcctgagcgtgcagggcctctcgcgcgccagccccgtgcgcctgctcagcctggccttcgcgctgtcggcccactcggtctttgagggcctggccctgggcctgcaggaggagggggagaaagtggtgagcctgttcgtgggggtggccgtccacgagacactggtggccgtggccctgggcatcagcatggcccggagtgccatgcccctgcgggacgcggccaagctggcggtcaccgtaagcgccatgatccccctgggcatcggcctgggcctgggcattgagagcgcccagggcgtgccgggcagcgtggcgtccgtgctgctgcagggcctggcgggcggcaccttcctcttcatcaccttcctggagatcctggccaaggagctggaggagaagagtgaccgtctgctcaaggtcctcttcctggtgctgggctacaccgtcctggccgggatggtcttcctcaagtggtgagcggcctcgccattgtccctgccgccggagcccgccgggagccccgggccggacacaggccgcgtcccccggccgcgcgtcccccaagagcgagcactgtggccctgggccaccacctgtgcacaaggggcctcccgggaccaggctgtgcccccgatcctacaccctgagcctcagagcactgctactttttaaaatacttctttctcttaaaagtctttaccaaaaaaaaaaaaaaaaaaaaaaaaaaaaaaaaaaaaaaaaaaaaacaagaaaaacaaaagaaagaagaaaacaaaagaaacaaaggcggggggcgccacccaagaaaagaaatccaccacggaggggcccaccaacatacagaggacacagcgacgatacgtgtacaacaacagagaggtcgccccaacaaagggcgacggctgctacaaaacgacagacaaaacaaacgtgccgcgcccactaataaaaacacccacccgcgagacagagatacgaaaaaaacagcagcccaaccagagacaaaacaacgagagaagaaaaacacacctcacacaacaggctgggtggacggaaaaaacaaaatacggggcacaaaaaacaaccaccaactaaacaaatattatcacg

SEQ ID NO: 63476 - DNA, 1227 bp, Homo sapiens
agcgggggcaggggcgtgggcggggcgtggaccagccgcgccgagcggggcctctccgggccgcgtctgtggggtcgagactgcgcggccgttgggcgtgcagcggcgccagtcggcggacgaggggcccccgggagttgctggactgagacatgagcctccaactgtgtggttgggctcggtagcacatcgtgggacttgggtgtgcgcccacagatggtttggccctgcagtgaccagagcagcccaagccgccaccatggtgaaattgctagtggccaaaatcctgtgcatggtgggcgtgttcttcttcatgctgctcggctccctgctccccgtgaagatcatcgagacagattttgagaaggcccatcgctcgaaaaagatcctctctctctgcaacacctttggaggaggggtgtttctggccacgtgcttcaacgctctgctgcccgctgtgagggaaaagctccagaaggtcctgagcctcggccacatcagcaccgactacccgctggccgaaaccatcctcctgctgggcttcttcatgaccgtcttcctggagcagctgatcctgaccttccgcaaggagaagccgtccttcatcgacctggagaccttcaacgccggatcggacgtgggcagcgactcggagtatgagagccccttcatggggggcgcgcggggccacgcgctgtacgtggagccccacggccacggccccagcctgagcgtgcagggcctctcgcgcgccagccccgtgcgcctgctcagcctggccttcgcgctgtcggcccactcggtctttgagggcctggccctgggcctgcaggaggagggggagaaagtggtgagcctgttcgtgggggtggccgtccacgagacactggtggccgtggccctgggcatcagcatggcccggagtgccatgcccctgcgggacgcggccaagctggcggtcaccgtaagcgccatgatccccctgggcatcggcctgggcctgggcattgagagcgcccagggcgtgccaggccgcgtcccccggccgcgcgtcccccaagagcgagcactgtggccctgggccaccacctgtgcacaaggggcctcccgggaccaggctgtgcccccgatcctacaccctgagcctcagagcactgctactttttaaaatacttctttctcttaaaagtctttaccataccaaagctgtgtggccatgtcaacctc

SEQ ID NO: 63477 - DNA, 901 bp, Homo sapiens
agcgggggcaggggcgtgggcggggcgtggaccagccgcgccgagcggggcctctccgggccgcgtctgtggggtcgagactgcgcggccgttgggcgtgcagcggcgccagtcggcggacgaggggcccccgggagttgctggactgagacatgagcctccaactgtgtggttgggctcggtagcacatcgtgggacttgggtgtgcgcccacagatggtttggccctgcagtgaccagagcagcccaagccgccaccatggtgaaattgctagtggccaaaatcctgtgcatggtgggcgtgttcttcttcatgctgctcggctccctgctccccgtgaagatcatcgagacagattttgagaaggcccatcgctcgaaaaagatcctctctctctgcaacacctttggaggaggggtgtttctggccacgtgcttcaacgctctgctgcccgctgtgagggaaaagctccagaaggtcctgagcctcggccacatcagcaccgactacccgctggccgaaaccatcctcctgctgggcttcttcatgaccgtcttcctggagcagctgatcctgaccttccgcaaggagaagccgtccttcatcgacctgcagtgaccagagcagcccaagccgccaccatggtgaaattgctagtggccaaaatcctgtgcatggtgggcgtgttcttcttcatgctgctcggctccctgctcccagcaggcgtgggctccagcgggaaggaagcccctcgttgggttctcagcatggacagctggatggcatcactggattccctcacctggatccggagacaaaaggggagaaaatgatgaggcagcgcccaggcctgcggggttgagtcagccgtaataacagcctgttggccctaagtgtctg

SEQ ID NO: 63478 - DNA, 1704 bp, Homo sapiens
agcgggggcaggggcgtgggcggggcgtggaccagccgcgccgagcggggcctctccgggccgcgtctgtggggtcgagactgcgcggccgttgggcgtgcagcggcgccagtcggcggacgaggggcccccgggagttgctggactgagacatgagcctccaactgtgtggttgggctcggtagcacatcgtgggacttgggtgtgcgcccacagatggtttggccctgcagtgaccagagcagcccaagccgccaccatggtgaaattgctagtggccaaaatcctgtgcatggtgggcgtgttcttcttcatgctgctcggctccctgctccccgtgaagatcatcgagacagattttgagaaggcccatcgctcgaaaaagatcctctctctctgcaacacctttggaggaggggtgtttctggccacgtgcttcaacgctctgctgcccgctgtgagggaaaaggtaagggctccctgggcactagcagcagcccttggcaccttatggccaagggactctgatgcattttcaacactgatgccaagttcagtgaaggccttgatgctgtaagggtgacggaaagtaggaagtgaatttgctgtgtgattgtgaactggttactttctgtctctgtgctctaccggccaaacaaggggtttggaccagacctgggattcccaacaggtggacttgtcggttgtcacctgataatcagaccagactacccacctaggtagggcacactctgtcctgaagctggaaagcatggcctctcttcggttcctatatcagtcagctactgttgcgtaacaaattatagcaaactgagcaccttaggactacagacgtttatcatctcacagtttctgtgagtcaggggtctgggcactgcttcaggagctcacaaggcagcagtcacagtgtctcctgggctgtggtctcatctcaacgttcaaccggggatgggtcggcctctaagctcatgtggttgtaagccaggttcagttcctcattggttgtcagaccgaaggtgtctgtttgtcagtgtctgttggctggggcagccctcagagcctggccacgtggacctccccagcatgatcagttccttcatcagcaaatggagaagatggccatgactctgtgtaagacagagggcacagtcccatgtcatgcagaggtgacagggtatcccttcccctctgccccagtgtcctgctggttagaagcaagttcaagtccttcccatactcaagtggccaggacctcacagggtatggctgtcaagaggcaggggcttctggggccatcttggagtctgtccaccccaactcctgacagcatcatcctctgctgacctgttccttgagctcccccatatcagcagcccagagtgtgggtcccctgtcaggccacagtgtgaccagccctggccatgcttgctgggtgaccctgggtgagtggcttcctctctctgggccagtgccagatgtgacattgaatttgtgttggttacatacttggtggagatatgaggaccccctgttcttcctcccaacgaaagcatggaagccctaagcttatcccccaacccctggccctgcttttcctcgtgcctagtgtccagccccgaatgtcagcaccttccccctacccgagttgtgaaaataaaaaatgtttccagacattaccaggtg

SEQ ID NO: 63479 - DNA, 1804 bp, Homo sapiens
  misc_feature (27)..(27): n is a, c, g, or t
  misc_feature (37)..(37): n is a, c, g, or t
  misc_feature (40)..(40): n is a, c, g, or t
  misc_feature (68)..(68): n is a, c, g, or t
  misc_feature (87)..(89): n is a, c, g, or t
cgcggtctggtggggtcgacgacatgnctgcggccgntantgggcgtttgcagctggcgcccagatancggcggaacgaatggggcnnnccccggcgacgtttgttgctggactgagacatgagcctccaactgtgtggttgggctcggtagcacatcgtgggacttgggtgtgcgcccacagatggtttggccctgcagtgaccagagcagcccaagccgccaccatggtgaaattgctagtggccaaaatcctgtgcatggtgggcgtgttcttcttcatgctgctcggctccctgctccccgtgaagatcatcgagacagattttgagaaggcccatcgctcgaaaaagatcctctctctctgcaacacctttggaggaggggtgtttctggccacgtgcttcaacgctctgctgcccgctgtgagggaaaagctccagaaggtcctgagcctcggccacatcagcaccgactacccgctggccgaaaccatcctcctgctgggcttcttcatgaccgtcttcctggagcagctgatcctgaccttccgcaaggagaagccgtccttcatcgacctggagaccttcaacgccggatcggacgtgggcagcgactcggagtatgagagccccttcatggggggcgcgcggggccacgcgctgtacgtggagccccacggccacggccccagcctgagcgtgcagggcctctcgcgcgccagccccgtgcgcctgctcagcctggccttcgcgctgtcggcccactcggtctttgagggcctggccctgggcctgcaggaggagggggagaaagtggtgagcctgttcgtgggggtggccgtccacgagacactggtggccgtggccctgggcatcagcatggcccggagtgccatgcccctgcgggacgcggccaagctggcggtcaccgtaagcgccatgatccccctgggcatcggcctgggcctgggcattgagagcgcccagggcgtgccgggcagcgtggcgtccgtgctgctgcagggcctggcgggcggcaccttcctcttcatcaccttcctggagatcctggccaaggagctggaggagaagagtgaccgtctgctcaaggtcctcttcctggtgctgggctacaccgtcctggccgggatggtcttcctcaagtggtgagcggcctcgccattgtccctgccgccggagcccgccgggagccccgggccggacacaggccgcgtcccccggccgcgcgtcccccaagagcgagcactgtggccctgggccaccacctgtgcacaaggggcctcccgggaccaggctgtgcccccgatcctacaccctgagcctcagagcactgctactttttaaaatacttctttctcttaaaagtctttaccaaaaaaaaaaaaaaaaaaaaaaaaaaaaaaaaaaaaaaaaaaaaacaagaaaaacaaaagaaagaagaaaacaaaagaaacaaaggcggggggcgccacccaagaaaagaaatccaccacggaggggcccaccaacatacagaggacacagcgacgatacgtgtacaacaacagagaggtcgccccaacaaagggcgacggctgctacaaaacgacagacaaaacaaacgtgccgcgcccactaataaaaacacccacccgcgagacagagatacgaaaaaaacagcagcccaaccagagacaaaacaacgagagaagaaaaacacacctcacacaacaggctgggtggacggaaaaaacaaaatacggggcacaaaaaacaaccaccaactaaacaaatattatcacg

SEQ ID NO: 63480 - DNA, 3001 bp, Homo sapiens
agcgggggcaggggcgtgggcggggcgtggaccagccgcgccgagcggggcctctccgggccgcgtctgtggggtcgagactgcgcggccgttgggcgtgcagcggcgccagtcggcggacgaggggcccccgggagttgctggactgagacatgagcctccaactgtgtggttgggctcggtagcacatcgtgggacttgggtgtgcgcccacagatggtttggccctgcagtgaccagagcagcccaagccgccaccatggtgaaattgctagtggccaaaatcctgtgcatggtgggcgtgttcttcttcatgctgctcggctccctgctccccgtgaagatcatcgagacagattttgagaaggcccatcgctcgaaaaagatcctctctctctgcaacacctttggaggaggggtgtttctggccacgtgcttcaacgctctgctgcccgctgtgagggaaaaggtaagggctccctgggcactagcagcagcccttggcaccttatggccaagggactctgatgcattttcaacactgatgccaagttcagtgaaggccttgatgctgtaagggtgacggaaagtaggaagtgaatttgctgtgtgattgtgaactggttactttctgtctctgtgctctaccggccaaacaaggggtttggaccagacctgggattcccaacaggtggacttgtcggttgtcacctgataatcagaccagactacccacctaggtagggcacactctgtcctgaagctggaaagcatggcctctcttcggttcctatatcagtcagctactgttgcgtaacaaattatagcaaactgagcaccttaggactacagacgtttatcatctcacagtttctgtgagtcaggggtctgggcactgcttcaggagctcacaaggcagcagtcacagtgtctcctgggctgtggtctcatctcaacgttcaaccggggatgggtcggcctctaagctcatgtggttgtaagccaggttcagttcctcattggttgtcagaccgaaggtgtctgtttgtcagtgtctgttggctggggcagccctcagagcctggccacgtggacctccccagcatgatcagttccttcatcagcaaatggagaagatggccatgactctgtgtaagacagagggcacagtcccatgtcatgcagaggtgacagggtatcccttcccctctgccccagtgtcctgctggttagaagcaagttcaagtccttcccatactcaagtggccaggacctcacagggtatggctgtcaagaggcaggggcttctggggccatcttggagtctgtccaccccaactcctgacagcatcatcctctgctgacctgttccttgagctcccccatatcagcagcccagagtgtgggtcccctgtcaggccacagtgtgaccagccctggccatgcttgctgggtgaccctgggtgagtggcttcctctctctgggccagtgccagatgtgacattgaatttgtgttggttacatacttggtggagatatgaggaccccctgttcttcctcccaacgaaagcatggaagccctaagcttatcccccaacccctggccctgcttttcctcgtgcctagtgtccagaaaggaggagaagggctgttgtctgggattaaatcatctgagcctgttagtgtggcagagtagagttccagggtggctccctgagcttccagcccctgctccgcacgccccatgctcttccctcccctcgagtgtgggtagggctgggactgccgtgcgtgtcactcctgccattatgtcagaatcccagcagaggggatgttgcagctgtgatgaccgccccagatcggttagcgctgagttcatcaaaagggagggggtgggcctggcctaatcaggtgagccactcaccctcctgctggccttggagaagcaaaaagccagggtgtgccaggagaagggcatgaagcgaggacccgagggcagcctctcggtgccaagagccatccccgccaacagccagccaggacacggggcctcagtccacagccaccaggaggtggactcttccgacctccagtgagcttggaagaggaccctgggtgtcagtgagatctcagccctgatgacaccctgcgagacctggagcgtagggcccagctagcccgcacctggatttccaccgttcagagccgagacaccgcattcctgctgttccgcgtggctgagtctgcattcgttcgttacgcggtgtgtgaagactgacatctgcactgcgaggatggagatcttggtcatctctgacatctcctgcatcgcagaggccactgccagccccccttttcccccatggtcatggtgtcacccccgtcaccctctgactgcaggcctgggcgactgcggggagcttgctcttccctccccctcatcacagtggccttctcatggcacccaaacctttcccgccgttctcctgtcctcgggctggtcaggcggatgaggtccctactcccgagcccccagcctcacccactgcagggccaggctctcagtcacccctggaaaatggtgcctggttcacagctcccgtgcatctgcctcatctctcctgatcaacgtctgtctcttgggagtagctagagttcctcatgagcttgtcctcaagcgaggcatgcatgaggcctccagccggtggtcagtgagggagttaagtggcttctccgtggaaacacagccttctgctgcagcagaggctcacccagcgtgaactgcccccagggaacactgggcgatgcctggggacattgtggttgtcacgatggggggtgctcctggcctggagtgggtggaggccagagacactgctcagcagcaccctgcagtgcccaggacggccccgtcccagagaacaatccagccccgaatgtcagcaccttccccctacccgagttgtgaaaataaaaaatgtttccagacattaccaggtg

SEQ ID NO: 63481 - DNA, 183 bp, Homo sapiens
cagcccatggagggtgagccaaagcagggtggggcatcacctcacccaggaagcacaaggggtcgggggatttccctttcctagccacgggaagccgtgacagactgtacctggaaaaaggagaaacttccgcccaaatactgcgcttttcccaaggtcttagcaactggcagacaaggagat

SEQ ID NO: 63482 - DNA, 128 bp, Homo sapiens
aaacatttgcttctgtcatagttgctaccagatgggacctgcaagctatagttatcctattctaagcactttttttgtaatggtattcttcgctttagatctttaacattttatttttaggttataaa

SEQ ID NO: 63483 - DNA, 2935 bp, Homo sapiens
  misc_feature (447)..(447): n is a, c, g, or t
aaaaggagagaacatttaaaaaacaacaacaaaaaaaactggttatacaattcactttaatggacttttacatgtataatcatctaataaaaacaggtgtggggcataatgatttttccagggggtagtctagctatctcatagggtttaagttactgaaaattaagttgaaataaaattggcacagacatagatattctgttttatgtaacagagtaaatcttttgtactactgtggcagaaacccaagtgtttctgtgctctggagtgacattgttttaaagacaggacatctggtgactacaactcaggggaagccacaaatcatctttgagagttaacctgacacaagcaaccatctttagatttttatcaatgcaagaaaaaaattaatcttcattctggttgggtcatcgtttctcttatctgcttgcttgttctttgtgnaggcattttgggatagtggaaaggtggtttcatttactagctgaataaccttgaacaaattgtggaacttccttattgtcagtgtcatcctctattaaaagtcagcgtaacaattattattcctgattggtttaagaattaaataaaacagactgaccatcacctggtacatggtagatagtaaagttaattcctttcctaaagctattattgtgtcttcttttaatacccatcaatcaagaaagcaaccaggaagggaatccatttcactcaggcccctttgtcctggaggtcctctgttctaagtgtttcattctggaaaaataagttggaagtttttcatttgcttcagcaccactccactggcttgccacatcttccttggtctccttggacagtgtggtaactcagtattccagctttctatcatacttggggttatggccagagtgacagaatgggcccagaccctgcagagttgagtagacgggcctccagactaaataaatcaggattgttcaaccatttacaatagccaccctggcctggaactagccttttgccatcagagttcctggaaagcagcaattttgtgatgcactttgtgggctatcaggattacatccaaagttaacaaacactactaaaaaaagttttgggattcaataaattaggaaaatgctgcataactgcctctcaaattcttatgtgcagttaagtgctttgagaaattgcacagtgaagaaccttgttgaacttttttcaccccggcacctcccaaactcattgaactattgaactagagccctgtttttgggaagtcactattaatgtccaatggctcttctgtatcccatctaccattttccttgaagtgcctaacctccgaaagaggttgcatacttcccaaacatgttaagacaggtaagccctggaaacttatgttctcatgtaacatttcactctttgctttatgattttataagctgagcttctgtttgtgtgcttgttctgactgatttgttctttcaccctgtgtagcctaatgcatggaaagctaacaggatggagcacaagtcaggatccctttcctctagccgggagtctgcttttaccagtccaatctctgttaccaaaccagtggtactggctagtggtgcagctctgagttctcccaaagagagtccctccagcaccacccctccaattgagatcagctcctctcgtctgaccaagttgacccgccgaaccaccgacaggaagagtgagttcctgaaaactctgaaggatgaccggaatggagacttctcagagaatagagactgtgacaagctggaagatttggaggacaacagcacacctgaaccaaaggaaaatggggaggaaggctgtcatcaaaatggtcttgccctccctgtagtggaagaaggggaggttctctcacactctctagaagcagagcacaggttattgaaagctatgggttggcaggaatatcctgaaaatgatgagaattgccttcccctcacagaggatgagctcaaagagttccacatgaagacagagcagctgagaagaaatggctttggaaagaatggcttcttgcagagccgcagttccagtctgttctccccttggagaagcacttgcaaagcagagtttgaggactcagacaccgaaaccagtagcagtgaaacatcagatgacgatgcctggaagtaggcatataaatgctcacagttaaatctgacccagtaaactctgtgtgtttagggagtatacaaaagaaatcgttcttttccttttcttatgttgttgaatacttcattcacaagggaaataatcatatcccaaagagagagcaattggcttgttttgcttttgttattgttcttccctgttatctgctttatagagagaagtttgtgtggtgggacagattttttaaacacactcacacacacacacacatacacacccagtatatatggggcgatgcacaggtaggagctggcagtgcagggaagaggagacactggtctgcagcaacagcttctactaccagcccttggggcactcacccctgtgatcaagcaatcattgtcaatgacaaagtgactattgaagttataattgtattaaattaatgctaataatttggatattttattttatttttggctgctcgggtaactttagcccttaaccaagcatatgtgggtttttttggttgtttttttttgttttttttttctttttcctttttgggtacagctgtaaaatatttggatataggaaatgttgtgttattcttgcagccttgatattcagggtggattgtaaaatataaatttttgtgagatttcaaagattaagattattttgataacattatttacagatttaaaagatgtggttatcacaagtctcgagggggaaactactgcataaaataactaacttggaataaatattttgcatcagtttg

SEQ ID NO: 63484 - DNA, 3468 bp, Homo sapiens
cgagtatgggctatcgtcgacccacgccgtcgctttgttatggttgtggactagccgcctctgccgggtcgacaagctggggacgcgtcctcagacgcagcgtctagtccctggccatagctccgccgctgcccgttggtgtctcacctttaactctccttatgctgggtgaaaacaaagagtgatagattcgtgtggcctttcaaatgattgtgaagtggtggaaatggatccaaaataataagtgacttctctaccaaagcatagaagattcttcatatctccttccagtggctcaatttagattttgggaaggagcagaacaagtgaaacacagaaaactgaagagaagaaatcctcattttggacctatatttctccttgactatttcttaatatccatcctacccatcgttctaatgttttaactttgctctgaatttataaatagtaaaggccaaagacatagaatatacatttagtagctttataccaagaaatttgccttgaaagctgctgttcgtggagggaaaagtgtagcaaattcctgtctatttttattttttatttttttttaacaaagacaagatttatgtccctagattttgaaggttaaggcaaatataaatacatatctgcacactattttttagcagttgcatgagtaagagtaatgagatttgtattttaaggactttgtcatgtggatgttttggagttgactgctcagatcttttatagggctttaatatttttgatctattaccttgatgacattatttgtccacacttgagcccatctgtctttctagctatgaccttgttatgaacagtatttgcactcggtgcaaatatccatgtcttacctaattaagcaacatcatagtgccataactcaaggaagttgaatgaggtgaacatagatacagctctttccccttccccccctttttaaatgtaacaaatactttttatgttccccttccccccttccccttttcccctttccccttttggaaacgtgtcaggaaccaaatagtttaagatgagcagttgaggggactgagagagtgatcgacacagaacctggcttcttcgtgcttcatcataagtcgtgctgccggccaggttacttaagcacccttttaacaaggaaaccttgtgggagatccagctggccgactcgagttcagaaacaggaccacagaggttacactctgggatcctggccatgaggttggatgcctcaccttactgaaaggagacactggacctaaatggcgcagcatgattttgttcctgcttggctaaatttctcaacaccacagtcagctaagtcacctactgccaccttcgaaaaacacggagagcacctacccagaggagaaggtagatttggagtaagccgccgtcgacataattcctctgatggtttttttaacaatggtcccctacgaactgcaggagattcttggcaccagccctccctgttccgccatgattctgtggactctggtgtctctaagggagcatatgctggaatcacagggaacccatctggttggcatagctcttcccgaggtcatgatggcatgagccaacgtagtggaggtggcacagggaaccatcgccattggaatggcagcttccactcccggaaagggtgtgcttttcaggaaaagccacctatggagattagggaagaaaagaaagaagacaaggtggaaaagttgcagtttgaagaggaggactttccttccttgaatccagaagctggcaaacagcatcagccatgcagacctattgggacaccttctggagtatgggaaaacccgcctagtgccaagcaaccctccaagatgctagttatcaaaaaagtttccaaagaggatcctgctgctgccttctctgctgcattcacctcaccaggatctcaccatgcaaatgggaacaaattgtcatccgtggttccaagtgtctataagaacctggttcctaagcctgtaccacctccttccaagcctaatgcatggaaagctaacaggatggagcacaagtcaggatccctttcctctagccgggagtctgcttttaccagtccaatctctgttaccaaaccagtggtactggctagtggtgcagctctgagttctcccaaagagagtccctccagcaccacccctccaattgagatcagctcctctcgtctgaccaagttgacccgccgaaccaccgacaggaagagtgagttcctgaaaactctgaaggatgaccggaatggagacttctcagagaatagagactgtgacaagctggaagatttggaggacaacagcacacctgaaccaaaggaaaatggggaggaaggctgtcatcaaaatggtcttgccctccctgtagtggaagaaggggaggttctctcacactctctagaagcagagcacaggttattgaaagctatgggttggcaggaatatcctgaaaatgatgagaattgccttcccctcacagaggatgagctcaaagagttccacatgaagacagagcagctgagaagaaatggctttggaaagaatggcttcttgcagagccgcagttccagtctgttctccccttggagaagcacttgcaaagcagagtttgaggactcagacaccgaaaccagtagcagtgaaacatcagatgacgatgcctggaagtaggcatataaatgctcacagttaaatctgacccagtaaactctgtgtgtttagggagtatacaaaagaaatcgttcttttccttttcttatgttgttgaatacttcattcacaagggaaataatcatatcccaaagagagagcaattggcttgttttgcttttgttattgttcttccctgttatctgctttatagagagaagtttgtgtggtgggacagattttttaaacacactcacacacacacacacatacacacccagtatatatggggcgatgcacaggtaggagctggcagtgcagggaagaggagacactggtctgcagcaacagcttctactaccagcccttggggcactcacccctgtgatcaagcaatcattgtcaatgacaaagtgactattgaagttataattgtattaaattaatgctaataatttggatattttattttatttttggctgctcgggtaactttagcccttaaccaagcatatgtgggtttttttggttgtttttttttgttttttttttctttttcctttttgggtacagctgtaaaatatttggatataggaaatgttgtgttattcttgcagccttgatattcagggtggattgtaaaatataaatttttgtgagatttcaaagattaagattattttgataacattatttacagatttaaaagatgtggttatcacaagtctcgagggggaaactactgcataaaataactaacttggaataaatattttgcatcagtttg

SEQ ID NO: 63485 - DNA, 3533 bp, Homo sapiens
acgggggatgggagggccgtgctgctggtcgctcctcctcctccacccgctctgcccctcctggaccttgtgggccgggcagccattttgggaagagctttgttatggttgtggactagccgcctctgccgggtcgacaagctggggacgcgtcctcagacgcagcgtctagtccctggccatagctccgccgctgcccgttggtgtctcacctttaactctccttatgctgggtgaaaacaaagagtgatagattcgtgtggcctttcaaatgattgtgaagtggtggaaatggatccaaaataataagtgacttctctaccaaagcatagaagattcttcatatctccttccagtggctcaatttagattttgggaaggagcagaacaagtgaaacacagaaaactgaagagaagaaatcctcattttggacctatatttctccttgactatttcttaatatccatcctacccatcgttctaatgttttaactttgctctgaatttataaatagtaaaggccaaagacatagaatatacatttagtagctttataccaagaaatttgccttgaaagctgctgttcgtggagggaaaagtgtagcaaattcctgtctatttttattttttatttttttttaacaaagacaagatttatgtccctagattttgaaggttaaggcaaatataaatacatatctgcacactattttttagcagttgcatgagtaagagtaatgagatttgtattttaaggactttgtcatgtggatgttttggagttgactgctcagatcttttatagggctttaatatttttgatctattaccttgatgacattatttgtccacacttgagcccatctgtctttctagctatgaccttgttatgaacagtatttgcactcggtgcaaatatccatgtcttacctaattaagcaacatcatagtgccataactcaaggaagttgaatgaggtgaacatagatacagctctttccccttccccccctttttaaatgtaacaaatactttttatgttccccttccccccttccccttttcccctttccccttttggaaacgtgtcaggaaccaaatagtttaagatgagcagttgaggggactgagagagtgatcgacacagaacctggcttcttcgtgcttcatcataagtcgtgctgccggccaggttacttaagcacccttttaacaaggaaaccttgtgggagatccagctggccgactcgagttcagaaacaggaccacagaggttacactctgggatcctggccatgaggttggatgcctcaccttactgaaaggagacactggacctaaatggcgcagcatgattttgttcctgcttggctaaatttctcaacaccacagtcagctaagtcacctactgccaccttcgaaaaacacggagagcacctacccagaggagaaggtagatttggagtaagccgccgtcgacataattcctctgatggtttttttaacaatggtcccctacgaactgcaggagattcttggcaccagccctccctgttccgccatgattctgtggactctggtgtctctaagggagcatatgctggaatcacagggaacccatctggttggcatagctcttcccgaggtcatgatggcatgagccaacgtagtggaggtggcacagggaaccatcgccattggaatggcagcttccactcccggaaagggtgtgcttttcaggaaaagccacctatggagattagggaagaaaagaaagaagacaaggtggaaaagttgcagtttgaagaggaggactttccttccttgaatccagaagctggcaaacagcatcagccatgcagacctattgggacaccttctggagtatgggaaaacccgcctagtgccaagcaaccctccaagatgctagttatcaaaaaagtttccaaagaggatcctgctgctgccttctctgctgcattcacctcaccaggatctcaccatgcaaatgggaacaaattgtcatccgtggttccaagtgtctataagaacctggttcctaagcctgtaccacctccttccaagcctaatgcatggaaagctaacaggatggagcacaagtcaggatccctttcctctagccgggagtctgcttttaccagtccaatctctgttaccaaaccagtggtactggctagtggtgcagctctgagttctcccaaagagagtccctccagcaccacccctccaattgagatcagctcctctcgtctgaccaagttgacccgccgaaccaccgacaggaagagtgagttcctgaaaactctgaaggatgaccggaatggagacttctcagagaatagagactgtgacaagctggaagatttggaggacaacagcacacctgaaccaaaggaaaatggggaggaaggctgtcatcaaaatggtcttgccctccctgtagtggaagaaggggaggttctctcacactctctagaagcagagcacaggttattgaaagctatgggttggcaggaatatcctgaaaatgatgagaattgccttcccctcacagaggatgagctcaaagagttccacatgaagacagagcagctgagaagaaatggctttggaaagaatggcttcttgcagagccgcagttccagtctgttctccccttggagaagcacttgcaaagcagagtttgaggactcagacaccgaaaccagtagcagtgaaacatcagatgacgatgcctggaagtaggcatataaatgctcacagttaaatctgacccagtaaactctgtgtgtttagggagtatacaaaagaaatcgttcttttccttttcttatgttgttgaatacttcattcacaagggaaataatcatatcccaaagagagagcaattggcttgttttgcttttgttattgttcttccctgttatctgctttatagagagaagtttgtgtggtgggacagattttttaaacacactcacacacacacacacatacacacccagtatatatggggcgatgcacaggtaggagctggcagtgcagggaagaggagacactggtctgcagcaacagcttctactaccagcccttggggcactcacccctgtgatcaagcaatcattgtcaatgacaaagtgactattgaagttataattgtattaaattaatgctaataatttggatattttattttatttttggctgctcgggtaactttagcccttaaccaagcatatgtgggtttttttggttgtttttttttgttttttttttctttttcctttttgggtacagctgtaaaatatttggatataggaaatgttgtgttattcttgcagccttgatattcagggtggattgtaaaatataaatttttgtgagatttcaaagattaagattattttgataacattatttacagatttaaaagatgtggttatcacaagtctcgagggggaaactactgcataaaataactaacttggaataaatattttgcatcagtttg

SEQ ID NO: 63486 - DNA, 3488 bp, Homo sapiens
acgggggatgggagggccgtgctgctggtcgctcctcctcctccacccgctctgcccctcctggaccttgtgggccgggcagccattttgggaagagctttgttatggttgtggactagccgcctctgccgggtcgacaagctggggacgcgtcctcagacgcagcgtctagtccctggccatagctccgccgctgcccgagtgatagattcgtgtggcctttcaaatgattgtgaagtggtggaaatggatccaaaataataagtgacttctctaccaaagcatagaagattcttcatatctccttccagtggctcaatttagattttgggaaggagcagaacaagtgaaacacagaaaactgaagagaagaaatcctcattttggacctatatttctccttgactatttcttaatatccatcctacccatcgttctaatgttttaactttgctctgaatttataaatagtaaaggccaaagacatagaatatacatttagtagctttataccaagaaatttgccttgaaagctgctgttcgtggagggaaaagtgtagcaaattcctgtctatttttattttttatttttttttaacaaagacaagatttatgtccctagattttgaaggttaaggcaaatataaatacatatctgcacactattttttagcagttgcatgagtaagagtaatgagatttgtattttaaggactttgtcatgtggatgttttggagttgactgctcagatcttttatagggctttaatatttttgatctattaccttgatgacattatttgtccacacttgagcccatctgtctttctagctatgaccttgttatgaacagtatttgcactcggtgcaaatatccatgtcttacctaattaagcaacatcatagtgccataactcaaggaagttgaatgaggtgaacatagatacagctctttccccttccccccctttttaaatgtaacaaatactttttatgttccccttccccccttccccttttcccctttccccttttggaaacgtgtcaggaaccaaatagtttaagatgagcagttgaggggactgagagagtgatcgacacagaacctggcttcttcgtgcttcatcataagtcgtgctgccggccaggttacttaagcacccttttaacaaggaaaccttgtgggagatccagctggccgactcgagttcagaaacaggaccacagaggttacactctgggatcctggccatgaggttggatgcctcaccttactgaaaggagacactggacctaaatggcgcagcatgattttgttcctgcttggctaaatttctcaacaccacagtcagctaagtcacctactgccaccttcgaaaaacacggagagcacctacccagaggagaaggtagatttggagtaagccgccgtcgacataattcctctgatggtttttttaacaatggtcccctacgaactgcaggagattcttggcaccagccctccctgttccgccatgattctgtggactctggtgtctctaagggagcatatgctggaatcacagggaacccatctggttggcatagctcttcccgaggtcatgatggcatgagccaacgtagtggaggtggcacagggaaccatcgccattggaatggcagcttccactcccggaaagggtgtgcttttcaggaaaagccacctatggagattagggaagaaaagaaagaagacaaggtggaaaagttgcagtttgaagaggaggactttccttccttgaatccagaagctggcaaacagcatcagccatgcagacctattgggacaccttctggagtatgggaaaacccgcctagtgccaagcaaccctccaagatgctagttatcaaaaaagtttccaaagaggatcctgctgctgccttctctgctgcattcacctcaccaggatctcaccatgcaaatgggaacaaattgtcatccgtggttccaagtgtctataagaacctggttcctaagcctgtaccacctccttccaagcctaatgcatggaaagctaacaggatggagcacaagtcaggatccctttcctctagccgggagtctgcttttaccagtccaatctctgttaccaaaccagtggtactggctagtggtgcagctctgagttctcccaaagagagtccctccagcaccacccctccaattgagatcagctcctctcgtctgaccaagttgacccgccgaaccaccgacaggaagagtgagttcctgaaaactctgaaggatgaccggaatggagacttctcagagaatagagactgtgacaagctggaagatttggaggacaacagcacacctgaaccaaaggaaaatggggaggaaggctgtcatcaaaatggtcttgccctccctgtagtggaagaaggggaggttctctcacactctctagaagcagagcacaggttattgaaagctatgggttggcaggaatatcctgaaaatgatgagaattgccttcccctcacagaggatgagctcaaagagttccacatgaagacagagcagctgagaagaaatggctttggaaagaatggcttcttgcagagccgcagttccagtctgttctccccttggagaagcacttgcaaagcagagtttgaggactcagacaccgaaaccagtagcagtgaaacatcagatgacgatgcctggaagtaggcatataaatgctcacagttaaatctgacccagtaaactctgtgtgtttagggagtatacaaaagaaatcgttcttttccttttcttatgttgttgaatacttcattcacaagggaaataatcatatcccaaagagagagcaattggcttgttttgcttttgttattgttcttccctgttatctgctttatagagagaagtttgtgtggtgggacagattttttaaacacactcacacacacacacacatacacacccagtatatatggggcgatgcacaggtaggagctggcagtgcagggaagaggagacactggtctgcagcaacagcttctactaccagcccttggggcactcacccctgtgatcaagcaatcattgtcaatgacaaagtgactattgaagttataattgtattaaattaatgctaataatttggatattttattttatttttggctgctcgggtaactttagcccttaaccaagcatatgtgggtttttttggttgtttttttttgttttttttttctttttcctttttgggtacagctgtaaaatatttggatataggaaatgttgtgttattcttgcagccttgatattcagggtggattgtaaaatataaatttttgtgagatttcaaagattaagattattttgataacattatttacagatttaaaagatgtggttatcacaagtctcgagggggaaactactgcataaaataactaacttggaataaatattttgcatcagtttg

SEQ ID NO: 63487 - DNA, 3385 bp, Homo sapiens
ggtagcgcggccgacgcagcgcgcgcagcctccggggccaggccgtgtggcccgctggggactggagtctcaacgacgcgcacacgagaagtaaggaagtgatagattcgtgtggcctttcaaatgattgtgaagtggtggaaatggatccaaaataataagtgacttctctaccaaagcatagaagattcttcatatctccttccagtggctcaatttagattttgggaaggagcagaacaagtgaaacacagaaaactgaagagaagaaatcctcattttggacctatatttctccttgactatttcttaatatccatcctacccatcgttctaatgttttaactttgctctgaatttataaatagtaaaggccaaagacatagaatatacatttagtagctttataccaagaaatttgccttgaaagctgctgttcgtggagggaaaagtgtagcaaattcctgtctatttttattttttatttttttttaacaaagacaagatttatgtccctagattttgaaggttaaggcaaatataaatacatatctgcacactattttttagcagttgcatgagtaagagtaatgagatttgtattttaaggactttgtcatgtggatgttttggagttgactgctcagatcttttatagggctttaatatttttgatctattaccttgatgacattatttgtccacacttgagcccatctgtctttctagctatgaccttgttatgaacagtatttgcactcggtgcaaatatccatgtcttacctaattaagcaacatcatagtgccataactcaaggaagttgaatgaggtgaacatagatacagctctttccccttccccccctttttaaatgtaacaaatactttttatgttccccttccccccttccccttttcccctttccccttttggaaacgtgtcaggaaccaaatagtttaagatgagcagttgaggggactgagagagtgatcgacacagaacctggcttcttcgtgcttcatcataagtcgtgctgccggccaggttacttaagcacccttttaacaaggaaaccttgtgggagatccagctggccgactcgagttcagaaacaggaccacagaggttacactctgggatcctggccatgaggttggatgcctcaccttactgaaaggagacactggacctaaatggcgcagcatgattttgttcctgcttggctaaatttctcaacaccacagtcagctaagtcacctactgccaccttcgaaaaacacggagagcacctacccagaggagaaggtagatttggagtaagccgccgtcgacataattcctctgatggtttttttaacaatggtcccctacgaactgcaggagattcttggcaccagccctccctgttccgccatgattctgtggactctggtgtctctaagggagcatatgctggaatcacagggaacccatctggttggcatagctcttcccgaggtcatgatggcatgagccaacgtagtggaggtggcacagggaaccatcgccattggaatggcagcttccactcccggaaagggtgtgcttttcaggaaaagccacctatggagattagggaagaaaagaaagaagacaaggtggaaaagttgcagtttgaagaggaggactttccttccttgaatccagaagctggcaaacagcatcagccatgcagacctattgggacaccttctggagtatgggaaaacccgcctagtgccaagcaaccctccaagatgctagttatcaaaaaagtttccaaagaggatcctgctgctgccttctctgctgcattcacctcaccaggatctcaccatgcaaatgggaacaaattgtcatccgtggttccaagtgtctataagaacctggttcctaagcctgtaccacctccttccaagcctaatgcatggaaagctaacaggatggagcacaagtcaggatccctttcctctagccgggagtctgcttttaccagtccaatctctgttaccaaaccagtggtactggctagtggtgcagctctgagttctcccaaagagagtccctccagcaccacccctccaattgagatcagctcctctcgtctgaccaagttgacccgccgaaccaccgacaggaagagtgagttcctgaaaactctgaaggatgaccggaatggagacttctcagagaatagagactgtgacaagctggaagatttggaggacaacagcacacctgaaccaaaggaaaatggggaggaaggctgtcatcaaaatggtcttgccctccctgtagtggaagaaggggaggttctctcacactctctagaagcagagcacaggttattgaaagctatgggttggcaggaatatcctgaaaatgatgagaattgccttcccctcacagaggatgagctcaaagagttccacatgaagacagagcagctgagaagaaatggctttggaaagaatggcttcttgcagagccgcagttccagtctgttctccccttggagaagcacttgcaaagcagagtttgaggactcagacaccgaaaccagtagcagtgaaacatcagatgacgatgcctggaagtaggcatataaatgctcacagttaaatctgacccagtaaactctgtgtgtttagggagtatacaaaagaaatcgttcttttccttttcttatgttgttgaatacttcattcacaagggaaataatcatatcccaaagagagagcaattggcttgttttgcttttgttattgttcttccctgttatctgctttatagagagaagtttgtgtggtgggacagattttttaaacacactcacacacacacacacatacacacccagtatatatggggcgatgcacaggtaggagctggcagtgcagggaagaggagacactggtctgcagcaacagcttctactaccagcccttggggcactcacccctgtgatcaagcaatcattgtcaatgacaaagtgactattgaagttataattgtattaaattaatgctaataatttggatattttattttatttttggctgctcgggtaactttagcccttaaccaagcatatgtgggtttttttggttgtttttttttgttttttttttctttttcctttttgggtacagctgtaaaatatttggatataggaaatgttgtgttattcttgcagccttgatattcagggtggattgtaaaatataaatttttgtgagatttcaaagattaagattattttgataacattatttacagatttaaaagatgtggttatcacaagtctcgagggggaaactactgcataaaataactaacttggaataaatattttgcatcagtttg

SEQ ID NO: 63488 - DNA, 3425 bp, Homo sapiens
acctgcgctaattggttcctaggcccggctttctgtttgggggccattcttaatttctagttgaatccagatgttgaacggtccttgaagttctattccagggctcccaggcagcagaatctgcccacagagttcggagtgatagattcgtgtggcctttcaaatgattgtgaagtggtggaaatggatccaaaataataagtgacttctctaccaaagcatagaagattcttcatatctccttccagtggctcaatttagattttgggaaggagcagaacaagtgaaacacagaaaactgaagagaagaaatcctcattttggacctatatttctccttgactatttcttaatatccatcctacccatcgttctaatgttttaactttgctctgaatttataaatagtaaaggccaaagacatagaatatacatttagtagctttataccaagaaatttgccttgaaagctgctgttcgtggagggaaaagtgtagcaaattcctgtctatttttattttttatttttttttaacaaagacaagatttatgtccctagattttgaaggttaaggcaaatataaatacatatctgcacactattttttagcagttgcatgagtaagagtaatgagatttgtattttaaggactttgtcatgtggatgttttggagttgactgctcagatcttttatagggctttaatatttttgatctattaccttgatgacattatttgtccacacttgagcccatctgtctttctagctatgaccttgttatgaacagtatttgcactcggtgcaaatatccatgtcttacctaattaagcaacatcatagtgccataactcaaggaagttgaatgaggtgaacatagatacagctctttccccttccccccctttttaaatgtaacaaatactttttatgttccccttccccccttccccttttcccctttccccttttggaaacgtgtcaggaaccaaatagtttaagatgagcagttgaggggactgagagagtgatcgacacagaacctggcttcttcgtgcttcatcataagtcgtgctgccggccaggttacttaagcacccttttaacaaggaaaccttgtgggagatccagctggccgactcgagttcagaaacaggaccacagaggttacactctgggatcctggccatgaggttggatgcctcaccttactgaaaggagacactggacctaaatggcgcagcatgattttgttcctgcttggctaaatttctcaacaccacagtcagctaagtcacctactgccaccttcgaaaaacacggagagcacctacccagaggagaaggtagatttggagtaagccgccgtcgacataattcctctgatggtttttttaacaatggtcccctacgaactgcaggagattcttggcaccagccctccctgttccgccatgattctgtggactctggtgtctctaagggagcatatgctggaatcacagggaacccatctggttggcatagctcttcccgaggtcatgatggcatgagccaacgtagtggaggtggcacagggaaccatcgccattggaatggcagcttccactcccggaaagggtgtgcttttcaggaaaagccacctatggagattagggaagaaaagaaagaagacaaggtggaaaagttgcagtttgaagaggaggactttccttccttgaatccagaagctggcaaacagcatcagccatgcagacctattgggacaccttctggagtatgggaaaacccgcctagtgccaagcaaccctccaagatgctagttatcaaaaaagtttccaaagaggatcctgctgctgccttctctgctgcattcacctcaccaggatctcaccatgcaaatgggaacaaattgtcatccgtggttccaagtgtctataagaacctggttcctaagcctgtaccacctccttccaagcctaatgcatggaaagctaacaggatggagcacaagtcaggatccctttcctctagccgggagtctgcttttaccagtccaatctctgttaccaaaccagtggtactggctagtggtgcagctctgagttctcccaaagagagtccctccagcaccacccctccaattgagatcagctcctctcgtctgaccaagttgacccgccgaaccaccgacaggaagagtgagttcctgaaaactctgaaggatgaccggaatggagacttctcagagaatagagactgtgacaagctggaagatttggaggacaacagcacacctgaaccaaaggaaaatggggaggaaggctgtcatcaaaatggtcttgccctccctgtagtggaagaaggggaggttctctcacactctctagaagcagagcacaggttattgaaagctatgggttggcaggaatatcctgaaaatgatgagaattgccttcccctcacagaggatgagctcaaagagttccacatgaagacagagcagctgagaagaaatggctttggaaagaatggcttcttgcagagccgcagttccagtctgttctccccttggagaagcacttgcaaagcagagtttgaggactcagacaccgaaaccagtagcagtgaaacatcagatgacgatgcctggaagtaggcatataaatgctcacagttaaatctgacccagtaaactctgtgtgtttagggagtatacaaaagaaatcgttcttttccttttcttatgttgttgaatacttcattcacaagggaaataatcatatcccaaagagagagcaattggcttgttttgcttttgttattgttcttccctgttatctgctttatagagagaagtttgtgtggtgggacagattttttaaacacactcacacacacacacacatacacacccagtatatatggggcgatgcacaggtaggagctggcagtgcagggaagaggagacactggtctgcagcaacagcttctactaccagcccttggggcactcacccctgtgatcaagcaatcattgtcaatgacaaagtgactattgaagttataattgtattaaattaatgctaataatttggatattttattttatttttggctgctcgggtaactttagcccttaaccaagcatatgtgggtttttttggttgtttttttttgttttttttttctttttcctttttgggtacagctgtaaaatatttggatataggaaatgttgtgttattcttgcagccttgatattcagggtggattgtaaaatataaatttttgtgagatttcaaagattaagattattttgataacattatttacagatttaaaagatgtggttatcacaagtctcgagggggaaactactgcataaaataactaacttggaataaatattttgcatcagtttg

SEQ ID NO: 63489 - DNA, 3369 bp, Homo sapiens
cgagtatgggctatcgtcgacccacgccgtcgctttgttatggttgtggactagccgcctctgccgggtcgacaagctggggacgcgtcctcagacgcagcgtctagtccctggccatagctccgccgctgcccgagtgatagattcgtgtggcctttcaaatgattgtgaagtggtggaaatggatcccagtggctcaatttagattttgggaaggagcagaacaagtgaaacacagaaaactgaagagaagaaatcctcattttggacctatatttctccttgactatttcttaatatccatcctacccatcgttctaatgttttaactttgctctgaatttataaatagtaaaggccaaagacatagaatatacatttagtagctttataccaagaaatttgccttgaaagctgctgttcgtggagggaaaagtgtagcaaattcctgtctatttttattttttatttttttttaacaaagacaagatttatgtccctagattttgaaggttaaggcaaatataaatacatatctgcacactattttttagcagttgcatgagtaagagtaatgagatttgtattttaaggactttgtcatgtggatgttttggagttgactgctcagatcttttatagggctttaatatttttgatctattaccttgatgacattatttgtccacacttgagcccatctgtctttctagctatgaccttgttatgaacagtatttgcactcggtgcaaatatccatgtcttacctaattaagcaacatcatagtgccataactcaaggaagttgaatgaggtgaacatagatacagctctttccccttccccccctttttaaatgtaacaaatactttttatgttccccttccccccttccccttttcccctttccccttttggaaacgtgtcaggaaccaaatagtttaagatgagcagttgaggggactgagagagtgatcgacacagaacctggcttcttcgtgcttcatcataagtcgtgctgccggccaggttacttaagcacccttttaacaaggaaaccttgtgggagatccagctggccgactcgagttcagaaacaggaccacagaggttacactctgggatcctggccatgaggttggatgcctcaccttactgaaaggagacactggacctaaatggcgcagcatgattttgttcctgcttggctaaatttctcaacaccacagtcagctaagtcacctactgccaccttcgaaaaacacggagagcacctacccagaggagaaggtagatttggagtaagccgccgtcgacataattcctctgatggtttttttaacaatggtcccctacgaactgcaggagattcttggcaccagccctccctgttccgccatgattctgtggactctggtgtctctaagggagcatatgctggaatcacagggaacccatctggttggcatagctcttcccgaggtcatgatggcatgagccaacgtagtggaggtggcacagggaaccatcgccattggaatggcagcttccactcccggaaagggtgtgcttttcaggaaaagccacctatggagattagggaagaaaagaaagaagacaaggtggaaaagttgcagtttgaagaggaggactttccttccttgaatccagaagctggcaaacagcatcagccatgcagacctattgggacaccttctggagtatgggaaaacccgcctagtgccaagcaaccctccaagatgctagttatcaaaaaagtttccaaagaggatcctgctgctgccttctctgctgcattcacctcaccaggatctcaccatgcaaatgggaacaaattgtcatccgtggttccaagtgtctataagaacctggttcctaagcctgtaccacctccttccaagcctaatgcatggaaagctaacaggatggagcacaagtcaggatccctttcctctagccgggagtctgcttttaccagtccaatctctgttaccaaaccagtggtactggctagtggtgcagctctgagttctcccaaagagagtccctccagcaccacccctccaattgagatcagctcctctcgtctgaccaagttgacccgccgaaccaccgacaggaagagtgagttcctgaaaactctgaaggatgaccggaatggagacttctcagagaatagagactgtgacaagctggaagatttggaggacaacagcacacctgaaccaaaggaaaatggggaggaaggctgtcatcaaaatggtcttgccctccctgtagtggaagaaggggaggttctctcacactctctagaagcagagcacaggttattgaaagctatgggttggcaggaatatcctgaaaatgatgagaattgccttcccctcacagaggatgagctcaaagagttccacatgaagacagagcagctgagaagaaatggctttggaaagaatggcttcttgcagagccgcagttccagtctgttctccccttggagaagcacttgcaaagcagagtttgaggactcagacaccgaaaccagtagcagtgaaacatcagatgacgatgcctggaagtaggcatataaatgctcacagttaaatctgacccagtaaactctgtgtgtttagggagtatacaaaagaaatcgttcttttccttttcttatgttgttgaatacttcattcacaagggaaataatcatatcccaaagagagagcaattggcttgttttgcttttgttattgttcttccctgttatctgctttatagagagaagtttgtgtggtgggacagattttttaaacacactcacacacacacacacatacacacccagtatatatggggcgatgcacaggtaggagctggcagtgcagggaagaggagacactggtctgcagcaacagcttctactaccagcccttggggcactcacccctgtgatcaagcaatcattgtcaatgacaaagtgactattgaagttataattgtattaaattaatgctaataatttggatattttattttatttttggctgctcgggtaactttagcccttaaccaagcatatgtgggtttttttggttgtttttttttgttttttttttctttttcctttttgggtacagctgtaaaatatttggatataggaaatgttgtgttattcttgcagccttgatattcagggtggattgtaaaatataaatttttgtgagatttcaaagattaagattattttgataacattatttacagatttaaaagatgtggttatcacaagtctcgagggggaaactactgcataaaataactaacttggaataaatattttgcatcagtttg

SEQ ID NO: 63490 - DNA, 3603 bp, Homo sapiens
cgagtatgggctatcgtcgacccacgccgtcgctttgttatggttgtggactagccgcctctgccgggtcgacaagctggggacgcgtcctcagacgcagcgtctagtccctggccatagctccgccgctgcccgttggtgtctcacctttaactctccttatgctgggtgaaaacaaagagtgatagattcgtgtggcctttcaaatgattgtgaagtggtggaaatggatccaaaataataagtgacttctctaccaaagcatagaagattcttcatatctccttccagtggctcaatttagattttgggaaggagcagaacaagtgaaacacagaaaactgaagagaagaaatcctcattttggacctatatttctccttgactatttcttaatatccatcctacccatcgttctaatgttttaactttgctctgaatttataaatagtaaaggccaaagacatagaatatacatttagtagctttataccaagaaatttgccttgaaagctgctgttcgtggagggaaaagtgtagcaaattcctgtctatttttattttttatttttttttaacaaagacaagatttatgtccctagattttgaaggttaaggcaaatataaatacatatctgcacactattttttagcagttgcatgagtaagagtaatgagatttgtattttaaggactttgtcatgtggatgttttggagttgactgctcagatcttttatagggctttaatatttttgatctattaccttgatgacattatttgtccacacttgagcccatctgtctttctagctatgaccttgttatgaacagtatttgcactcggtgcaaatatccatgtcttacctaattaagcaacatcatagtgccataactcaaggaagttgaatgaggtgaacatagatacagctctttccccttccccccctttttaaatgtaacaaatactttttatgttccccttccccccttccccttttcccctttccccttttggaaacgtgtcaggaaccaaatagtttaagatgagcagttgaggggactgagagagtgatcgacacagaacctggcttcttcgtgcttcatcataagtcgtgctgccggccaggttacttaagcacccttttaacaaggaaaccttgtgggagatccagctggccgactcgagttcagaaacaggaccacagaggttacactctgggatcctggccatgaggttggatgcctcaccttactgaaaggagacactggacctaaatggcgcagcatgattttgttcctgcttggctaaatttctcaacaccacagtcagctaagtcacctactgccaccttcgaaaaacacggagagcacctacccagaggagaaggtagatttggagtaagccgccgtcgacataattcctctgatggtttttttaacaatggtcccctacgaactgcaggagattcttggcaccagccctccctgttccgccatgattctgtggactctggtgtctctaagggagcatatgctggaatcacagggaacccatctggttggcatagctcttcccgaggtcatgatggcatgagccaacgtagtggaggtggcacagggaaccatcgccattggaatggcagcttccactcccggaaagggtgtgcttttcaggaaaagccacctatggagattagggaagaaaagaaagaagacaaggtggaaaagttgcagtttgaagaggaggactttccttccttgaatccagaagctggcaaacagcatcagccatgcagacctattgggacaccttctggagtatgggaaaacccgcctagtgccaagcaaccctccaagatgctagttatcaaaaaagtttccaaagaggatcctgctgctgccttctctgctgcattcacctcaccaggatctcaccatgcaaatgggaacaaattgtcatccgtggttccaagtgtctataagaacctggttcctaagcctgtaccacctccttccaagcctaatgcatggaaagctaacaggatggagcacaagtcaggatccctttcctctagccgggagtctgcttttaccagtccaatctctgttaccaaaccagtggtactggctagtggtgcagctctgagttctcccaaagagagtccctccagcaccacccctccaattgagatcagctcctctcgtctgaccaagttgacccgccgaaccaccgacaggaagagtgagttcctgaaaactctgaaggatgaccggaatggagacttctcagagaatagagactgtgacaagctggaagatttggaggacaacagcacacctgaaccaaaggaaaatggggaggaaggctgtcatcaaaatggtcttgccctccctgtagtggaagaaggggaggttctctcacactctctagaagcagagcacaggttattgaaagctatgggttggcaggaatatcctgaaaatgatgagaattgccttcccctcacagaggatgagctcaaagagttccacatgaagacagagcagctgagaagaaatggctttggaaagaatggcttcttgcagagccgcagttccagtctgttctccccttggagaagcacttgcaaagcagagtttgaggactcagacaccgaaaccagtagcagtgaaacatcagatgacgatgcctggaagtaggcatataaatgctcacagttaaatctgacccagtaaactctgtgtgtttagggagtatacaaaagaaatcgttcttttccttttcttatgttgttgaatacttcattcacaagggaaataatcatatcccaaagagagagcaattggcttgttttgcttttgttattgttcttccctgttatctgctttatagagagaagtttgtgtggtgggacagattttttaaacacactcacacacacacacacatacacacccagtatatatggggcgatgcacaggtaggagctggcagtgcagggaagaggagacactggtctgcagcaacagcttctactaccagcccttggggcactcacccctgtgatcaagcaatcattgtcaatgacaaattttatttttggctgctcgggtaactttagcccttaaccaagcatatgtgggtttttttggttgtttttttttgttttttttttctttttcctttttgggtacagctgtaaaatatttggatataggaaatgttgtgttattcttgcagccttgatattcagggtggattgtaaaatataaatttttgtgagatttcaaagattaagattattttgataacattatttacagatttaaaagatgtggttatcacaagtctcgagggggaaactactgcataaaataactaacttggaataaatattttgcatcagtttggattgtcttgtgtaagaagtatattttctttaaaattagatgagtggattcttttttaggggaaatatttttagaagttggggggaaatgtgaattcagacacaactgtttctctattttagcagatacttttttgatgcagaaaaacctgtgcaataaattaccagtaataaagtcagaaaccaagata

SEQ ID NO: 63491 - DNA, 3535 bp, Homo sapiens
cgagtatgggctatcgtcgacccacgccgtcgctttgttatggttgtggactagccgcctctgccgggtcgacaagctggggacgcgtcctcagacgcagcgtctagtccctggccatagctccgccgctgcccgttggtgtctcacctttaactctccttatgctgggtgaaaacaaagagtgatagattcgtgtggcctttcaaatgattgtgaagtggtggaaatggatccaaaataataagtgacttctctaccaaagcatagaagattcttcatatctccttccagtggctcaatttagattttgggaaggagcagaacaagtgaaacacagaaaactgaagagaagaaatcctcattttggacctatatttctccttgactatttcttaatatccatcctacccatcgttctaatgttttaactttgctctgaatttataaatagtaaaggccaaagacatagaatatacatttagtagctttataccaagaaatttgccttgaaagctgctgttcgtggagggaaaagtgtagcaaattcctgtctatttttattttttatttttttttaacaaagacaagatttatgtccctagattttgaaggttaaggcaaatataaatacatatctgcacactattttttagcagttgcatgagtaagagtaatgagatttgtattttaaggactttgtcatgtggatgttttggagttgactgctcagatcttttatagggctttaatatttttgatctattaccttgatgacattatttgtccacacttgagcccatctgtctttctagctatgaccttgttatgaacagtatttgcactcggtgcaaatatccatgtcttacctaattaagcaacatcatagtgccataactcaaggaagttgaatgaggtgaacatagatacagctctttccccttccccccctttttaaatgtaacaaatactttttatgttccccttccccccttccccttttcccctttccccttttggaaacgtgtcaggaaccaaatagtttaagatgagcagttgaggggactgagagagtgatcgacacagaacctggcttcttcgtgcttcatcataagtcgtgctgccggccaggttacttaagcacccttttaacaaggaaaccttgtgggagatccagctggccgactcgagttcagaaacaggaccacagaggttacactctgggatcctggccatgaggttggatgcctcaccttactgaaaggagacactggacctaaatggcgcagcatgattttgttcctgcttggctaaatttctcaacaccacagtcagctaagtcacctactgccaccttcgaaaaacacggagagcacctacccagaggagaaggtagatttggagtaagccgccgtcgacataattcctctgatggtttttttaacaatggtcccctacgaactgcaggagattcttggcaccagccctccctgttccgccatgattctgtggactctggtgtctctaagggagcatatgctggaatcacagggaacccatctggttggcatagctcttcccgaggtcatgatggcatgagccaacgtagtggaggtggcacagggaaccatcgccattggaatggcagcttccactcccggaaagggtgtgcttttcaggaaaagccacctatggagattagggaagaaaagaaagaagacaaggtggaaaagttgcagtttgaagaggaggactttccttccttgaatccagaagctggcaaacagcatcagccatgcagacctattgggacaccttctggagtatgggaaaacccgcctagtgccaagcaaccctccaagatgctagttatcaaaaaagtttccaaagaggatcctgctgctgccttctctgctgcattcacctcaccaggatctcaccatgcaaatgggaacaaattgtcatccgtggttccaagtgtctataagaacctggttcctaagcctgtaccacctccttccaagcctaatgcatggaaagctaacaggatggagcacaagtcaggatccctttcctctagccgggagtctgcttttaccagtccaatctctgttaccaaaccagtggtactggctagtggtgcagctctgagttctcccaaagagagtccctccagcaccacccctccaattgagatcagctcctctcgtctgaccaagttgacccgccgaaccaccgacaggaagagtgagttcctgaaaactctgaaggatgaccggaatggagacttctcagagaatagagactgtgacaagctggaagatttggaggacaacagcacacctgaaccaaaggaaaatggggaggaaggctgtcatcaaaatggtcttgccctccctgtagtggaagaaggggaggttctctcacactctctagaagcagagcacaggttattgaaagctatgggttggcaggaatatcctgaaaatgatgagaattgccttcccctcacagaggatgagctcaaagagttccacatgaagacagagcagctgagaagaaatggctttggaaagaatggcttcttgcagagccgcagttccagtctgttctccccttggagaagcacttgcaaagcagagtttgaggactcagacaccgaaaccagtagcagtgaaacatcagatgacgatgcctggaagtaggcatataaatgctcacagttaaatctgacccagtaaactctgtgtgtttagggagtatacaaaagaaatcgttcttttccttttcttatgttgttgaatacttcattcacaagggaaataatcatatcccaaagagagagcaattggcttgttttgcttttgttattgttcttccctgttatctgctttatagagagaagtttgtgtggtgggacagattttttaaacacactcacacacacacacacatacacacccagtatatatggggcgatgcacaggtaggagctggcagtgcagggaagaggagacactggtctgcagcaacagcttctactaccagcccttggggcactcacccctgtgatcaagcaatcattgtcaatgacaaagtgactattgaagttataattgtattaaattaatgctaataatttggatattttattttatttttggctgctcgggtaactttagcccttaaccaagcatatgtgggtttttttggttgtttttttttgttttttttttctttttcctttttgggtacagctgtaaaatatttggatataggaaatgttatattttacaatccaccctgaatatcaaggctgcaagaataacacaacatttcctatatccaaatatgtgttattcttgcagccttgatattcagggtggattgtaaaatataaatttttgtgagatttcaaagattaagattattttgataacattatttacagatttaaaagatgtggttatcacaagtctcgagggggaaactactgcataaaataactaacttggaataaatattttgcatcagtttg

SEQ ID NO: 63492 - DNA, 2721 bp, Homo sapiens
gactatggaattgatctcctaatggtctcttagttgatgtttaaatacctcagatccatcctttaagctgctactagagtgacggttgtaagttgataattagataatgttaactgcatgaaagatggatcctcattacctgtagaataaaacttaatctcccctaagaaatcctccacaagctggctcttgcctgctttgccagatacctctttccccacagaagggtcccctccttccctagcactactcatgctgaactatttgcagacctgaatattctgttctttttaatgctttctgttcctggaattaccgtttttccagctttggaattcatctttaaggattcttaaatcacctgttagtaaagccttttctgatagcacttctctttcaagtagaattgatgtttcttactgagtactccttcttccctaatatgaatttttttcatcgtccttgtaaccttttattgtacttaacttgtctagaagtttttatagcaaaactgtgacccgtgtgaagacaggggctctttattgtatttctagcacagtccttggcatatggtctgcccctgccctacacccatcttagaaatgcagtgaatactatacatttcactgaccacattgtcctcctttaatctgaggaaaatgatccacattcttgttcatctaactttcagtgcctccttatttggcatacatatcctataggaaagtgggaattcgcacatttagtctgtttatttaaaataaatgaaatcccttatatcaaaggaaatgaaactcaggagaacctaatattaacataatacctattgattttgtgttttgatattttctgtttgttacgtttctgaatacagtgtcaaattagtaagtgttgctaatatgtaaaatatgtaattatttgataggttccatggtgatggctactttgtgaaaagtgccaaaatgatcagctttctgtatcaaccattcatatcccttttttcctagccttccttgaatccagaagctggcaaacagcatcagccatgcagacctattgggacaccttctggagtatgggaaaacccgcctagtgccaagcaaccctccaagatgctagttatcaaaaaagtttccaaagaggatcctgctgctgccttctctgctgcattcacctcaccaggatctcaccatgcaaatgggaacaaattgtcatccgtggttccaagtgtctataagaacctggttcctaagcctgtaccacctccttccaagcctaatgcatggaaagctaacaggatggagcacaagtcaggatccctttcctctagccgggagtctgcttttaccagtccaatctctgttaccaaaccagtggtactggctagtggtgcagctctgagttctcccaaagagagtccctccagcaccacccctccaattgagatcagctcctctcgtctgaccaagttgacccgccgaaccaccgacaggaagagtgagttcctgaaaactctgaaggatgaccggaatggagacttctcagagaatagagactgtgacaagctggaagatttggaggacaacagcacacctgaaccaaaggaaaatggggaggaaggctgtcatcaaaatggtcttgccctccctgtagtggaagaaggggaggttctctcacactctctagaagcagagcacaggttattgaaagctatgggttggcaggaatatcctgaaaatgatgagaattgccttcccctcacagaggatgagctcaaagagttccacatgaagacagagcagctgagaagaaatggctttggaaagaatggcttcttgcagagccgcagttccagtctgttctccccttggagaagcacttgcaaagcagagtttgaggactcagacaccgaaaccagtagcagtgaaacatcagatgacgatgcctggaagtaggcatataaatgctcacagttaaatctgacccagtaaactctgtgtgtttagggagtatacaaaagaaatcgttcttttccttttcttatgttgttgaatacttcattcacaagggaaataatcatatcccaaagagagagcaattggcttgttttgcttttgttattgttcttccctgttatctgctttatagagagaagtttgtgtggtgggacagattttttaaacacactcacacacacacacacatacacacccagtatatatggggcgatgcacaggtaggagctggcagtgcagggaagaggagacactggtctgcagcaacagcttctactaccagcccttggggcactcacccctgtgatcaagcaatcattgtcaatgacaaagtgactattgaagttataattgtattaaattaatgctaataatttggatattttattttatttttggctgctcgggtaactttagcccttaaccaagcatatgtgggtttttttggttgtttttttttgttttttttttctttttcctttttgggtacagctgtaaaatatttggatataggaaatgttgtgttattcttgcagccttgatattcagggtggattgtaaaatataaatttttgtgagatttcaaagattaagattattttgataacattatttacagatttaaaagatgtggttatcacaagtctcgagggggaaactactgcataaaataactaacttggaataaatattttgcatcagtttg

SEQ ID NO: 63493 - DNA, 2559 bp, Homo sapiens
cgagtatgggctatcgtcgacccacgccgtcgctttgttatggttgtggactagccgcctctgccgggtcgacaagctggggacgcgtcctcagacgcagcgtctagtccctggccatagctccgccgctgcccgttggtgtctcacctttaactctccttatgctgggtgaaaacaaagagtgatagattcgtgtggcctttcaaatgattgtgaagtggtggaaatggatccaaaataataagtgacttctctaccaaagcatagaagattcttcatatctccttccagtggctcaatttagattttgggaaggagcagaacaagtgaaacacagaaaactgaagagaagaaatcctcattttggacctatatttctccttgactatttcttaatatccatcctacccatcgttctaatgttttaactttgctctgaatttataaatagtaaaggccaaagacatagaatatacatttagtagctttataccaagaaatttgccttgaaagctgctgttcgtggagggaaaagtgtagcaaattcctgtctatttttattttttatttttttttaacaaagacaagatttatgtccctagattttgaaggttaaggcaaatataaatacatatctgcacactattttttagcagttgcatgagtaagagtaatgagatttgtattttaaggactttgtcatgtggatgttttggagttgactgctcagatcttttatagggctttaatatttttgatctattaccttgatgacattatttgtccacacttgagcccatctgtctttctagctatgaccttgttatgaacagtatttgcactcggtgcaaatatccatgtcttacctaattaagcaacatcatagtgccataactcaaggaagttgaatgaggtgaacatagatacagctctttccccttccccccctttttaaatgtaacaaatactttttatgttccccttccccccttccccttttcccctttccccttttggaaacgtgtcaggaaccaaatagtttaagatgagcagttgaggggactgagagagtgatcgacacagaacctggcttcttcgtgcttcatcataagtcgtgctgccggccaggttacttaagcacccttttaacaaggaaaccttgtgggagatccagctggccgactcgagttcagaaacaggaccacagaggttacactctgggatcctggccatgaggttggatgcctcaccttactgaaaggagacactggacctaaatggcgcagcatgattttgttcctgcttggctaaatttctcaacaccacagtcagctaagtcacctactgccaccttcgaaaaacacggagagcacctacccagaggagaaggtagatttggagtaagccgccgtcgacataattcctctgatggtttttttaacaatggtcccctacgaactgcaggagaaaatggtcttgccctccctgtagtggaagaaggggaggttctctcacactctctagaagcagagcacaggttattgaaagctatgggttggcaggaatatcctgaaaatgatgagaattgccttcccctcacagaggatgagctcaaagagttccacatgaagacagagcagctgagaagaaatggctttggaaagaatggcttcttgcagagccgcagttccagtctgttctccccttggagaagcacttgcaaagcagagtttgaggactcagacaccgaaaccagtagcagtgaaacatcagatgacgatgcctggaagtaggcatataaatgctcacagttaaatctgacccagtaaactctgtgtgtttagggagtatacaaaagaaatcgttcttttccttttcttatgttgttgaatacttcattcacaagggaaataatcatatcccaaagagagagcaattggcttgttttgcttttgttattgttcttccctgttatctgctttatagagagaagtttgtgtggtgggacagattttttaaacacactcacacacacacacacatacacacccagtatatatggggcgatgcacaggtaggagctggcagtgcagggaagaggagacactggtctgcagcaacagcttctactaccagcccttggggcactcacccctgtgatcaagcaatcattgtcaatgacaaagtgactattgaagttataattgtattaaattaatgctaataatttggatattttattttatttttggctgctcgggtaactttagcccttaaccaagcatatgtgggtttttttggttgtttttttttgttttttttttctttttcctttttgggtacagctgtaaaatatttggatataggaaatgttgtgttattcttgcagccttgatattcagggtggattgtaaaatataaatttttgtgagatttcaaagattaagattattttgataacattatttacagatttaaaagatgtggttatcacaagtctcgagggggaaactactgcataaaataactaacttggaataaatattttgcatcagtttg

SEQ ID NO: 63494 - DNA, 1896 bp, Homo sapiens
cgagtatgggctatcgtcgacccacgccgtcgctttgttatggttgtggactagccgcctctgccgggtcgacaagctggggacgcgtcctcagacgcagcgtctagtccctggccatagctccgccgctgcccgttggtgtctcacctttaactctccttatgctgggtgaaaacaaagagtgatagattcgtgtggcctttcaaatgattgtgaagtggtggaaatggatccaaaataataagtgacttctctaccaaagcatagaagattcttcatatctccttccagtggctcaatttagattttgggaaggagcagaacaagtgaaacacagaaaactgaagagaagaaatcctcattttggacctatatttctccttgactatttcttaatatccatcctacccatcgttctaatgttttaactttgctctgaatttataaatagtaaaggccaaagacatagaatatacatttagtagctttataccaagaaatttgccttgaaagctgctgttcgtggagggaaaagtgtagcaaattcctgtctatttttattttttatttttttttaacaaagacaagatttatgtccctagattttgaaggttaaggcaaatataaatacatatctgcacactattttttagcagttgcatgagtaagagtaatgagatttgtattttaaggactttgtcatgtggatgttttggagttgactgctcagatcttttatagggctttaatatttttgatctattaccttgatgacattatttgtccacacttgagcccatctgtctttctagctatgaccttgttatgaacagtatttgcactcggtgcaaatatccatgtcttacctaattaagcaacatcatagtgccataactcaaggaagttgaatgaggtgaacatagatacagctctttccccttccccccctttttaaatgtaacaaatactttttatgttccccttccccccttccccttttcccctttccccttttggaaacgtgtcaggaaccaaatagtttaagatgagcagttgaggggactgagagagtgatcgacacagaacctggcttcttcgtgcttcatcataagtcgtgctgccggccaggttacttaagcacccttttaacaaggaaaccttgtgggagatccagctggccgactcgagttcagaaacaggaccacagaggttacactctgggatcctggccatgaggttggatgcctcaccttactgaaaggagacactggacctaaatggcgcagcatgattttgttcctgcttggctaaatttctcaacaccacagtcagctaagtcacctactgccaccttcgaaaaacacggagagcacctacccagaggagaaggtagatttggagtaagccgccgtcgacataattcctctgatggtttttttaacaatggtcccctacgaactgcaggagattcttggcaccagccctccctgttccgccatgattctgtggactctggtgtctctaagggagcatatgctggaatcacagggaacccatctggttggcatagctcttcccgaggtcatgatggcatgagccaacgtagtggaggtggcacagggaaccatcgccattggaatggcagcttccactcccggaaagggtgtgcttttcaggaaaagccacctatggagattagggaagaaaagaaagaagacaaggtggaaaagttgcagtttgaagaggaggactttccttccttgaatccagaagctggcaaacagcatcagccatgcagacctattgggacaccttctggagtatgggaaaacccgcctagtgccaagcaccctccagatgctagtatcattcagtgaaaatcgggccaggtatctg

SEQ ID NO: 63495 - DNA, 1070 bp, Homo sapiens
  misc_feature (735)..(735): n is a, c, g, or t
  misc_feature (738)..(738): n is a, c, g, or t
  misc_feature (853)..(853): n is a, c, g, or t
acctgcgctaattggttcctaggcccggctttctgtttgggggccattcttaatttctagttgaatccagatgttgaacggtccttgaagttctattccagggctcccaggcagcagaatctgcccacagagttcgggtaagtagagtgcaagtactgaaacaatctcagaatgatggtggtgaaggaaggtaagagacgggattttaggcccagtgtgacctgaattgcttgccatctgtgggacttatgttttactttgcaaaacagggtttataaggcctatggggacacatctcactgcattagggccctttactatcatttagagggggaaaaaagcccagttcttacatccattttctttgctgggacctataaacttcattaagggttaaagagcacaagagcaggattttcacttccatgaaaggtgtggtgataagggccctaggcttgggggtggttcggaaagtcagatcatttctcctactgccctcggctttatttctcggctatgtgaccttgggcaagtcccttctcttatctagacttgtttcacaagggaaaatgggttacccgaaaagcgagagtggattagtgtcgtcgcatacgcgcggatctatattgtgagggtaacgtcgcaggagctattgtagctaagtgagatgaccgatgggggcaaacaacgagccggcccaaggtcacacttcgtaatgcactgcactggacttantangggtacgtactatggatccttgcatccgccgagtgcacgtacagcgagaatcagtctgtttactcagtcgaccagcgaattagtagcgcaacatgtagtagaggatcctatgcgncgctaatagttacgtgacaggcaggccttctgtaagtttcggatgcgtagagccgtgtgcgagattttctagtgtgcagatgcctcgtgctgcatggccaagcactcgcccgctcttcctcagttaacgtgcaagtactccaatatgagaatctgcaggtactgagaaagcggcagctgtcgccaagcagcaggcatatcccactggaatcccccgg

SEQ ID NO: 63496 - DNA, 324 bp, Homo sapiens
atcctggccatgaggttggatgcctcaccttactgaaaggagacactggacctaaatggcgcagcatgattttgttcctgcttggctaaatttctcaacaccacagtcagctaaggtactgttctccattcctgtagtaacttctcaaatatgagagggtttgggggtggttttggttgttttttggtttcattttgttttgagacagggtctccctctgtcacccaggatgaagtgcggtagtgtgatcacagcttactgcagctttggcctcctgggctcaggcagtcctcctgactcagctcccagagtagctgggcctac

SEQ ID NO: 63497 - DNA, 410 bp, Homo sapiens
gatcagctcctctcgtctgaccaagttgacccgccgaaccaccgacaggaagagtgagttcctgaaaactctgaaggatgaccggaatggagacttctcagagaatagagactgtgacaagctggaagatgtaagagcatccgccttttctgggggtagcctaggaattttcctttgatacatacgtgatttcttcttcttaaaggataaagatgtggcaagatttttaaatgtacagagatactgtctgtaggtgtaactgccttctagaccacatagtaaagtgagtttaatccttttttcagcaaaaatgttaaattcgggtttattttagtaatcactcacctattgaagtacatcttggttgcttccaagtgttggcaactatgaataaaactgcagtaaacatc

SEQ ID NO: 63498 - DNA, 269 bp, Homo sapiens
acgggggatgggagggccgtgctgctggtcgctcctcctcctccacccgctctgcccctcctggaccttgtgggccgggcagccattttgggaagagctttgttatggttgtggactagccgcctctgccgggtcgacaagctggggacgcgtcctcagacgcagcgtctagtccctggccatagctccgccgctgcccgttggtgtctcacctttaactctccttatgctggacctaactttgcgtgtgtgtgtgtagacaagatgaa

SEQ ID NO: 63499 - DNA, 3496 bp, Homo sapiens
ggtagcgcggccgacgcagcgcgcgcagcctccggggccaggccgtgtggcccgctggggactggagtctcaacgacgcgcacacgagaagtaaggagcggaaggtgggaaagggccggaaaacacacgttcctccgaaaccggtttgcaagtccttgtagagttggtgtctcacctttaactctccttatgctgggtgaaaacaaagagtgatagattcgtgtggcctttcaaatgattgtgaagtggtggaaatggatccaaaataataagtgacttctctaccaaagcatagaagattcttcatatctccttccagtggctcaatttagattttgggaaggagcagaacaagtgaaacacagaaaactgaagagaagaaatcctcattttggacctatatttctccttgactatttcttaatatccatcctacccatcgttctaatgttttaactttgctctgaatttataaatagtaaaggccaaagacatagaatatacatttagtagctttataccaagaaatttgccttgaaagctgctgttcgtggagggaaaagtgtagcaaattcctgtctatttttattttttatttttttttaacaaagacaagatttatgtccctagattttgaaggttaaggcaaatataaatacatatctgcacactattttttagcagttgcatgagtaagagtaatgagatttgtattttaaggactttgtcatgtggatgttttggagttgactgctcagatcttttatagggctttaatatttttgatctattaccttgatgacattatttgtccacacttgagcccatctgtctttctagctatgaccttgttatgaacagtatttgcactcggtgcaaatatccatgtcttacctaattaagcaacatcatagtgccataactcaaggaagttgaatgaggtgaacatagatacagctctttccccttccccccctttttaaatgtaacaaatactttttatgttccccttccccccttccccttttcccctttccccttttggaaacgtgtcaggaaccaaatagtttaagatgagcagttgaggggactgagagagtgatcgacacagaacctggcttcttcgtgcttcatcataagtcgtgctgccggccaggttacttaagcacccttttaacaaggaaaccttgtgggagatccagctggccgactcgagttcagaaacaggaccacagaggttacactctgggatcctggccatgaggttggatgcctcaccttactgaaaggagacactggacctaaatggcgcagcatgattttgttcctgcttggctaaatttctcaacaccacagtcagctaagtcacctactgccaccttcgaaaaacacggagagcacctacccagaggagaaggtagatttggagtaagccgccgtcgacataattcctctgatggtttttttaacaatggtcccctacgaactgcaggagattcttggcaccagccctccctgttccgccatgattctgtggactctggtgtctctaagggagcatatgctggaatcacagggaacccatctggttggcatagctcttcccgaggtcatgatggcatgagccaacgtagtggaggtggcacagggaaccatcgccattggaatggcagcttccactcccggaaagggtgtgcttttcaggaaaagccacctatggagattagggaagaaaagaaagaagacaaggtggaaaagttgcagtttgaagaggaggactttccttccttgaatccagaagctggcaaacagcatcagccatgcagacctattgggacaccttctggagtatgggaaaacccgcctagtgccaagcaaccctccaagatgctagttatcaaaaaagtttccaaagaggatcctgctgctgccttctctgctgcattcacctcaccaggatctcaccatgcaaatgggaacaaattgtcatccgtggttccaagtgtctataagaacctggttcctaagcctgtaccacctccttccaagcctaatgcatggaaagctaacaggatggagcacaagtcaggatccctttcctctagccgggagtctgcttttaccagtccaatctctgttaccaaaccagtggtactggctagtggtgcagctctgagttctcccaaagagagtccctccagcaccacccctccaattgagatcagctcctctcgtctgaccaagttgacccgccgaaccaccgacaggaagagtgagttcctgaaaactctgaaggatgaccggaatggagacttctcagagaatagagactgtgacaagctggaagatttggaggacaacagcacacctgaaccaaaggaaaatggggaggaaggctgtcatcaaaatggtcttgccctccctgtagtggaagaaggggaggttctctcacactctctagaagcagagcacaggttattgaaagctatgggttggcaggaatatcctgaaaatgatgagaattgccttcccctcacagaggatgagctcaaagagttccacatgaagacagagcagctgagaagaaatggctttggaaagaatggcttcttgcagagccgcagttccagtctgttctccccttggagaagcacttgcaaagcagagtttgaggactcagacaccgaaaccagtagcagtgaaacatcagatgacgatgcctggaagtaggcatataaatgctcacagttaaatctgacccagtaaactctgtgtgtttagggagtatacaaaagaaatcgttcttttccttttcttatgttgttgaatacttcattcacaagggaaataatcatatcccaaagagagagcaattggcttgttttgcttttgttattgttcttccctgttatctgctttatagagagaagtttgtgtggtgggacagattttttaaacacactcacacacacacacacatacacacccagtatatatggggcgatgcacaggtaggagctggcagtgcagggaagaggagacactggtctgcagcaacagcttctactaccagcccttggggcactcacccctgtgatcaagcaatcattgtcaatgacaaagtgactattgaagttataattgtattaaattaatgctaataatttggatattttattttatttttggctgctcgggtaactttagcccttaaccaagcatatgtgggtttttttggttgtttttttttgttttttttttctttttcctttttgggtacagctgtaaaatatttggatataggaaatgttgtgttattcttgcagccttgatattcagggtggattgtaaaatataaatttttgtgagatttcaaagattaagattattttgataacattatttacagatttaaaagatgtggttatcacaagtctcgagggggaaactactgcataaaataactaacttggaataaatattttgcatcagtttg

SEQ ID NO: 63500 - DNA, 3451 bp, Homo sapiens
ggtagcgcggccgacgcagcgcgcgcagcctccggggccaggccgtgtggcccgctggggactggagtctcaacgacgcgcacacgagaagtaaggagcggaaggtgggaaagggccggaaaacacacgttcctccgaaaccggtttgcaagtccttgtagagagtgatagattcgtgtggcctttcaaatgattgtgaagtggtggaaatggatccaaaataataagtgacttctctaccaaagcatagaagattcttcatatctccttccagtggctcaatttagattttgggaaggagcagaacaagtgaaacacagaaaactgaagagaagaaatcctcattttggacctatatttctccttgactatttcttaatatccatcctacccatcgttctaatgttttaactttgctctgaatttataaatagtaaaggccaaagacatagaatatacatttagtagctttataccaagaaatttgccttgaaagctgctgttcgtggagggaaaagtgtagcaaattcctgtctatttttattttttatttttttttaacaaagacaagatttatgtccctagattttgaaggttaaggcaaatataaatacatatctgcacactattttttagcagttgcatgagtaagagtaatgagatttgtattttaaggactttgtcatgtggatgttttggagttgactgctcagatcttttatagggctttaatatttttgatctattaccttgatgacattatttgtccacacttgagcccatctgtctttctagctatgaccttgttatgaacagtatttgcactcggtgcaaatatccatgtcttacctaattaagcaacatcatagtgccataactcaaggaagttgaatgaggtgaacatagatacagctctttccccttccccccctttttaaatgtaacaaatactttttatgttccccttccccccttccccttttcccctttccccttttggaaacgtgtcaggaaccaaatagtttaagatgagcagttgaggggactgagagagtgatcgacacagaacctggcttcttcgtgcttcatcataagtcgtgctgccggccaggttacttaagcacccttttaacaaggaaaccttgtgggagatccagctggccgactcgagttcagaaacaggaccacagaggttacactctgggatcctggccatgaggttggatgcctcaccttactgaaaggagacactggacctaaatggcgcagcatgattttgttcctgcttggctaaatttctcaacaccacagtcagctaagtcacctactgccaccttcgaaaaacacggagagcacctacccagaggagaaggtagatttggagtaagccgccgtcgacataattcctctgatggtttttttaacaatggtcccctacgaactgcaggagattcttggcaccagccctccctgttccgccatgattctgtggactctggtgtctctaagggagcatatgctggaatcacagggaacccatctggttggcatagctcttcccgaggtcatgatggcatgagccaacgtagtggaggtggcacagggaaccatcgccattggaatggcagcttccactcccggaaagggtgtgcttttcaggaaaagccacctatggagattagggaagaaaagaaagaagacaaggtggaaaagttgcagtttgaagaggaggactttccttccttgaatccagaagctggcaaacagcatcagccatgcagacctattgggacaccttctggagtatgggaaaacccgcctagtgccaagcaaccctccaagatgctagttatcaaaaaagtttccaaagaggatcctgctgctgccttctctgctgcattcacctcaccaggatctcaccatgcaaatgggaacaaattgtcatccgtggttccaagtgtctataagaacctggttcctaagcctgtaccacctccttccaagcctaatgcatggaaagctaacaggatggagcacaagtcaggatccctttcctctagccgggagtctgcttttaccagtccaatctctgttaccaaaccagtggtactggctagtggtgcagctctgagttctcccaaagagagtccctccagcaccacccctccaattgagatcagctcctctcgtctgaccaagttgacccgccgaaccaccgacaggaagagtgagttcctgaaaactctgaaggatgaccggaatggagacttctcagagaatagagactgtgacaagctggaagatttggaggacaacagcacacctgaaccaaaggaaaatggggaggaaggctgtcatcaaaatggtcttgccctccctgtagtggaagaaggggaggttctctcacactctctagaagcagagcacaggttattgaaagctatgggttggcaggaatatcctgaaaatgatgagaattgccttcccctcacagaggatgagctcaaagagttccacatgaagacagagcagctgagaagaaatggctttggaaagaatggcttcttgcagagccgcagttccagtctgttctccccttggagaagcacttgcaaagcagagtttgaggactcagacaccgaaaccagtagcagtgaaacatcagatgacgatgcctggaagtaggcatataaatgctcacagttaaatctgacccagtaaactctgtgtgtttagggagtatacaaaagaaatcgttcttttccttttcttatgttgttgaatacttcattcacaagggaaataatcatatcccaaagagagagcaattggcttgttttgcttttgttattgttcttccctgttatctgctttatagagagaagtttgtgtggtgggacagattttttaaacacactcacacacacacacacatacacacccagtatatatggggcgatgcacaggtaggagctggcagtgcagggaagaggagacactggtctgcagcaacagcttctactaccagcccttggggcactcacccctgtgatcaagcaatcattgtcaatgacaaagtgactattgaagttataattgtattaaattaatgctaataatttggatattttattttatttttggctgctcgggtaactttagcccttaaccaagcatatgtgggtttttttggttgtttttttttgttttttttttctttttcctttttgggtacagctgtaaaatatttggatataggaaatgttgtgttattcttgcagccttgatattcagggtggattgtaaaatataaatttttgtgagatttcaaagattaagattattttgataacattatttacagatttaaaagatgtggttatcacaagtctcgagggggaaactactgcataaaataactaacttggaataaatattttgcatcagtttg

SEQ ID NO: 63501 - DNA, 3470 bp, Homo sapiens
acctgcgctaattggttcctaggcccggctttctgtttgggggccattcttaatttctagttgaatccagatgttgaacggtccttgaagttctattccagggctcccaggcagcagaatctgcccacagagttcggttggtgtctcacctttaactctccttatgctgggtgaaaacaaagagtgatagattcgtgtggcctttcaaatgattgtgaagtggtggaaatggatccaaaataataagtgacttctctaccaaagcatagaagattcttcatatctccttccagtggctcaatttagattttgggaaggagcagaacaagtgaaacacagaaaactgaagagaagaaatcctcattttggacctatatttctccttgactatttcttaatatccatcctacccatcgttctaatgttttaactttgctctgaatttataaatagtaaaggccaaagacatagaatatacatttagtagctttataccaagaaatttgccttgaaagctgctgttcgtggagggaaaagtgtagcaaattcctgtctatttttattttttatttttttttaacaaagacaagatttatgtccctagattttgaaggttaaggcaaatataaatacatatctgcacactattttttagcagttgcatgagtaagagtaatgagatttgtattttaaggactttgtcatgtggatgttttggagttgactgctcagatcttttatagggctttaatatttttgatctattaccttgatgacattatttgtccacacttgagcccatctgtctttctagctatgaccttgttatgaacagtatttgcactcggtgcaaatatccatgtcttacctaattaagcaacatcatagtgccataactcaaggaagttgaatgaggtgaacatagatacagctctttccccttccccccctttttaaatgtaacaaatactttttatgttccccttccccccttccccttttcccctttccccttttggaaacgtgtcaggaaccaaatagtttaagatgagcagttgaggggactgagagagtgatcgacacagaacctggcttcttcgtgcttcatcataagtcgtgctgccggccaggttacttaagcacccttttaacaaggaaaccttgtgggagatccagctggccgactcgagttcagaaacaggaccacagaggttacactctgggatcctggccatgaggttggatgcctcaccttactgaaaggagacactggacctaaatggcgcagcatgattttgttcctgcttggctaaatttctcaacaccacagtcagctaagtcacctactgccaccttcgaaaaacacggagagcacctacccagaggagaaggtagatttggagtaagccgccgtcgacataattcctctgatggtttttttaacaatggtcccctacgaactgcaggagattcttggcaccagccctccctgttccgccatgattctgtggactctggtgtctctaagggagcatatgctggaatcacagggaacccatctggttggcatagctcttcccgaggtcatgatggcatgagccaacgtagtggaggtggcacagggaaccatcgccattggaatggcagcttccactcccggaaagggtgtgcttttcaggaaaagccacctatggagattagggaagaaaagaaagaagacaaggtggaaaagttgcagtttgaagaggaggactttccttccttgaatccagaagctggcaaacagcatcagccatgcagacctattgggacaccttctggagtatgggaaaacccgcctagtgccaagcaaccctccaagatgctagttatcaaaaaagtttccaaagaggatcctgctgctgccttctctgctgcattcacctcaccaggatctcaccatgcaaatgggaacaaattgtcatccgtggttccaagtgtctataagaacctggttcctaagcctgtaccacctccttccaagcctaatgcatggaaagctaacaggatggagcacaagtcaggatccctttcctctagccgggagtctgcttttaccagtccaatctctgttaccaaaccagtggtactggctagtggtgcagctctgagttctcccaaagagagtccctccagcaccacccctccaattgagatcagctcctctcgtctgaccaagttgacccgccgaaccaccgacaggaagagtgagttcctgaaaactctgaaggatgaccggaatggagacttctcagagaatagagactgtgacaagctggaagatttggaggacaacagcacacctgaaccaaaggaaaatggggaggaaggctgtcatcaaaatggtcttgccctccctgtagtggaagaaggggaggttctctcacactctctagaagcagagcacaggttattgaaagctatgggttggcaggaatatcctgaaaatgatgagaattgccttcccctcacagaggatgagctcaaagagttccacatgaagacagagcagctgagaagaaatggctttggaaagaatggcttcttgcagagccgcagttccagtctgttctccccttggagaagcacttgcaaagcagagtttgaggactcagacaccgaaaccagtagcagtgaaacatcagatgacgatgcctggaagtaggcatataaatgctcacagttaaatctgacccagtaaactctgtgtgtttagggagtatacaaaagaaatcgttcttttccttttcttatgttgttgaatacttcattcacaagggaaataatcatatcccaaagagagagcaattggcttgttttgcttttgttattgttcttccctgttatctgctttatagagagaagtttgtgtggtgggacagattttttaaacacactcacacacacacacacatacacacccagtatatatggggcgatgcacaggtaggagctggcagtgcagggaagaggagacactggtctgcagcaacagcttctactaccagcccttggggcactcacccctgtgatcaagcaatcattgtcaatgacaaagtgactattgaagttataattgtattaaattaatgctaataatttggatattttattttatttttggctgctcgggtaactttagcccttaaccaagcatatgtgggtttttttggttgtttttttttgttttttttttctttttcctttttgggtacagctgtaaaatatttggatataggaaatgttgtgttattcttgcagccttgatattcagggtggattgtaaaatataaatttttgtgagatttcaaagattaagattattttgataacattatttacagatttaaaagatgtggttatcacaagtctcgagggggaaactactgcataaaataactaacttggaataaatattttgcatcagtttg

SEQ ID NO: 63502 - DNA, 3478 bp, Homo sapiens
acgggggatgggagggccgtgctgctggtcgctcctcctcctccacccgctctgcccctcctggaccttgtgggccgggcagccattttgggaagagctttgttatggttgtggactagccgcctctgccgggtcgacaagctggggacgcgtcctcagacgcagcgtctagtccctggccatagctccgccgctgcccgttggtgtctcacctttaactctccttatgctgggtgaaaacaaagagtgatagattcgtgtggcctttcaaatgattgtgaagtggtggaaatggatccaaaataataagtgacttctctaccaaagcatagaagattcttcatatctccttccagtggctcaatttagattttgggaaggagcagaacaagtgaaacacagaaaactgaagagaagaaatcctcattttggacctatatttctccttgactatttcttaatatccatcctacccatcgttctaatgttttaactttgctctgaatttataaatagtaaaggccaaagacatagaatatacatttagtagctttataccaagaaatttgccttgaaagctgctgttcgtggagggaagatttatgtccctagattttgaaggttaaggcaaatataaatacatatctgcacactattttttagcagttgcatgagtaagagtaatgagatttgtattttaaggactttgtcatgtggatgttttggagttgactgctcagatcttttatagggctttaatatttttgatctattaccttgatgacattatttgtccacacttgagcccatctgtctttctagctatgaccttgttatgaacagtatttgcactcggtgcaaatatccatgtcttacctaattaagcaacatcatagtgccataactcaaggaagttgaatgaggtgaacatagatacagctctttccccttccccccctttttaaatgtaacaaatactttttatgttccccttccccccttccccttttcccctttccccttttggaaacgtgtcaggaaccaaatagtttaagatgagcagttgaggggactgagagagtgatcgacacagaacctggcttcttcgtgcttcatcataagtcgtgctgccggccaggttacttaagcacccttttaacaaggaaaccttgtgggagatccagctggccgactcgagttcagaaacaggaccacagaggttacactctgggatcctggccatgaggttggatgcctcaccttactgaaaggagacactggacctaaatggcgcagcatgattttgttcctgcttggctaaatttctcaacaccacagtcagctaagtcacctactgccaccttcgaaaaacacggagagcacctacccagaggagaaggtagatttggagtaagccgccgtcgacataattcctctgatggtttttttaacaatggtcccctacgaactgcaggagattcttggcaccagccctccctgttccgccatgattctgtggactctggtgtctctaagggagcatatgctggaatcacagggaacccatctggttggcatagctcttcccgaggtcatgatggcatgagccaacgtagtggaggtggcacagggaaccatcgccattggaatggcagcttccactcccggaaagggtgtgcttttcaggaaaagccacctatggagattagggaagaaaagaaagaagacaaggtggaaaagttgcagtttgaagaggaggactttccttccttgaatccagaagctggcaaacagcatcagccatgcagacctattgggacaccttctggagtatgggaaaacccgcctagtgccaagcaaccctccaagatgctagttatcaaaaaagtttccaaagaggatcctgctgctgccttctctgctgcattcacctcaccaggatctcaccatgcaaatgggaacaaattgtcatccgtggttccaagtgtctataagaacctggttcctaagcctgtaccacctccttccaagcctaatgcatggaaagctaacaggatggagcacaagtcaggatccctttcctctagccgggagtctgcttttaccagtccaatctctgttaccaaaccagtggtactggctagtggtgcagctctgagttctcccaaagagagtccctccagcaccacccctccaattgagatcagctcctctcgtctgaccaagttgacccgccgaaccaccgacaggaagagtgagttcctgaaaactctgaaggatgaccggaatggagacttctcagagaatagagactgtgacaagctggaagatttggaggacaacagcacacctgaaccaaaggaaaatggggaggaaggctgtcatcaaaatggtcttgccctccctgtagtggaagaaggggaggttctctcacactctctagaagcagagcacaggttattgaaagctatgggttggcaggaatatcctgaaaatgatgagaattgccttcccctcacagaggatgagctcaaagagttccacatgaagacagagcagctgagaagaaatggctttggaaagaatggcttcttgcagagccgcagttccagtctgttctccccttggagaagcacttgcaaagcagagtttgaggactcagacaccgaaaccagtagcagtgaaacatcagatgacgatgcctggaagtaggcatataaatgctcacagttaaatctgacccagtaaactctgtgtgtttagggagtatacaaaagaaatcgttcttttccttttcttatgttgttgaatacttcattcacaagggaaataatcatatcccaaagagagagcaattggcttgttttgcttttgttattgttcttccctgttatctgctttatagagagaagtttgtgtggtgggacagattttttaaacacactcacacacacacacacatacacacccagtatatatggggcgatgcacaggtaggagctggcagtgcagggaagaggagacactggtctgcagcaacagcttctactaccagcccttggggcactcacccctgtgatcaagcaatcattgtcaatgacaaagtgactattgaagttataattgtattaaattaatgctaataatttggatattttattttatttttggctgctcgggtaactttagcccttaaccaagcatatgtgggtttttttggttgtttttttttgttttttttttctttttcctttttgggtacagctgtaaaatatttggatataggaaatgttgtgttattcttgcagccttgatattcagggtggattgtaaaatataaatttttgtgagatttcaaagattaagattattttgataacattatttacagatttaaaagatgtggttatcacaagtctcgagggggaaactactgcataaaataactaacttggaataaatattttgcatcagtttg

SEQ ID NO: 63503 - DNA, 3658 bp, Homo sapiens
cgagtatgggctatcgtcgacccacgccgtcgctttgttatggttgtggactagccgcctctgccgggtcgacaagctggggacgcgtcctcagacgcagcgtctagtccctggccatagctccgccgctgcccgttggtgtctcacctttaactctccttatgctgggtgaaaacaaagagtgatagattcgtgtggcctttcaaatgattgtgaagtggtggaaatggatccaaaataataagtgacttctctaccaaagcatagaagattcttcatatctccttccagtggctcaatttagattttgggaaggagcagaacaagtgaaacacagaaaactgaagagaagaaatcctcattttggacctatatttctccttgactatttcttaatatccatcctacccatcgttctaatgttttaactttgctctgaatttataaatagtaaaggccaaagacatagaatatacatttagtagctttataccaagaaatttgccttgaaagctgctgttcgtggagggaaaagtgtagcaaattcctgtctatttttattttttatttttttttaacaaagacaagatttatgtccctagattttgaaggttaaggcaaatataaatacatatctgcacactattttttagcagttgcatgagtaagagtaatgagatttgtattttaaggactttgtcatgtggatgttttggagttgactgctcagatcttttatagggctttaatatttttgatctattaccttgatgacattatttgtccacacttgagcccatctgtctttctagctatgaccttgttatgaacagtatttgcactcggtgcaaatatccatgtcttacctaattaagcaacatcatagtgccataactcaaggaagttgaatgaggtgaacatagatacagctctttccccttccccccctttttaaatgtaacaaatactttttatgttccccttccccccttccccttttcccctttccccttttggaaacgtgtcaggaaccaaatagtttaagatgagcagttgaggggactgagagagtgatcgacacagaacctggcttcttcgtgcttcatcataagtcgtgctgccggccaggttacttaagcacccttttaacaaggaaaccttgtgggagatccagctggccgactcgagttcagaaacaggaccacagaggttacactctgggatcctggccatgaggttggatgcctcaccttactgaaaggagacactggacctaaatggcgcagcatgattttgttcctgcttggctaaatttctcaacaccacagtcagctaagtcacctactgccaccttcgaaaaacacggagagcacctacccagaggagaaggtagatttggagtaagccgccgtcgacataattcctctgatggtttttttaacaatggtcccctacgaactgcaggagattcttggcaccagccctccctgttccgccatgattctgtggactctggtgtctctaagggagcatatgctggaatcacagggaacccatctggttggcatagctcttcccgaggtcatgatggcatgagccaacgtagtggaggtggcacagggaaccatcgccattggaatggcagcttccactcccggaaagggtgtgcttttcaggaaaagccacctatggagattagggaagaaaagaaagaagacaaggtggaaaagttgcagtttgaagaggaggactttccttccttgaatccagaagctggcaaacagcatcagccatgcagacctattgggacaccttctggagtatgggaaaacccgcctagtgccaagcaaccctccaagatgctagttatcaaaaaagtttccaaagaggatcctgctgctgccttctctgctgcattcacctcaccaggatctcaccatgcaaatgggaacaaattgtcatccgtggttccaagtgtctataagaacctggttcctaagcctgtaccacctccttccaagcctaatgcatggaaagctaacaggatggagcacaagtcaggatccctttcctctagccgggagtctgcttttaccagtccaatctctgttaccaaaccagtggtactggctagtggtgcagctctgagttctcccaaagagagtccctccagcaccacccctccaattgagatcagctcctctcgtctgaccaagttgacccgccgaaccaccgacaggaagagtgagttcctgaaaactctgaaggatgaccggaatggagacttctcagagaatagagactgtgacaagctggaagatttggaggacaacagcacacctgaaccaaaggaaaatggggaggaaggctgtcatcaaaatggtcttgccctccctgtagtggaagaaggggaggttctctcacactctctagaagcagagcacaggttattgaaagctatgggttggcaggaatatcctgaaaatgatgagaattgccttcccctcacagaggatgagctcaaagagttccacatgaagacagagcagctgagaagaaatggctttggaaagaatggcttcttgcagagccgcagttccagtctgttctccccttggagaagcacttgcaaagcagagtttgaggactcagacaccgaaaccagtagcagtgaaacatcagatgacgatgcctggaagtaggcatataaatgctcacagttaaatctgacccagtaaactctgtgtgtttagggagtatacaaaagaaatcgttcttttccttttcttatgttgttgaatacttcattcacaagggaaataatcatatcccaaagagagagcaattggcttgttttgcttttgttattgttcttccctgttatctgctttatagagagaagtttgtgtggtgggacagattttttaaacacactcacacacacacacacatacacacccagtatatatggggcgatgcacaggtaggagctggcagtgcagggaagaggagacactggtctgcagcaacagcttctactaccagcccttggggcactcacccctgtgatcaagcaatcattgtcaatgacaaagtgactattgaagttataattgtattaaattaatgctaataatttggatattttattttatttttggctgctcgggtaactttagcccttaaccaagcatatgtgggtttttttggttgtttttttttgttttttttttctttttcctttttgggtacagctgtaaaatatttggatataggaaatgttgtgttattcttgcagccttgatattcagggtggattgtaaaatataaatttttgtgagatttcaaagattaagattattttgataacattatttacagatttaaaagatgtggttatcacaagtctcgagggggaaactactgcataaaataactaacttggaataaatattttgcatcagtttggattgtcttgtgtaagaagtatattttctttaaaattagatgagtggattcttttttaggggaaatatttttagaagttggggggaaatgtgaattcagacacaactgtttctctattttagcagatacttttttgatgcagaaaaacctgtgcaataaattaccagtaataaagtcagaaaccaagata

SEQ ID NO: 63504 - DNA, 2734 bp, Homo sapiens
cgagtatgggctatcgtcgacccacgccgtcgctttgttatggttgtggactagccgcctctgccgggtcgacaagctggggacgcgtcctcagacgcagcgtctagtccctggccatagctccgccgctgcccgttggtgtctcacctttaactctccttatgctgggtgaaaacaaagagtgatagattcgtgtggcctttcaaatgattgtgaagtggtggaaatggatccaaaataataagtgacttctctaccaaagcatagaagattcttcatatctccttccagtggctcaatttagattttgggaaggagcagaacaagtgaaacacagaaaactgaagagaagaaatcctcattttggacctatatttctccttgactatttcttaatatccatcctacccatcgttctaatgttttaactttgctctgaatttataaatagtaaaggccaaagacatagaatatacatttagtagctttataccaagaaatttgccttgaaagctgctgttcgtggagggaaaagtgtagcaaattcctgtctatttttattttttatttttttttaacaaagacaagatttatgtccctagattttgaaggttaaggcaaatataaatacatatctgcacactattttttagcagttgcatgagtaagagtaatgagatttgtattttaaggactttgtcatgtggatgttttggagttgactgctcagatcttttatagggctttaatatttttgatctattaccttgatgacattatttgtccacacttgagcccatctgtctttctagctatgaccttgttatgaacagtatttgcactcggtgcaaatatccatgtcttacctaattaagcaacatcatagtgccataactcaaggaagttgaatgaggtgaacatagatacagctctttccccttccccccctttttaaatgtaacaaatactttttatgttccccttccccccttccccttttcccctttccccttttggaaacgtgtcaggaaccaaatagtttaagatgagcagttgaggggactgagagagtgatcgacacagaacctggcttcttcgtgcttcatcataagtcgtgctgccggccaggttacttaagcacccttttaacaaggaaaccttgtgggagatccagctggccgactcgagttcagaaacaggaccacagaggttacactctgggtgtcatccgtggttccaagtgtctataagaacctggttcctaagcctgtaccacctccttccaagcctaatgcatggaaagctaacaggatggagcacaagtcaggatccctttcctctagccgggagtctgcttttaccagtccaatctctgttaccaaaccagtggtactggctagtggtgcagctctgagttctcccaaagagagtccctccagcaccacccctccaattgagatcagctcctctcgtctgaccaagttgacccgccgaaccaccgacaggaagagtgagttcctgaaaactctgaaggatgaccggaatggagacttctcagagaatagagactgtgacaagctggaagatttggaggacaacagcacacctgaaccaaaggaaaatggggaggaaggctgtcatcaaaatggtcttgccctccctgtagtggaagaaggggaggttctctcacactctctagaagcagagcacaggttattgaaagctatgggttggcaggaatatcctgaaaatgatgagaattgccttcccctcacagaggatgagctcaaagagttccacatgaagacagagcagctgagaagaaatggctttggaaagaatggcttcttgcagagccgcagttccagtctgttctccccttggagaagcacttgcaaagcagagtttgaggactcagacaccgaaaccagtagcagtgaaacatcagatgacgatgcctggaagtaggcatataaatgctcacagttaaatctgacccagtaaactctgtgtgtttagggagtatacaaaagaaatcgttcttttccttttcttatgttgttgaatacttcattcacaagggaaataatcatatcccaaagagagagcaattggcttgttttgcttttgttattgttcttccctgttatctgctttatagagagaagtttgtgtggtgggacagattttttaaacacactcacacacacacacacatacacacccagtatatatggggcgatgcacaggtaggagctggcagtgcagggaagaggagacactggtctgcagcaacagcttctactaccagcccttggggcactcacccctgtgatcaagcaatcattgtcaatgacaaagtgactattgaagttataattgtattaaattaatgctaataatttggatattttattttatttttggctgctcgggtaactttagcccttaaccaagcatatgtgggtttttttggttgtttttttttgttttttttttctttttcctttttgggtacagctgtaaaatatttggatataggaaatgttgtgttattcttgcagccttgatattcagggtggattgtaaaatataaatttttgtgagatttcaaagattaagattattttgataacattatttacagatttaaaagatgtggttatcacaagtctcgagggggaaactactgcataaaataactaacttggaataaatattttgcatcagtttg

SEQ ID NO: 63505 - DNA, 3415 bp, Homo sapiens
cgagtatgggctatcgtcgacccacgccgtcgctttgttatggttgtggactagccgcctctgccgggtcgacaagctggggacgcgtcctcagacgcagcgtctagtccctggccatagctccgccgctgcccgttggtgtctcacctttaactctccttatgctgggtgaaaacaaagagtgatagattcgtgtggcctttcaaatgattgtgaagtggtggaaatggatccaaaataataagtgacttctctaccaaagcatagaagattcttcatatctccttccagtggctcaatttagattttgggaaggagcagaacaagtgaaacacagaaaactgaagagaagaaatcctcattttggacctatatttctccttgactatttcttaatatccatcctacccatcgttctaatgttttaactttgctctgaatttataaatagtaaaggccaaagacatagaatatacatttagtagctttataccaagaaatttgccttgaaagctgctgttcgtggagggaaaagtgtagcaaattcctgtctatttttattttttatttttttttaacaaagacaagatttatgtccctagattttgaaggttaaggcaaatataaatacatatctgcacactattttttagcagttgcatgagtaagagtaatgagatttgtattttaaggactttgtcatgtggatgttttggagttgactgctcagatcttttatagggctttaatatttttgatctattaccttgatgacattatttgtccacacttgagcccatctgtctttctagctatgaccttgttatgaacagtatttgcactcggtgcaaatatccatgtcttacctaattaagcaacatcatagtgccataactcaaggaagttgaatgaggtgaacatagatacagctctttccccttccccccctttttaaatgtaacaaatactttttatgttccccttccccccttccccttttcccctttccccttttggaaacgtgtcaggaaccaaatagtttaagatgagcagttgaggggactgagagagtgatcgacacagaacctggcttcttcgtgcttcatcataagtcgtgctgccggccaggttacttaagcacccttttaacaaggaaaccttgtgggagatccagctggccgactcgagttcagaaacaggaccacagaggttacactctgggatcctggccatgaggttggatgcctcaccttactgaaaggagacactggacctaaatggcgcagcatgattttgttcctgcttggctaaatttctcaacaccacagtcagctaagtcacctactgccaccttcgaaaaacacggagagcacctacccagaggagaaggtagatttggagtaagccgccgtcgacataattcctctgatggtttttttaacaatggtcccctacgaactgcaggagattcttggcaccagccctccctgttccgccatgattctgtggactctggtgtctctaagggagcatatgctggaatcacagggaacccatctggttggcatagctcttcccgaggtcatgatggcatgagccaacgtagtggaggtggcacagggaaccatcgccattggaatggcagcttccactcccggaaagggtgtgcttttcaggaaaagccacctatggagattagggaagaaaagaaagaagacaaggtggaaaagttgcagtttgaagaggaggactttccttccttgaatccagaagctggcaaacagcatcagccatgcagacctattgggacaccttctggagtatgggaaaacccgcctagtgccaagcaaccctccaagatgctagttatcaaaaaagtttccaaagaggatcctgctgctgccttctctgctgcattcacctcaccaggatctcaccatgcaaatgggaacaaattgtcatccgtggttccaagtgtctataagaacctggttcctaagcctgtaccacctccttccaagcctaatgcatggaaagctaacaggatggagcacaagtcaggatccctttcctctagccgggagtctgcttttaccagtccaatctctgttaccaaaccagtggtactggctagtggtgcagctctgagttctcccaaagagagtccctccagcaccacccctccaattgagatcagctcctctcgtctgaccaagttgacccgccgaaccaccgacaggaagagtgagttcctgaaaactctgaaggatgaccggaatggagacttctcagagaatagagactgtgacaagctggaagatttggaggacaacagcacacctgaaccaaaggaaaatggggaggaaggctgtcatcaaaatggtcttgccctccctgtagtggaagaaggggaggttctctcacactctctagaagcagagcacaggttattgaaagctatgggttggcaggaatatcctgaaaatgatgagaattgccttcccctcacagaggatgagctcaaagagttccacatgaagacagagcagctgagaagaaatggctttggaaagaatggcttcttgcagagccgcagttccagtctgttctccccttggagaagcacttgcaaagcagagtttgaggactcagacaccgaaaccagtagcagtgaaacatcagatgacgatgcctggaagtaggcatataaatgctcacagttaaatctgacccagtaaactctgtgtgtttagggagtatacggaaataatcatatcccaaagagagagcaattggcttgttttgcttttgttattgttcttccctgttatctgctttatagagagaagtttgtgtggtgggacagattttttaaacacactcacacacacacacacatacacacccagtatatatggggcgatgcacaggtaggagctggcagtgcagggaagaggagacactggtctgcagcaacagcttctactaccagcccttggggcactcacccctgtgatcaagcaatcattgtcaatgacaaagtgactattgaagttataattgtattaaattaatgctaataatttggatattttattttatttttggctgctcgggtaactttagcccttaaccaagcatatgtgggtttttttggttgtttttttttgttttttttttctttttcctttttgggtacagctgtaaaatatttggatataggaaatgttgtgttattcttgcagccttgatattcagggtggattgtaaaatataaatttttgtgagatttcaaagattaagattattttgataacattatttacagatttaaaagatgtggttatcacaagtctcgagggggaaactactgcataaaataactaacttggaataaatattttgcatcagtttg

SEQ ID NO: 63506 - DNA, 2601 bp, Homo sapiens
cgagtatgggctatcgtcgacccacgccgtcgctttgttatggttgtggactagccgcctctgccgggtcgacaagctggggacgcgtcctcagacgcagcgtctagtccctggccatagctccgccgctgcccgttggtgtctcacctttaactctccttatgctgggtgaaaacaaagagtgatagattcgtgtggcctttcaaatgattgtgaagtggtggaaatggatccaaaataataagtgacttctctaccaaagcatagaagattcttcatatctccttccagtggctcaatttagattttgggaaggagcagaacaagtgaaacacagaaaactgaagagaagaaatcctcattttggacctatatttctccttgactatttcttaatatccatcctacccatcgttctaatgttttaactttgctctgaatttataaatagtaaaggccaaagacatagaatatacatttagtagctttataccaagaaatttgccttgaaagctgctgttcgtggagggaaaagtgtagcaaattcctgtctatttttattttttatttttttttaacaaagacaagatttatgtccctagattttgaaggttaaggcaaatataaatacatatctgcacactattttttagcagttgcatgagtaagagtaatgagatttgtattttaaggactttgtcatgtggatgttttggagttgactgctcagatcttttatagggctttaatatttttgatctattaccttgatgacattatttgtccacacttgagcccatctgtctttctagctatgaccttgttatgaacagtatttgcactcggtgcaaatatccatgtcttacctaattaagcaacatcatagtgccataactcaaggaagttgaatgaggtgaacatagatacagctctttccccttccccccctttttaaatgtaacaaatactttttatgttccccttccccccttccccttttcccctttccccttttggaaacgtgtcaggaaccaaatagtttaagatgagcagttgaggggactgagagagtgatcgacacagaacctggcttcttcgtgcttcatcataagtcgtgctgccggccaggttacttaagcacccttttaacaaggaaaccttgtgggagatccagctggccgactcgagttcagaaacaggaccacagaggttacactctgggatcctggccatgaggttggatgcctcaccttactgaaaggagacactggacctaaatggcgcagcatgattttgttcctgcttggctaaatttctcaacaccacagtcagctaagtcacctactgccaccttcgaaaaacacggagagcacctacccagaggagaaggtagatttggagtaagccgccgtcgacataattcctctgatggtttttttaacaatggtcccctacgaactgcaggagattcttggcaccagccctccctgttccgccatgattctgtggactctggtgtctctaagggagcatatgctggaatcacagggaacccatctggttggcatagctcttcccgaggtcatgatggcatgagccaacgtagtggaggtggcacagggaaccatcgccattggaatggcagcttccactcccggaaagggtgtgcttttcaggaaaagccacctatggagattagggaagaaaagaaagaagacaaggtggaaaagttgcagtttgaagaggaggactttccttccttgaatccagaagctggcaaacagcatcagccatgcagacctattgggacaccttctggagtatgggaaaacccgcctagtgccaagcaaccctccaagatgctagttatcaaaaaagtttccaaagaggatcctgctgctgccttctctgctgcattcacctcaccaggatctcaccatgcaaatgggaacaaattgtcatccgtggttccaagtgtctataagaacctggttcctaagcctgtaccacctccttccaagcctaatgcatggaaagctaacaggatggagcacaagtcaggatccctttcctctagccgggagtctgcttttaccagtccaatctctgttaccaaaccagtggtactggctagtggtgcagctctgagttctcccaaagagagtccctccagcaccacccctccaattgagatcagctcctctcgtctgaccaagttgacccgccgaaccaccgacaggaagagtgagttcctgaaaactctgaaggatgaccggaatggagacttctcagagaatagagactgtgacaagctggaagatttggaggacaacagcacacctgaaccaaaggaaaatggggaggaaggctgtcatcaaaatggtcttgccctccctgtagtggaagaaggggaggttctctcacactctctagaagcagagcacaggttattgaaagctatgggttggcaggaatatcctgaaaatgatgagaattgccttcccctcacagaggatgagctcaaagagttccacatgaagacagagcagctgagaagaaatgctttggaaagaatgcgtagcagacggccgctactagctc

SEQ ID NO: 63507 - DNA, 4118 bp, Homo sapiens
ctctcggcctgcgggctcgcggaaaccggaagcggcggctgtccgcggtgccggctgggggcggagaggcggcggtgggctccctggggtgtgtgagcccggtgatggagccgggcccgacagccgcgcagcggaggtgttcgttgccgccgtggctgccgctggggctgctgctgtggtcggggctggccctgggcgcgctccccttcggcagcagtccgcacagggtcttccacgacctcctgtcggagcagcagttgctggaggtggaggacttgtccctgtccctcctgcagggtggagggctggggcctctgtcgctgcccccggacctgccggatctggatcctgagtgccgggagctcctgctggacttcgccaacagcagcgcagagctgacagggtgtctggtgcgcagcgcccggcccgtgcgcctctgtcagacctgctaccccctcttccaacaggtcgtcagcaagatggacaacatcagccgagccgcggggaatacttcagagagtcagagttgtgccagaagtctcttaatggcagatagaatgcaaatagttgtgattctctcagaattttttaataccacatggcaggaggcaaattgtgcaaattgtttaacaaacaacagtgaagaattatcaaacagcacagtatatttccttaatctatttaatcacaccctgacctgctttgaacataaccttcaggggaatgcacatagtcttttacagacaaaaaattattcagaagtatgcaaaaactgccgtgaagcatacaaaactctgagtagtctgtacagtgaaatgcaaaaaatgaatgaacttgagaataaggctgaacctggaacacatttatgcattgatgtggaagatgcaatgaacatcactcgaaaactatggagtcgaactttcaactgttcagtcccttgcagtgacacagtgcctgtaattgctgtttctgtgttcattctctttctacctgttgtcttctaccttagtagctttcttcactcagagcaaaagaaacgcaaactcattctgcccaaacgtctcaagtccagtaccagttttgcaaatattcaggaaaattcaaactgagacctacaaaatggagaattgacatatcacgtgaatgaatggtggaagacacaacttggtttcagaaagaagataaactgtgatttgacaagtcaagctcttaagaaatacaaggacttcagatccatttttaaataagaattttcgatttttctttccttttccacttctttctaacagatttggatatttttaatttccaggcatagcaatgttatctattttaatgtgtatttgtcacaataacagaacatgcaagaacaatcattattttattttataggcatttgattactattctagacttctggtatcttcttactaacataaatatctcaagtagaaaagtttttgaaaactaacatttaaaaattaatcagttacagtaaagactttgaaaaagaaatgtacttgttaggaagtagcttaattaccccccattgcagtattattgttatatatatagttaatatgttgtacatcacaataatatataattcagtctctagtttccctagagtcatttttgaaaccactgattgcaaacctccctgacaatttttaaaagtagtaagccacattacatttatctttgtaaaaagatttatggtaactggtttcttacttgacttttataaatagtattttacatcttatttttgcctttatttcataagtaatttaaaaatcactggattgctttattatattcagggcaatatggattatttttataccaaggatttgcatcgtgaattacattaagttatttggcaatttataatttattactactttaaatcaaatgtagcattatcacactgtatttaaattgtcattttttaaaggaatattttcttcttaagatatatagaggattttggagaagagagacaggaggggtaaaaccagcttaaggttcagcgagcagaaagggacctgagaggatgctcactgtaagactgttggacagtggtgtgtattgaggggatgaatcggaacgatagtctcatgcagaaaatagtgagattaagatcatccttattgtttctaaattatttcaatcagatgaaagtgatacgattgaaatgaaatcacatagttcgtgctcagaaattctattttggtatgtttgtattagcctttagaaaaaacactccgtttcagaattgttcacagttttatttcttaggtttttagagttcaggatttcatttattaatttcttcttgcttttttggtggaaataggctttgttgtaaacattaagaatataaaatctcctctatatagaaacaagaattttgttaaaaagagaatttgaatcccttcctatactataaaatgctctatagggagacaaagtgtttcttttttcttttatgtttactgtttatgtggagtgaaatataaggctcttggatgtataacatactcaaaagctgttacactttctctgatctgctgtgatccactgaaaatgtgctggggtttgttctgctgtcactgtttatgctgctggaacttagcactgtcttgatttgaagcatatgattgagagccatttgaagcaatcttcattaatgcagataaaacaagtttacatgtgcagagttagaaaatgacatgttcaattctgtaagtggtgactttttgagcacctttcagtattatgtatttgtaaaaaccattgtttttggatataaagctaataagcactttaaaaaggaaaaggcagcctttactattttttctggttgagtcattgctctttagacctagcatcagcaatagatttcaaagataagtattaagcgctaccctaaagtgtgtaagtttttcattttgtcatattgaaaaatgatttgcatagtactgaatgttgacacacagcttatatgtatttacaagaatatctttaagtgtttttttgacacattaaaataaaggataaggaaattgtaagctttatttggatttttaaatacatttttaaaatttcagatgtaatttaacatcacatttgtttttcaggtattgagtttagatgcctacttttatgagtaccatcagctggacacagtgtctcatacctgtatttgcagcactttgggaggctgaagcagatcgctggagcttatgagttcgagaccagcctggacaacatagtgaaacactgtctctgcaaaaaatacaaaaattagctgggtatggtgagacagtgtctcactatgttgcccaaggctggtcttgaactcctgagttcaagagatcctcctgccttagcctcccaaagtgctgggattacaagcataagcaccacacctggctgaacatcagatattttaaagtgtagcccagagtctagttggtaaatgttacttatattgggactagtattttctaatgtttctgggatatgctccctataaaatgaaatgttttcctggaacaatgctaattaggattgcattcctggccaaagacatgacatcaaataagtaatagacatcaccagcaatgaattttgaaaagcaaaaaatactattaacctatataaccatttaaaatttaaaaaattatgttccaagtacctctattttctgagctagaagaaaccttagaggccatctgatgatagattcccagagctggatggatccctagggactacctaatctgactttctgtccactgcatggattcttctaaaaagtatgtcacttatttccctaccttattaagactaaataagtggaacatcatagagctctttatttataacagtcattctttgatagtcaactcttaaatggagacttgagatgcttaaatattgtactactgtgcttatcttgtaaagatttcataaaatgatagtattggttattttaaaaaggctttggcttatgctgaattatacatgtagcaccaaaatgttacaactctactaaatttccttgttctaaactattatattagctataataaatattagtcatacatgta

SEQ ID NO: 63508 - DNA, 3457 bp, Homo sapiens
ctctcggcctgcgggctcgcggaaaccggaagcggcggctgtccgcggtgccggctgggggcggagaggcggcggtgggctccctggggtgtgtgagcccggtgatggagccgggcccgacagccgcgcagcggaggtgttcgttgccgccgtggctgccgctggggctgctgctgtggtcggggctggccctgggcgcgctccccttcggcagcagtccgcacagggtcttccacgacctcctgtcggagcagcagttgctggaggtggaggacttgtccctgtccctcctgcagggtggagggctggggcctctgtcgctgcccccggacctgccggatctggatcctgagtgccgggagctcctgctggacttcgccaacagcagcgcagagctgacagggtgtctggtgcgcagcgcccggcccgtgcgcctctgtcagacctgctaccccctcttccaacaggtcgtcagcaagatggacaacatcagccgagccgcggggaatacttcagagagtcagagttgtgccagaagtctcttaatggcagatagaatgcaaatagttgtgattctctcagaattttttaataccacatggcaggaggcaaattgtgcaaattgtttaacaaacaacagtgaagaattatcaaacagcacagtatatttccttaatctatttaatcacaccctgacctgctttgaacataaccttcaggggaatgcacatagtcttttacagacaaaaaattattcagaagtatgcaaaaactgccgtgaagcatacaaaactctgagtagtctgtacagtgaaatgcaaaaaatgaatgaacttgagaataaggctgaacctggaacacatttatgcattgatgtggaagatgcaatgaacatcactcgaaaactatggagtcgaactttcaactgttcagtcccttgcagtgacacagtgcctgtaattgctgtttctgtgttcattctctttctacctgttgtcttctaccttagtagctttcttcactcagagcaaaagaaacgcaaactcattctgcccaaacgtctcaagtccagtaccagttttgcaaatattcaggaaaattcaaactgagacctacaaaatggagaattgacatatcacgtgaatgaatggtggaagacacaacttggtttcagaaagaagataaactgtgatttgacaagtcaagctcttaagaaatacaaggacttcagatccatttttaaataagaattttcgatttttctttccttttccacttctttctaacagatttggatatttttaatttccaggcatagcaatgttatctattttaatgtgtatttgtcacaataacagaacatgcaagaacaatcattattttattttataggcatttgattactattctagacttctggtatcttcttactaacataaatatctcaagtagaaaagtttttgaaaactaacatttaaaaattaatcagttacagtaaagactttgaaaaagaaatgtacttgttaggaagtagcttaattaccccccattgcagtattattgttatatatatagttaatatgttgtacatcacaataatatataattcagtctctagtttccctagagtcatttttgaaaccactgattgcaaacctccctgacaatttttaaaagtagtaagccacattacatttatctttgtaaaaagatttatggtaactggtttcttacttgacttttataaatagtattttacatcttatttttgcctttatttcataagtaatttaaaaatcactggattgctttattatattcagggcaatatggattatttttataccaaggatttgcatcgtgaattacattaagttatttggcaatttataatttattactactttaaatcaaatgtagcattatcacactgtatttaaattgtcattttttaaaggaatattttcttcttaagatatatagaggattttggagaagagagacaggaggggtaaaaccagcttaaggttcagcgagcagaaagggacctgagaggatgctcactgtaagactgttggacagtggtgtgtattgaggggatgaatcggaacgatagtctcatgcagaaaatagtgagattaagatcatccttattgtttctaaattatttcaatcagatgaaagtgatacgattgaaatgaaatcacatagttcgtgctcagaaattctattttggtatgtttgtattagcctttagaaaaaacactccgtttcagaattgttcacagttttatttcttaggtttttagagttcaggatttcatttattaatttcttcttgcttttttggtggaaataggctttgttgtaaacattaagaatataaaatctcctctatatagaaacaagaattttgttaaaaagagaatttgaatcccttcctatactataaaatgctctatagggagacaaagtgtttcttttttcttttatgtttactgtttatgtggagtgaaatataaggctcttggatgtataacatactcaaaagctgttacactttctctgatctgctgtgatccactgaaaatgtgctggggtttgttctgctgtcactgtttatgctgctggaacttagcactgtcttgatttgaagcatatgattgagagccatttgaagcaatcttcattaatgcagataaaacaagtttacatgtgcagagttagaaaatgacatgttcaattctgtaagtggtgactttttgagcacctttcagtattatgtatttgtaaaaaccattgtttttggatataaagctaataagcactttaaaaaggaaaaggcagcctttactattttttctggttgagtcattgctctttagacctagcatcagcaatagatttcaaagataagtattaagcgctaccctaaagtgtgtaagtttttcattttgtcatattgaaaaatgatttgcatagtactgaatgttgacacacagcttatatgtatttacaagaatatctttaagtgtttttttgacacattaaaataaaggataaggaaattgtaagctttatttggatttttaaatacatttttaaaatttcagatgtaatttaacatcacatttgtttttcaggtattgagtttagatgcctacttttatgagtaccatcagctggacacagtgtctcatacctgtatttgcagcactttgggaggctgaagcagatcgctggagcttatgagttcgagaccagcctggacaacatagtgaaacactgtctctgcaaaaaatacaaaaattagctgggtatggtggtaagtgcctgtagtcctagctacttgggaggctgagatgggaggatgtcttgagcccgggaggtggaggttgcaatgagccaagattgtaccactgcattccaacctgggcgacagagccagaccttgtct

SEQ ID NO: 63509 - DNA, 4140 bp, Homo sapiens
ctctcggcctgcgggctcgcggaaaccggaagcggcggctgtccgcggtgccggctgggggcggagaggcggcggtgggctccctggggtgtgtgagcccggtgatggagccgggcccgacagccgcgcagcggaggtgttcgttgccgccgtggctgccgctggggctgctgctgtggtcggggctggccctgggcgcgctccccttcggcagcagtccgcacagggtcttccacgacctcctgtcggagcagcagttgctggaggtggaggacttgtccctgtccctcctgcagggtggagggctggggcctctgtcgctgcccccggacctgccggatctggatcctgagtgccgggagctcctgctggacttcgccaacagcagcgcagagctgacagggtgtctggtgcgcagcgcccggcccgtgcgcctctgtcagacctgctaccccctcttccaacaggtcgtcagcaagatggacaacatcagccgagccgcggggaatacttcagagagtcagagttgtgccagaagtctcttaatggcagatagaatgcaaatagttgtgattctctcagaattttttaataccacatggcaggaggcaaattgtgcaaattgtttaacaaacaacagtgaagaattatcaaacagcacagtatatttccttaatctatttaatcacaccctgacctgctttgaacataaccttcaggggaatgcacatagtcttttacagacaaaaaattattcagaagtatgcaaaaactgccgtgaagcatacaaaactctgagtagtctgtacagtgaaatgcaaaaaatgaatgaacttgagaataaggctgaacctggaacacatttatgcattgatgtggaagatgcatgacacagtgcctgtaattgctgtttctgtgttcattctctttctacctgttgtcttctaccttagtagctttcttcactcagagcaaaagaaacgcaaactcattctgcccaaacgtctcaagtccagtaccagttttgcaaatattcaggaaaattcaaactgagacctacaaaatggagaattgacatatcacgtgaatgaatggtggaagacacaacttggtttcagaaagaagataaactgtgatttgacaagtcaagctcttaagaaatacaaggacttcagatccatttttaaataagaattttcgatttttctttccttttccacttctttctaacagatttggatatttttaatttccaggcatagcaatgttatctattttaatgtgtatttgtcacaataacagaacatgcaagaacaatcattattttattttataggcatttgattactattctagacttctggtatcttcttactaacataaatatctcaagtagaaaagtttttgaaaactaacatttaaaaattaatcagttacagtaaagactttgaaaaagaaatgtacttgttaggaagtagcttaattaccccccattgcagtattattgttatatatatagttaatatgttgtacatcacaataatatataattcagtctctagtttccctagagtcatttttgaaaccactgattgcaaacctccctgacaatttttaaaagtagtaagccacattacatttatctttgtaaaaagatttatggtaactggtttcttacttgacttttataaatagtattttacatcttatttttgcctttatttcataagtaatttaaaaatcactggattgctttattatattcagggcaatatggattatttttataccaaggatttgcatcgtgaattacattaagttatttggcaatttataatttattactactttaaatcaaatgtagcattatcacactgtatttaaattgtcattttttaaaggaatattttcttcttaagatatatagaggattttggagaagagagacaggaggggtaaaaccagcttaaggttcagcgagcagaaagggacctgagaggatgctcactgtaagactgttggacagtggtgtgtattgaggggatgaatcggaacgatagtctcatgcagaaaatagtgagattaagatcatccttattgtttctaaattatttcaatcagatgaaagtgatacgattgaaatgaaatcacatagttcgtgctcagaaattctattttggtatgtttgtattagcctttagaaaaaacactccgtttcagaattgttcacagttttatttcttaggtttttagagttcaggatttcatttattaatttcttcttgcttttttggtggaaataggctttgttgtaaacattaagaatataaaatctcctctatatagaaacaagaattttgttaaaaagagaatttgaatcccttcctatactataaaatgctctatagggagacaaagtgtttcttttttcttttatgtttactgtttatgtggagtgaaatataaggctcttggatgtataacatactcaaaagctgttacactttctctgatctgctgtgatccactgaaaatgtgctggggtttgttctgctgtcactgtttatgctgctggaacttagcactgtcttgatttgaagcatatgattgagagccatttgaagcaatcttcattaatgcagataaaacaagtttacatgtgcagagttagaaaatgacatgttcaattctgtaagtggtgactttttgagcacctttcagtattatgtatttgtaaaaaccattgtttttggatataaagctaataagcactttaaaaaggaaaaggcagcctttactattttttctggttgagtcattgctctttagacctagcatcagcaatagatttcaaagataagtattaagcgctaccctaaagtgtgtaagtttttcattttgtcatattgaaaaatgatttgcatagtactgaatgttgacacacagcttatatgtatttacaagaatatctttaagtgtttttttgacacattaaaataaaggataaggaaattgtaagctttatttggatttttaaatacatttttaaaatttcagatgtaatttaacatcacatttgtttttcaggtattgagtttagatgcctacttttatgagtaccatcagctggacacagtgtctcatacctgtatttgcagcactttgggaggctgaagcagatcgctggagcttatgagttcgagaccagcctggacaacatagtgaaacactgtctctgcaaaaaatacaaaaattagctgggtatggtgagacagtgtctcactatgttgcccaaggctggtcttgaactcctgagttcaagagatcctcctgccttagcctcccaaagtgctgggattacaagcataagcaccacacctggctgaacatcagatattttaaagtgtagcccagagtctagttggtaaatgttacttatattgggactagtattttctaatgtttctgggatatgctccctataaaatgaaatgttttcctggaacaatgctaattaggattgcattcctggccaaagacatgacatcaaataagtaatagacatcaccagcaatgaattttgaaaagcaaaaaatactattaacctatataaccatttaaaatttaaaaaattatgttccaagtacctctattttctgagctagaagaaaccttagaggccatctgatgatagattcccagagctggatggatccctagggactacctaatctgactttctgtccactgcatggattcttctaaaaagtatgtcacttatttccctaccttattaagactaaataagtggaacatcatagagctctttatttataacagtcattctttgatagtcaactcttaaatggagacttgagatgcttaaatattgtactactgtgcttatcttgtaaagatttcataaaatgatagtattggttattttaaaaaggctttggcttatgctgaattatacatgtagcaccaaaatgttacaactctactaaatttccttgttctaaactattatattagctataataaatattagtcatacatgtaacatgtttaatgacaaataactttctttatctccttggaattaaagagggcttttaaaagataaaaaaactgatccat

SEQ ID NO: 63510 - DNA, 2480 bp, Homo sapiens
ccctatgaaacctgtaggcgtcggcgatcgatgcacgcgtcgattattacatctttgcctattcaataagtaatttaaaaatcactggattgctttattatattcagggcaatatggattatttttataccaaggatttgcatcgtgaattacattaagttatttggcaatttataatttattactactttaaatcaaatgtagcattatcacactgtatttaaattgtcattttttaaaggaatattttcttcttaagatatatagaggattttggagaagagagacaggaggggtaaaaccagcttaaggttcagcgagcagaaagggacctgagaggatgctcactgtaagactgttggacagtggtgtgtattgaggggatgaatcggaacgatagtctcatgcagaaaatagtgagattaagatcatccttattgtttctaaattatttcaatcagatgaaagtgatacgattgaaatgaaatcacatagttcgtgctcagaaattctattttggtatgtttgtattagcctttagaaaaaacactccgtttcagaattgttcacagttttatttcttaggtttttagagttcaggatttcatttattaatttcttcttgcttttttggtggaaataggctttgttgtaaacattaagaatataaaatctcctctatatagaaacaagaattttgttaaaaagagaatttgaatcccttcctatactataaaatgctctatagggagacaaagtgtttcttttttcttttatgtttactgtttatgtggagtgaaatataaggctcttggatgtataacatactcaaaagctgttacactttctctgatctgctgtgatccactgaaaatgtgctggggtttgttctgctgtcactgtttatgctgctggaacttagcactgtcttgatttgaagcatatgattgagagccatttgaagcaatcttcattaatgcagataaaacaagtttacatgtgcagagttagaaaatgacatgttcaattctgtaagtggtgactttttgagcacctttcagtattatgtatttgtaaaaaccattgtttttggatataaagctaataagcactttaaaaaggaaaaggcagcctttactattttttctggttgagtcattgctctttagacctagcatcagcaatagatttcaaagataagtattaagcgctaccctaaagtgtgtaagtttttcattttgtcatattgaaaaatgatttgcatagtactgaatgttgacacacagcttatatgtatttacaagaatatctttaagtgtttttttgacacattaaaataaaggataaggaaattgtaagctttatttggatttttaaatacatttttaaaatttcagatgtaatttaacatcacatttgtttttcaggtattgagtttagatgcctacttttatgagtaccatcagctggacacagtgtctcatacctgtatttgcagcactttgggaggctgaagcagatcgctggagcttatgagttcgagaccagcctggacaacatagtgaaacactgtctctgcaaaaaatacaaaaattagctgggtatggtgagacagtgtctcactatgttgcccaaggctggtcttgaactcctgagttcaagagatcctcctgccttagcctcccaaagtgctgggattacaagcataagcaccacacctggctgaacatcagatattttaaagtgtagcccagagtctagttggtaaatgttacttatattgggactagtattttctaatgtttctgggatatgctccctataaaatgaaatgttttcctggaacaatgctaattaggattgcattcctggccaaagacatgacatcaaataagtaatagacatcaccagcaatgaattttgaaaagcaaaaaatactattaacctatataaccatttaaaatttaaaaaattatgttccaagtacctctattttctgagctagaagaaaccttagaggccatctgatgatagattcccagagctggatggatccctagggactacctaatctgactttctgtccactgcatggattcttctaaaaagtatgtcacttatttccctaccttattaagactaaataagtggaacatcatagagctctttatttataacagtcattctttgatagtcaactcttaaatggagacttgagatgcttaaatattgtactactgtgcttatcttgtaaagatttcataaaatgatagtattggttattttaaaaaggctttggcttatgctgaattatacatgtagcaccaaaatgttacaactctactaaatttccttgttctaaactattatattagctataataaatattagtcatacatgtaacatgtttaatgacaaataactttctttatctccttggaattaaagagggcttttaaaagataaaaaaactgatccat

SEQ ID NO: 63511 - DNA, 700 bp, Homo sapiens
cctcttccaacaggtcgtcagcaagatggacaacatcagccgagccgcgggggtgggtacaggaccacgtccgggactgtggctcaggagagttgggaaaggaggagggtgtaatgatggtcagcgctgggggcctcagtttccccaacagtaagaaaaaggggttggactgagtctgtagagttgggtcatcagaaaaagggggtggcattatggggcttgggatttgggtttttgcttccaagaatgctgttggacatctttggttcatataggtgtgattggttttcttgggggtcctgattccccaaccctcttgctcttcctccacccactccaccacggcttcttctcatcttcacctggagttgccaggaaggatccttttctgaaacaagtggggtggagacactggtagtggttagaaatttgagctttgtagccagaaatgttcatgtccaccaacttctaactatgtaaccttggattaattatcttctcagaaccttagtttcctcctctataaagtggaaagaacatctgcctaatgcggctgttggaagaattaaaagagatattgcctgtgacttcatcttagtgatgtgaacagtctggagctagctagcggccaggactccagttccactctgcttattagcggtatactatgggcaagttacttacattctctgtgcctgtt

SEQ ID NO: 63512 - DNA, 4196 bp, Homo sapiens
ctctcggcctgcgggctcgcggaaaccggaagcggcggctgtccgcggtgccggctgggggcggagaggcggcggtgggctccctggggtgtgtgagcccggtgatggagccgggcccgacagccgcgcagcggaggtgttcgttgccgccgtggctgccgctggggctgctgctgtggtcggggctggccctgggcgcgctccccttcggcagcagtccgcacagggtcttccacgacctcctgtcggagcagcagttgctggaggtggaggacttgtccctgtccctcctgcagggtggagggctggggcctctgtcgctgcccccggacctgccggatctggatcctgagtgccgggagctcctgctggacttcgccaacagcagcgcagagctgacagggtgtctggtgcgcagcgcccggcccgtgcgcctctgtcagacctgctaccccctcttccaacaggtcgtcagcaagatggacaacatcagccgagccgcggggaatacttcagagagtcagagttgtgccagaagtctcttaatggcagatagaatgcaaatagttgtgattctctcagaattttttaataccacatggcaggaggcaaattgtgcaaattgtttaacaaacaacagtgaagaattatcaaacagcacagtatatttccttaatctatttaatcacaccctgacctgctttgaacataaccttcaggggaatgcacatagtcttttacagacaaaaaattattcagaagtatgcaaaaactgccgtgaagcatacaaaactctgagtagtctgtacagtgaaatgcaaaaaatgaatgaacttgagaataaggctgaacctggaacacatttatgcattgatgtggaagatgcaatgaacatcactcgaaaactatggagtcgaactttcaactgttcagtcccttgcagtgacacagtgcctgtaattgctgtttctgtgttcattctctttctacctgttgtcttctaccttagtagctttcttcactcagagcaaaagaaacgcaaactcattctgcccaaacgtctcaagtccagtaccagttttgcaaatattcaggaaaattcaaactgagacctacaaaatggagaattgacatatcacgtgaatgaatggtggaagacacaacttggtttcagaaagaagataaactgtgatttgacaagtcaagctcttaagaaatacaaggacttcagatccatttttaaataagaattttcgatttttctttccttttccacttctttctaacagatttggatatttttaatttccaggcatagcaatgttatctattttaatgtgtatttgtcacaataacagaacatgcaagaacaatcattattttattttataggcatttgattactattctagacttctggtatcttcttactaacataaatatctcaagtagaaaagtttttgaaaactaacatttaaaaattaatcagttacagtaaagactttgaaaaagaaatgtacttgttaggaagtagcttaattaccccccattgcagtattattgttatatatatagttaatatgttgtacatcacaataatatataattcagtctctagtttccctagagtcatttttgaaaccactgattgcaaacctccctgacaatttttaaaagtagtaagccacattacatttatctttgtaaaaagatttatggtaactggtttcttacttgacttttataaatagtattttacatcttatttttgcctttatttcataagtaatttaaaaatcactggattgctttattatattcagggcaatatggattatttttataccaaggatttgcatcgtgaattacattaagttatttggcaatttataatttattactactttaaatcaaatgtagcattatcacactgtatttaaattgtcattttttaaaggaatattttcttcttaagatatatagaggattttggagaagagagacaggaggggtaaaaccagcttaaggttcagcgagcagaaagggacctgagaggatgctcactgtaagactgttggacagtggtgtgtattgaggggatgaatcggaacgatagtctcatgcagaaaatagtgagattaagatcatccttattgtttctaaattatttcaatcagatgaaagtgatacgattgaaatgaaatcacatagttcgtgctcagaaattctattttggtatgtttgtattagcctttagaaaaaacactccgtttcagaattgttcacagttttatttcttaggtttttagagttcaggatttcatttattaatttcttcttgcttttttggtggaaataggctttgttgtaaacattaagaatataaaatctcctctatatagaaacaagaattttgttaaaaagagaatttgaatcccttcctatactataaaatgctctatagggagacaaagtgtttcttttttcttttatgtttactgtttatgtggagtgaaatataaggctcttggatgtataacatactcaaaagctgttacactttctctgatctgctgtgatccactgaaaatgtgctggggtttgttctgctgtcactgtttatgctgctggaacttagcactgtcttgatttgaagcatatgattgagagccatttgaagcaatcttcattaatgcagataaaacaagtttacatgtgcagagttagaaaatgacatgttcaattctgtaagtggtgactttttgagcacctttcagtattatgtatttgtaaaaaccattgtttttggatataaagctaataagcactttaaaaaggaaaaggcagcctttactattttttctggttgagtcattgctctttagacctagcatcagcaatagatttcaaagataagtattaagcgctaccctaaagtgtgtaagtttttcattttgtcatattgaaaaatgatttgcatagtactgaatgttgacacacagcttatatgtatttacaagaatatctttaagtgtttttttgacacattaaaataaaggataaggaaattgtaagctttatttggatttttaaatacatttttaaaatttcagatgtaatttaacatcacatttgtttttcaggtattgagtttagatgcctacttttatgagtaccatcagctggacacagtgtctcatacctgtatttgcagcactttgggaggctgaagcagatcgctggagcttatgagttcgagaccagcctggacaacatagtgaaacactgtctctgcaaaaaatacaaaaattagctgggtatggtgagacagtgtctcactatgttgcccaaggctggtcttgaactcctgagttcaagagatcctcctgccttagcctcccaaagtgctgggattacaagcataagcaccacacctggctgaacatcagatattttaaagtgtagcccagagtctagttggtaaatgttacttatattgggactagtattttctaatgtttctgggatatgctccctataaaatgaaatgttttcctggaacaatgctaattaggattgcattcctggccaaagacatgacatcaaataagtaatagacatcaccagcaatgaattttgaaaagcaaaaaatactattaacctatataaccatttaaaatttaaaaaattatgttccaagtacctctattttctgagctagaagaaaccttagaggccatctgatgatagattcccagagctggatggatccctagggactacctaatctgactttctgtccactgcatggattcttctaaaaagtatgtcacttatttccctaccttattaagactaaataagtggaacatcatagagctctttatttataacagtcattctttgatagtcaactcttaaatggagacttgagatgcttaaatattgtactactgtgcttatcttgtaaagatttcataaaatgatagtattggttattttaaaaaggctttggcttatgctgaattatacatgtagcaccaaaatgttacaactctactaaatttccttgttctaaactattatattagctataataaatattagtcatacatgtaacatgtttaatgacaaataactttctttatctccttggaattaaagagggcttttaaaagataaaaaaactgatccat

SEQ ID NO: 63513 - DNA, 4353 bp, Homo sapiens
ctctcggcctgcgggctcgcggaaaccggaagcggcggctgtccgcggtgccggctgggggcggagaggcggcggtgggctccctggggtgtgtgagcccggtgatggagccgggcccgacagccgcgcagcggaggtgttcgttgccgccgtggctgccgctggggctgctgctgtggtcggggctggccctgggcgcgctccccttcggcagcagtccgcacagggtcttccacgacctcctgtcggagcagcagttgctggaggtggaggacttgtccctgtccctcctgcagggtggagggctggggcctctgtcgctgcccccggacctgccggatctggatcctgagtgccgggagctcctgctggacttcgccaacagcagcgcagagctgacagggtgtctggtgcgcagcgcccggcccgtgcgcctctgtcagacctgctaccccctcttccaacaggtcgtcagcaagatggacaacatcagccgagccgcggggaaccttagtttcctcctctataaagtggaaagaacatctgcctaatgcggctgttggaagaattaaaagagatattgcctgtgacttcatcttagtgatgtgaacagtctggagctagctagcggccaggactccagttccactctgcttattagcgaatacttcagagagtcagagttgtgccagaagtctcttaatggcagatagaatgcaaatagttgtgattctctcagaattttttaataccacatggcaggaggcaaattgtgcaaattgtttaacaaacaacagtgaagaattatcaaacagcacagtatatttccttaatctatttaatcacaccctgacctgctttgaacataaccttcaggggaatgcacatagtcttttacagacaaaaaattattcagaagtatgcaaaaactgccgtgaagcatacaaaactctgagtagtctgtacagtgaaatgcaaaaaatgaatgaacttgagaataaggctgaacctggaacacatttatgcattgatgtggaagatgcaatgaacatcactcgaaaactatggagtcgaactttcaactgttcagtcccttgcagtgacacagtgcctgtaattgctgtttctgtgttcattctctttctacctgttgtcttctaccttagtagctttcttcactcagagcaaaagaaacgcaaactcattctgcccaaacgtctcaagtccagtaccagttttgcaaatattcaggaaaattcaaactgagacctacaaaatggagaattgacatatcacgtgaatgaatggtggaagacacaacttggtttcagaaagaagataaactgtgatttgacaagtcaagctcttaagaaatacaaggacttcagatccatttttaaataagaattttcgatttttctttccttttccacttctttctaacagatttggatatttttaatttccaggcatagcaatgttatctattttaatgtgtatttgtcacaataacagaacatgcaagaacaatcattattttattttataggcatttgattactattctagacttctggtatcttcttactaacataaatatctcaagtagaaaagtttttgaaaactaacatttaaaaattaatcagttacagtaaagactttgaaaaagaaatgtacttgttaggaagtagcttaattaccccccattgcagtattattgttatatatatagttaatatgttgtacatcacaataatatataattcagtctctagtttccctagagtcatttttgaaaccactgattgcaaacctccctgacaatttttaaaagtagtaagccacattacatttatctttgtaaaaagatttatggtaactggtttcttacttgacttttataaatagtattttacatcttatttttgcctttatttcataagtaatttaaaaatcactggattgctttattatattcagggcaatatggattatttttataccaaggatttgcatcgtgaattacattaagttatttggcaatttataatttattactactttaaatcaaatgtagcattatcacactgtatttaaattgtcattttttaaaggaatattttcttcttaagatatatagaggattttggagaagagagacaggaggggtaaaaccagcttaaggttcagcgagcagaaagggacctgagaggatgctcactgtaagactgttggacagtggtgtgtattgaggggatgaatcggaacgatagtctcatgcagaaaatagtgagattaagatcatccttattgtttctaaattatttcaatcagatgaaagtgatacgattgaaatgaaatcacatagttcgtgctcagaaattctattttggtatgtttgtattagcctttagaaaaaacactccgtttcagaattgttcacagttttatttcttaggtttttagagttcaggatttcatttattaatttcttcttgcttttttggtggaaataggctttgttgtaaacattaagaatataaaatctcctctatatagaaacaagaattttgttaaaaagagaatttgaatcccttcctatactataaaatgctctatagggagacaaagtgtttcttttttcttttatgtttactgtttatgtggagtgaaatataaggctcttggatgtataacatactcaaaagctgttacactttctctgatctgctgtgatccactgaaaatgtgctggggtttgttctgctgtcactgtttatgctgctggaacttagcactgtcttgatttgaagcatatgattgagagccatttgaagcaatcttcattaatgcagataaaacaagtttacatgtgcagagttagaaaatgacatgttcaattctgtaagtggtgactttttgagcacctttcagtattatgtatttgtaaaaaccattgtttttggatataaagctaataagcactttaaaaaggaaaaggcagcctttactattttttctggttgagtcattgctctttagacctagcatcagcaatagatttcaaagataagtattaagcgctaccctaaagtgtgtaagtttttcattttgtcatattgaaaaatgatttgcatagtactgaatgttgacacacagcttatatgtatttacaagaatatctttaagtgtttttttgacacattaaaataaaggataaggaaattgtaagctttatttggatttttaaatacatttttaaaatttcagatgtaatttaacatcacatttgtttttcaggtattgagtttagatgcctacttttatgagtaccatcagctggacacagtgtctcatacctgtatttgcagcactttgggaggctgaagcagatcgctggagcttatgagttcgagaccagcctggacaacatagtgaaacactgtctctgcaaaaaatacaaaaattagctgggtatggtgagacagtgtctcactatgttgcccaaggctggtcttgaactcctgagttcaagagatcctcctgccttagcctcccaaagtgctgggattacaagcataagcaccacacctggctgaacatcagatattttaaagtgtagcccagagtctagttggtaaatgttacttatattgggactagtattttctaatgtttctgggatatgctccctataaaatgaaatgttttcctggaacaatgctaattaggattgcattcctggccaaagacatgacatcaaataagtaatagacatcaccagcaatgaattttgaaaagcaaaaaatactattaacctatataaccatttaaaatttaaaaaattatgttccaagtacctctattttctgagctagaagaaaccttagaggccatctgatgatagattcccagagctggatggatccctagggactacctaatctgactttctgtccactgcatggattcttctaaaaagtatgtcacttatttccctaccttattaagactaaataagtggaacatcatagagctctttatttataacagtcattctttgatagtcaactcttaaatggagacttgagatgcttaaatattgtactactgtgcttatcttgtaaagatttcataaaatgatagtattggttattttaaaaaggctttggcttatgctgaattatacatgtagcaccaaaatgttacaactctactaaatttccttgttctaaactattatattagctataataaatattagtcatacatgtaacatgtttaatgacaaataactttctttatctccttggaattaaagagggcttttaaaagataaaaaaactgatccat

SEQ ID NO: 63514 - DNA, 4149 bp, Homo sapiens
ctctcggcctgcgggctcgcggaaaccggaagcggcggctgtccgcggtgccggctgggggcggagaggcggcggtgggctccctggggtgtgtgagcccggtgatggagccgggcccgacagccgcgcagcggaggtgttcgttgccgccgtggctgccgctggggctgctgctgtggtcggggctggccctgggcgcgctccccttcggcagcagtccgcacagggtcttccacgacctcctgtcggagcagcagttgctggaggtggaggacttgtccctgtccctcctgcagggtggagggctggggcctctgtcgctgcccccggacctgccggatctggatcctgagtgccgggagctcctgctggacttcgccaacagcagcgcagagctgacagggtgtctggtgcgcagcgcccggcccgtgcgcctctgtcagacctgctaccccctcttccaacaggtcgtcagcaagatggacaacatcagccgagccgcggggaatacttcagagagtcagagttgtgccagaagtctcttaatggcagatagaatgcaaatagttgtgattctctcagaattttttaataccacatggcaggaggcaaattgtgcaaattgtttaacaaacaacagtgaagaattatcaaacagcacagtatatttccttaatctatttaatcacaccctgacctgctttgaacataaccttcaggggaatgcacatagtcttttacagacaaaaaattattcagaagtatgcaaaaactgccgtgaagcatacaaaactctgagtagtctgtacagtgaaatgcaaaaaatgaatgaacttgagaataaggctgaacctggaacacatttatgcattgatgtggaagatgcaatgaacatcactcgaaaactatggagtcgaactttcaactgttcagtcccttgcagtgacacagtgcctgtaattgctgtttctgtgttcattctctttctacctgttgtcttctaccttagtagctttcttcactcagagcaaaagaaacgcaaactcattctgcccaaacgtctcaagtccagtaccagttttgcaaatattcaggaaaattcaaactgagacctacaaaatggagaattgacatatcacgtgaatgaatggtggaagacacaacttggtttcagaaagaagataaactgtgatttgacaagtcaagctcttaagaaatacaaggacttcagatccatttttaaataagaattttcgatttttctttccttttccacttctttctaacagatttggatatttttaatttccaggcatagcaatgttatctattttaatgtgtatttgtcacaataacagaacatgcaagaacaatcattattttattttataggcatttgattactattctagacttctggtatcttcttactaacataaatatctcaagtagaaaagtttttgaaaactaacatttaaaaattaatcagttacagtaaagactttgaatattattgttatatatatagttaatatgttgtacatcacaataatatataattcagtctctagtttccctagagtcatttttgaaaccactgattgcaaacctccctgacaatttttaaaagtagtaagccacattacatttatctttgtaaaaagatttatggtaactggtttcttacttgacttttataaatagtattttacatcttatttttgcctttatttcataagtaatttaaaaatcactggattgctttattatattcagggcaatatggattatttttataccaaggatttgcatcgtgaattacattaagttatttggcaatttataatttattactactttaaatcaaatgtagcattatcacactgtatttaaattgtcattttttaaaggaatattttcttcttaagatatatagaggattttggagaagagagacaggaggggtaaaaccagcttaaggttcagcgagcagaaagggacctgagaggatgctcactgtaagactgttggacagtggtgtgtattgaggggatgaatcggaacgatagtctcatgcagaaaatagtgagattaagatcatccttattgtttctaaattatttcaatcagatgaaagtgatacgattgaaatgaaatcacatagttcgtgctcagaaattctattttggtatgtttgtattagcctttagaaaaaacactccgtttcagaattgttcacagttttatttcttaggtttttagagttcaggatttcatttattaatttcttcttgcttttttggtggaaataggctttgttgtaaacattaagaatataaaatctcctctatatagaaacaagaattttgttaaaaagagaatttgaatcccttcctatactataaaatgctctatagggagacaaagtgtttcttttttcttttatgtttactgtttatgtggagtgaaatataaggctcttggatgtataacatactcaaaagctgttacactttctctgatctgctgtgatccactgaaaatgtgctggggtttgttctgctgtcactgtttatgctgctggaacttagcactgtcttgatttgaagcatatgattgagagccatttgaagcaatcttcattaatgcagataaaacaagtttacatgtgcagagttagaaaatgacatgttcaattctgtaagtggtgactttttgagcacctttcagtattatgtatttgtaaaaaccattgtttttggatataaagctaataagcactttaaaaaggaaaaggcagcctttactattttttctggttgagtcattgctctttagacctagcatcagcaatagatttcaaagataagtattaagcgctaccctaaagtgtgtaagtttttcattttgtcatattgaaaaatgatttgcatagtactgaatgttgacacacagcttatatgtatttacaagaatatctttaagtgtttttttgacacattaaaataaaggataaggaaattgtaagctttatttggatttttaaatacatttttaaaatttcagatgtaatttaacatcacatttgtttttcaggtattgagtttagatgcctacttttatgagtaccatcagctggacacagtgtctcatacctgtatttgcagcactttgggaggctgaagcagatcgctggagcttatgagttcgagaccagcctggacaacatagtgaaacactgtctctgcaaaaaatacaaaaattagctgggtatggtgagacagtgtctcactatgttgcccaaggctggtcttgaactcctgagttcaagagatcctcctgccttagcctcccaaagtgctgggattacaagcataagcaccacacctggctgaacatcagatattttaaagtgtagcccagagtctagttggtaaatgttacttatattgggactagtattttctaatgtttctgggatatgctccctataaaatgaaatgttttcctggaacaatgctaattaggattgcattcctggccaaagacatgacatcaaataagtaatagacatcaccagcaatgaattttgaaaagcaaaaaatactattaacctatataaccatttaaaatttaaaaaattatgttccaagtacctctattttctgagctagaagaaaccttagaggccatctgatgatagattcccagagctggatggatccctagggactacctaatctgactttctgtccactgcatggattcttctaaaaagtatgtcacttatttccctaccttattaagactaaataagtggaacatcatagagctctttatttataacagtcattctttgatagtcaactcttaaatggagacttgagatgcttaaatattgtactactgtgcttatcttgtaaagatttcataaaatgatagtattggttattttaaaaaggctttggcttatgctgaattatacatgtagcaccaaaatgttacaactctactaaatttccttgttctaaactattatattagctataataaatattagtcatacatgtaacatgtttaatgacaaataactttctttatctccttggaattaaagagggcttttaaaagataaaaaaactgatccat

SEQ ID NO: 63515 - DNA, 3596 bp, Homo sapiens
tgttgtttctgaaagagcacaggttggcccacctggatgtctgggcaccttcctctgaggtgatgcaaaggggccactcaatgggtccttgctcaaaatgctccagccttactggccttcttcccattcctgaatgcaccaagttagtcctgtcccagggcctttgcacgtgctggttttgctgccttgagcttcctacaggaatggtggctggttcctcccttctcatccttcacatttccttagacgccaccttctccgaaagtgccatctcttactaccctaaaggtctttttattttcttatttcagtgtccattcccttatttgtgatcgcctaattattttacttatttcttgttttgtttgcgtcctctttcattctgttagctccatgtaagcaggggtccgttttgctttattcagaactgtatactcaatgcccagtacagagtaggtctcaaaacatatttgttaaatgaatgacgtggcagctccacaattccaagtaaccaatgacacctaaagttgtttccccatgaagtctctgtcttttgggttccgtgcatcgggctgggctcacaggctgcgggaacttccttcccactgcctgttttccttggatcgcggtatctctcttcctggaggaaaaaggctcttatgacctcatggcgcgctctcccgagccgcagtgacgtcattaatgcgctcacgcgtcacagcccaatcatagggcccttcccctccctttagaagtcccgactgtccctgacacattccactccaagcgagccgcgacacttacgtcacgtccgcccgcccgcgcggtgatgacgtcacgacccagggctggcgtcacgtgtcccccccgcggggggcggcccttgagggcggcgcttccggtcggcggagcctggtggccgcagcggcggtggcgacgacggccgagacgtggggatggcgggcgccgggagcgaagcccggttcgccgggctgtcgctggtgcagctcaacgagctgctggaggacgagggccagctgacggagatggtgcagaagatggaggagacacagaatgttcagcttaacaaagaaatgacacttgccagcaaccggagcctggcagaaggaaaccttttgtaccagccccagctggacacgttgaaagcacgcttgacccagaaataccaggaactccaggttctctttgaagcctatcagataaagaagaccaaattagacagacagtctagcagtgcttccttggagaccctgttagcacttcttcaggcagaaggggccaagattgaggaagacactgagaacatggcagagaagtttctggatggagaacttcctctggattccttcattgatgtctatcagagcaaacggaaactggcccacatgcgacgggtgaaaatcgagaagctccaggagatggtcctaaaggggcagagactcccacaggccctggccccgctgccccccaggctgcccgaactggcacctaccgccccccttccctaccctgccccagaggccagtgggcctcctgccgttgcacctcggcgcatcccccccccaccacccccggtgcctgcgggacgcttagccaccccgtttactgcggccatgagttcgggacaggccgtgccgtacccaggattacagtgcccgcccctgcccccccgcgtgggcctccccactcagcaaggattctcttcgcagttcgtgtccccatatccgccacctctccctcagagacccccgccccggctccctccacaccagccgggtttcatcctccagtgagcgccggcgcggtccttcccgggagacttcttccacctggcgtgttgtgctctgctcacgggaaggaggctggaggtccgctctgtgccaagggctctggggccctgggccagcgtgtctgtctgattttagaactgtaggtcagtggtgagtagtaggagcccaggctttgggcatcaaggcagttgtgtgtgccgggttacagcctgacacctgtgcgttgcatcggtttgcattatccgtgtgatttctaagtatcttagcgttgatgaactcatgtttgggaagaaataggcctctcccccagtcccatttagaatcgtggtccttctgttgcagctttatttaatgagcatggttcatgatacttattttattttcgaaagacagtcctatgtgtctcacccaccggccactgcagccctggtgagggcgggtgggcgccggccggcctggaagagcgccgtggctgggccaccacctgtggctgcgttgttgctcactgaatctgttggggagaggtcaccatagtcaccgcctgacctggctgctgctcttgcttcagagccacaagcaaagtttgcactgggcccactgccgagtccagaggccggagaacggccactggtgtgggaggggagcgcacgagtgggactttgcacagcaaattgtgtccccagctcctcctctcccgcctgcctggagccggccctgaaggtttctatgaagaaataatcccccaatatttttactacgtgtgtgattttcctgttttatattgaaaaaacttttttgacactcccaagaccattcagggaaattttataaaaaatgcagatactgtcttgagcagatcgaaatgccgatgaagtggatgcaatttccttttgtgcaagcagtgcacggtgcccccccctcgggtgtccgtgctgtgccttagcttccccaggtgccgggactcacacctgctaggggctgggcaaggccccggctctgctttctctgaagggcttgtccaagttcattgccctgttacaggtggtcaagacgtccggccgccttgacccaggctacccttagccaatatcctctgcccctgggtggctggtggctgggcctcagggtgggcaacgttaggggtttggcgaaagcccgccccatgggattgagggacggggctgcactccaaccgtctgcacctgctcttcccccacccctgtgggacctcatcttcacgtgccatgtgtgctgaaggcccagggcccagcagggggcagtggcacctgttgacggaaaaggccgaggtgcttaccagtggaccttctggcccgcccctcccctgtcacttgtcgggcatccagggccccgacctgtgcctagccgccagggtgacagaaggcagaactgaagcggggtctgggccacgggccaggccactgccttttgtcctcagtgaccatacattcctgctctcggacttgaactctactgtaactgttttcttgaaatgaagctgtacaggacgattcactgccatgccagtcaggcgggcttgccatgttctgtgaatctcgagtgagcggtgccacccgcccccatacctccgccaccggccgctgtcggggatgccacagcctgccacggtcgcagccagacgtgagcttggcattgaagttgcaaagcggcccctggccgggctcgccgtcgctgtccagggccgtgtccggtgctgtggctgtaaagctgtaggaccctttttaataaatagagaattattaataa

SEQ ID NO: 63516 - DNA, 1467 bp, Homo sapiens
ccccagcttttggtcggctttgctcacccaccaacagctaggagctggaaggctcagaagagctggggtgggcatgggagagacagaggaaccccggtggctggaaacacagttccttcccagggtctcttcagcttgctggttggacctcttagcctgcttatgaagcctgaattgacatcatgccaactggtctcctgctgataagtgattccttaacttcctcgggagcagcagaaacttgttttgaaaaaaatcagattctaaatctttacagctgtttacttctgcaagcacaatggccgtagtaaggaattcaagtcacagcgcagcgtggcagggaaggctctgcatggagtcacaggacaaagcctgtcctggaaacgtgctggaaggaagtcggcctcattctttacgacgggcagcagctccaaatgagaaaccaaggggcttggctctggacacagaatgttcagcttaacaaagaaatgacacttgccagcaaccggagcctggcagaaggaaaccttttgtaccagccccagctggacacgttgaaagcacgcttgacccagaaataccaggaactccaggttctctttgaagcctatcagataaagaagaccaaattaggtaactttttaagggtgatcattcgagaataaagagttgagagaaggacacattttcaagctattgccctaccaggaaagaaatattacggaaaaatttcaggttaagatagcgactctactgcaatgaacaaatagcttatgtatattatttatttatttttagagacagggtcttgctctgtcggactggagtgcagtggcgcaaccatggctcagcacgacctcctgggctcaggtgatcctcctgtctcagcctcctgagtggctgggaccacaggtgtgcactaccccaagcaggctagtttttcatttttttgcggagaggttgtcttgctatgttgcccaggctggtcttgaactcaagccatcctcctgcctttgcctcacaaagtgctgctattacagacatgagccactgtattggactagtttatgtatggaatatggagggcccccagacctgcggcctctctgcacttgcggttcgagagggcagggtgtatagcaggactgccccctcctcccagtggccctgactggtggcggtgactgctgaggtcagcccaggtccacacgcacctccagggtctgcagtgtgaagcaggttgcagaaacgtgggtacctcggggcagttaccagaaaaggggctggagattaggaggaagccagccagtttagcagtcaccagtttagaagaggagacttaaccactttttaaattcaagaccccaccttctctaaacagcatagaaaaagctttctgaattatgatattaaacagatgtcttatgacgtttgcccgtttgtcttatgctgtttgttaatggtaaa

SEQ ID NO: 63517 - DNA, 831 bp, Homo sapiens
aaattcaagaccccaccttctctaaacagcatagaaaaagctttctgaattatgatattaaacagatgtcttatgacgtttgcccgtttgtcttatgctgtttgttaatggtaaaaaaaaaaaaaaaaaaagcatcactgaaacactttattttaatggcatactttaatttgcagccattaggaggagacatcagaattaaagattgttgagcatcctaagtgcttttgatagttatcaaagggacatttagataaagtcagactgggaccacaggtgtgcactaccccaagcaggctagtttttcatttttttgcggagaggttgtcttgctatgttgcccaggctggtcttgaactcaagccatcctcctgcctttgcctcacaaagtgctgctattacagacatgagccactgtattggactagtttatgtatggaatatggagggcccccagacctgcggcctctctgcacttgcggttcgagagggcagggtgtatagcaggactgccccctcctcccagtggccctgactggtggcggtgactgctgaggtcagcccaggtccacacgcacctccagggtctgcagtgtgaagcaggttgcagaaacgtgggtacctcggggcagttaccagaaaaggggctggagattaggaggaagccagccagtttagcagtcaccagtttagaagaggagacttaaccactttttaaattcaagaccccaccttctctaaacagcatagaaaaagctttctgaattatgatattaaacagatgtcttatgacgtttgcccgtttgtcttatgctgtttgttaatggtaaa

SEQ ID NO: 63518 - DNA, 3570 bp, Homo sapiens
tgttgtttctgaaagagcacaggttggcccacctggatgtctgggcaccttcctctgaggtgatgcaaaggggccactcaatgggtccttgctcaaaatgctccagccttactggccttcttcccattcctgaatgcaccaagttagtcctgtcccagggcctttgcacgtgctggttttgctgccttgagcttcctacaggaatggtggctggttcctcccttctcatccttcacatttccttagacgccaccttctccgaaagtgccatctcttactaccctaaaggtctttttattttcttatttcagtgtccattcccttatttgtgatcgcctaattattttacttatttcttgttttgtttgcgtcctctttcattctgttagctccatgtaagcaggggtccgttttgctttattcagaactgtatactcaatgcccagtacagagtaggtctcaaaacatatttgttaaatgaatgacgtggcagctccacaattccaagtaaccaatgacacctaaagttgtttccccatgaagtctctgtcttttgggttccgtgcatcgggctgggctcacaggctgcgggaacttccttcccactgcctgttttccttggatcgcggtatctctcttcctggaggaaaaaggctcttatgacctcatggcgcgctctcccgagccgcagtgacgtcattaatgcgctcacgcgtcacagcccaatcatagggcccttcccctccctttagaagtcccgactgtccctgacacattccactccaagcgagccgcgacacttacgtcacgtccgcccgcccgcgcggtgatgacgtcacgacccagggctggcgtcacgtgtcccccccgcggggggcggcccttgagggcggcgcttccggtcggcggagcctggtggccgcagcggcggtggcgacgacggccgagacgtggggatggcgggcgccgggagcgaagcccggttcgccgggctgtcgctggtgcagctcaacgagctgctggaggacgagggccagctgacggagatggtgcagaagatggaggagacacagaatgttcagcttaacaaagaaatgacacttgccagcaaccggagcctggcagaaggaaaccttttgtaccagccccagctggacacgttgaaagcacgcttgacccagaaataccaggaactccaggttctctttgaagcctatcagataaagaagaccaaattagacagacagtctagcagtgcttccttggagaccctgttagcacttcttcaggcagaaggggccaagattgaggaagacactgagaacatggcagagaagtttctggatggagaacttcctctggattccttcattgatgtctatcagagcaaacggaaactggcccacatgcgacgggtgaaaatcgagaagctccaggagatggtcctaaaggggcagagactcccacaggccctggccccgctgccccccaggctgcccgaactggcacctaccgccccccttccctaccctgccccagaggccagtgggcctcctgccgttgcacctcggcgcatcccccccccaccacccccggtgcctgcgggacgcttagccaccccgtttactgcggccatgagttcgggacaggccgtgccgtacccaggattacagtgcccgcccctgcccccccgcgtgggcctccccactcagcaaggattctcttcgcagttcgtgtccccatatccgccacctctccctcagagacccccgccccggctccctccacaccagccgggtttcatcctccagtgagcgccggcgcggtccttcccgggagacttcttccacctggcgtgttgtgctctgctcacgggaaggaggctggaggtccgctctgtgccaagggctctggggccctgggccagcgtgtctgtctgattttagaactgtaggtcagtggtgagtagtaggagcccaggctttgggcatcaaggcagttgtgtgtgccgggttacagcctgacacctgtgcgttgcatcggtttgcattatccgtgtgatttctaagtatcttagcgttgatgaactcatgtttgggaagaaataggcctctcccccagtcccatttagaatcgtggtccttctgttgcagctttatttaatgagcatggttcatgatacttattttattttcgaaagacagtcctatgtgtctcacccaccggccactgcagccctggtgagggcgggtgggcgccggccggcctggaagagcgccgtggctgggccaccacctgtggctgcgttgttgctcactgaatctgttggggagaggtcaccatagtcaccgcctgacctggctgctgctcttgcttcagagccacaagcaaagtttgcactgggcccactgccgagtccagaggccggagaacggccactggtgtgggaggggagcgcacgagtgggactttgcacagcaaattgtgtccccagctcctcctctcccgcctgcctggagccggccctgaaggtttctatgaagaaataatcccccaatatttttactacgtgtgtgattttcctgttttatattgaaaaaacttttttgacactcccaagaccattcagggaaattttataaaaaatgcagatactgtcttgagcagatcgaaatgccgatgaagtggatgcaatttccttttgtgcaagcagtgcacggtgcccccccctcgggtgtccgtgctgtgccttagcttccccaggtgccgggactcacacctgctaggggctgggcaaggccccggctctgctttctctgaagggcttgtccaagttcattgccctgttacaggtggtcaagacgtccggccgccttgacccaggctacccttagccaatatcctctgcccctgggtggctggtggctgggcctcagggtgggcaacgttaggggtttggcgaaagcccgccccatgggattgagggacggggctgcactccaaccgtctgcacctgctcttcccccacccctgtgggacctcatcttcacgtgccatgtgtgctgaaggcccagggcccagcagggggcagtggcacctgttgacggaaaaggccgaggtgcttaccagtggaccttctggcccgcccctcccctgtcacttgtcgggcatccagggccccgacctgtgcctagccgccagggtgacagaaggcagaactgaagcggggtctgggccacgggccaggccactgccttttgtcctcagtgaccatacattcctgctctcggacttgaactctactgtaactgttttcttgaaatgaagctgtacaggacgattcactgccatgccagtcaggcgggcttgccatgttctgtgaatctcgagtgagcgaccggccgctgtcggggatgccacagcctgccacggtcgcagccagacgtgagcttggcattgaagttgcaaagcggcccctggccgggctcgccgtcgctgtccagggccgtgtccggtgctgtggctgtaaagctgtaggaccctttttaataaatagagaattattaataa

SEQ ID NO: 63519 - DNA, 2862 bp, Homo sapiens
tgttgtttctgaaagagcacaggttggcccacctggatgtctgggcaccttcctctgaggtgatgcaaaggggccactcaatgggtccttgctcaaaatgctccagccttactggccttcttcccattcctgaatgcaccaagttagtcctgtcccagggcctttgcacgtgctggttttgctgccttgagcttcctacaggaatggtggctggttcctcccttctcatccttcacatttccttagacgccaccttctccgaaagtgccatctcttactaccctaaaggtctttttattttcttatttcagtgtccattcccttatttgtgatcgcctaattattttacttatttcttgttttgtttgcgtcctctttcattctgttagctccatgtaagcaggggtccgttttgctttattcagaactgtatactcaatgcccagtacagagtaggtctcaaaacatatttgttaaatgaatgacgtggcagctccacaattccaagtaaccaatgacacctaaagttgtttccccatgaagtctctgtcttttgggttccgtgcatcgggctgggctcacaggctgcgggaacttccttcccactgcctgttttccttggatcgcggtatctctcttcctggaggaaaaaggctcttatgacctcatggcgcgctctcccgagccgcagtgacgtcattaatgcgctcacgcgtcacagcccaatcatagggcccttcccctccctttagaagtcccgactgtccctgacacattccactccaagcgagccgcgacacttacgtcacgtccgcccgcccgcgcggtgatgacgtcacgacccagggctggcgtcacgtgtcccccccgcggggggcggcccttgagggcggcgcttccggtcggcggagcctggtggccgcagcggcggtggcgacgacggccgagacgtggggatggcgggcgccgggagcgaagcccggttcgccgggctgtcgctggtgcagctcaacgagctgctggaggacgagggccagctgacggagatggtgcagaagatggaggagacacagaatgttcagcttaacaaagaaatgacacttgccagcaaccggagcctggcagaaggaaaccttttgtaccagccccagctggacacgttgaaagcacgcttgacccagaaataccaggaactccaggttctctttgaagcctatcagataaagaagaccaaattagacagacagtctagcagtgcttccttggagaccctgttagcacttcttcaggcagaaggggccaagattgaggaagacactgagaacatggcagagaagtttctggatggagaacttcctctggattccttcattgatgtctatcagagcaaacggaaactggcccacatgcgacgggtgaaaatcgagaagctccaggagatggtcctaaaggggcagagactcccacaggccctggccccgctgccccccaggctgcccgaactggcacctaccgccccccttccctaccctgccccagaggccagtgggcctcctgccgttgcacctcggcgcatcccccccccaccacccccggtgcctgcgggacgcttagccaccccgtttactgcggccatgagttcgggacaggccgtgccgtacccaggattacagtgcccgcccctgcccccccgcgtgggcctccccactcagcaaggattctcttcgcagttcgtgtccccatatccgccacctctccctcagagacccccgccccggctccctccacaccagccgggtttcatcctccagtgagcgccggcgcggtccttcccgggagacttcttccacctggcgtgttgtgctctgctcacgggaaggaggctggaggtccgctctgtgccaagggctctggggccctgggccagcgtgtctgtctgattttagaactgtaggtcagtggtgagtagtaggagcccaggctttgggcatcaaggcagttgtgtgtgccgggttacagcctgacacctgtgcgttgcatcggtttgcattatccgtgtgatttctaagtatcttagcgttgatgaactcatgtttgggaagaaataggcctctcccccagtcccatttagaatcgtggtccttctgttgcagctttatttaatgagcatggttcatgatacttattttattttcgaaagacagtcctatgtgtctcacccaccggccactgcagccctggtgagggcgggtgggcgccggccggcctggaagagcgccgtggctgggccaccacctgtggctgcgttgttgctcactgaatctgttggggagaggtcaccatagtcaccgcctgacctggctgctgctcttgcttcagagccacaagcaaagtttgcactgggcccactgccgagtccagaggccggagaacggccactggtgtgggaggggagcgcacgagtgggactttgcacagcaaattgtgtccccagctcctcctctcccgcctgcctggagccggccctgaaggtttctatgaagaaataatcccccaatatttttactacgtgtgtgattttcctgttttatattgaaaaaacttttttgacactcccaagaccattcagggaaattttataaaaaatgcagatactgtcttgagcagatcgaaatgccgatgaagtggatgcaatttccttttgtgcaagcagtgcacggtgcccccccctcgggtgtccgtgctgtgccttagcttccccaggtgccgggactcacacctgctagggtttgatgacagggtattgatgagggtttagatgagcagggtttgatgaggggtgttgatgaagggtttgatgaa

SEQ ID NO: 63520 - DNA, 2388 bp, Homo sapiens
tgttgtttctgaaagagcacaggttggcccacctggatgtctgggcaccttcctctgaggtgatgcaaaggggccactcaatgggtccttgctcaaaatgctccagccttactggccttcttcccattcctgaatgcaccaagttagtcctgtcccagggcctttgcacgtgctggttttgctgccttgagcttcctacaggaatggtggctggttcctcccttctcatccttcacatttccttagacgccaccttctccgaaagtgccatctcttactaccctaaaggtctttttattttcttatttcagtgtccattcccttatttgtgatcgcctaattattttacttatttcttgttttgtttgcgtcctctttcattctgttagctccatgtaagcaggggtccgttttgctttattcagaactgtatactcaatgcccagtacagagtaggtctcaaaacatatttgttaaatgaatgacgtggcagctccacaattccaagtaaccaatgacacctaaagttgtttccccatgaagtctctgtcttttgggttccgtgcatcgggctgggctcacaggctgcgggaacttccttcccactgcctgttttccttggatcgcggtatctctcttcctggaggaaaaaggctcttatgacctcatggcgcgctctcccgagccgcagtgacgtcattaatgcgctcacgcgtcacagcccaatcatagggcccttcccctccctttagaagtcccgactgtccctgacacattccactccaagcgagccgcgacacttacgtcacgtccgcccgcccgcgcggtgatgacgtcacgacccagggctggcgtcacgtgtcccccccgcggggggcggcccttgagggcggcgcttccggtcggcggagcctggtggccgcagcggcggtggcgacgacggccgagacgtggggatggcgggcgccgggagcgaagcccggttcgccgggctgtcgctggtgcagctcaacgagctgctggaggacgagggccagctgacggagatggtgcagaagatggaggagacacagaatgttcagcttaacaaagaaatgacacttgccagcaaccggagcctggcagaaggaaaccttttgtaccagccccagctggacacgttgaaagcacgcttgacccagaaataccaggaactccaggttctctttgaagcctatcagataaagaagaccaaattagacagacagtctagcagtgcttccttggagaccctgttagcacttcttcaggcagaaggggccaagattgaggaagacactgagaacatggcagagaagtttctggatggagaacttcctctggattccttcattgatgtctatcagagcaaacggaaactggcccacatgcgacgggtgaaaatcgagaagctccaggagatggtcctaaaggggcagagactcccacaggccctggccccgctgccccccaggctgcccgaactggcacctaccgccccccttccctaccctgccccagaggccagtgggcctcctgccgttgcacctcggcgcatcccccccccaccacccccggtgcctgcgggacgcttagccaccccgtttactgcggccatgagttcgggacaggccgtgccgtacccaggattacagtgcccgcccctgcccccccgcgtgggcctccccactcagcaaggattctcttcgcagttcgtgtccccatatccgccacctctccctcagagacccccgccccggctccctccacaccagccgggtttcatcctccagtgagcgccggcgcggtccttcccgggagacttcttccacctggcgtgttgtgctctgctcacgggaaggaggctggaggtccgctctgtgccaagggctctggggccctgggccagcgtgtctgtctgattttagaactgtaggtcagtggtgagtagtaggagcccaggctttgggcatcaaggcagttgtgtgtgccgggttacagcctgacacctgtgcgttgcatcggtttgcattatccgtgtgatttctaagtatcttagcgttgatgaactcatgtttgggaagaaataggcctctcccccagtcccatttagaatcgtggtccttctgttgcagctttatttaatgagcatggttcatgatacttattttattttcgaaagacagtcctatgtgtaccggccgctgtcggggatgccacagcctgccacggtcgcagccagacgtgagcttggcattgaagttgcaaagcggcccctggccgggctcgccgtcgctgtccagggccgtgtccggtgctgtggctgtaaagctgtaggaccctttttaataaatagagaattattaataa

SEQ ID NO: 63521 - DNA, 342 bp, Homo sapiens
ccagtgaggtggcagcagctgcactgggctcctggggtgtgcgtggggacctcaggggtttaggagctgatatacttttggttctcatcatcttgtgtgttccttgcagacacagaatgttcagcttaacaaagaaatgacacttgccagcaaccggagcctggcagaaggaaaccttttgtaccagccccagctggacacgttgaaagcacgcttgacccagaaataccaggaactccaggttctctttgaagcctatcagataaagaagaccaaattaggtaactttttaagggtgatcattcgagaataaagagttgagagaaggacacattttcaagc

SEQ ID NO: 63522 - DNA, 2723 bp, Homo sapiens
tcttaggctaggtacgaggctgggtgtttaattcggccgagggtggccgcagcggcggtggcgacgacggccgagacgtggggatggcgggcgccgggagcgaagcccggttcgccgggctgtcgctggtgcagctcaacgagctgctggaggacgagggccagctgacggagatggtgcagaagatggaggagacacagaatgttcagcttaacaaagaaatgacacttgccagcaaccggagcctggcagaaggaaaccttttgtaccagccccagctggacacgttgaaagcacgcttgacccagaaataccaggaactccaggttctctttgaagcctatcagataaagaagaccaaattagacagacagtctagcagtgcttccttggagaccctgttagcacttcttcaggcagaaggggccaagattgaggaagacactgagaacatggcagagaagtttctggatggagaacttcctctggattccttcattgatgtctatcagagcaaacggaaactggcccacatgcgacgggtgaaaatcgagaagctccaggagatggtcctaaaggggcagagactcccacaggccctggccccgctgccccccaggctgcccgaactggcacctaccgccccccttccctaccctgccccagaggccagtgggcctcctgccgttgcacctcggcgcatcccccccccaccacccccggtgcctgcgggacgcttagccaccccgtttactgcggccatgagttcgggacaggccgtgccgtacccaggattacagtgcccgcccctgcccccccgcgtgggcctccccactcagcaaggattctcttcgcagttcgtgtccccatatccgccacctctccctcagagacccccgccccggctccctccacaccagccgggtttcatcctccagtgagcgccggcgcggtccttcccgggagacttcttccacctggcgtgttgtgctctgctcacgggaaggaggctggaggtccgctctgtgccaagggctctggggccctgggccagcgtgtctgtctgattttagaactgtaggtcagtggtgagtagtaggagcccaggctttgggcatcaaggcagttgtgtgtgccgggttacagcctgacacctgtgcgttgcatcggtttgcattatccgtgtgatttctaagtatcttagcgttgatgaactcatgtttgggaagaaataggcctctcccccagtcccatttagaatcgtggtccttctgttgcagctttatttaatgagcatggttcatgatacttattttattttcgaaagacagtcctatgtgtctcacccaccggccactgcagccctggtgagggcgggtgggcgccggccggcctggaagagcgccgtggctgggccaccacctgtggctgcgttgttgctcactgaatctgttggggagaggtcaccatagtcaccgcctgacctggctgctgctcttgcttcagagccacaagcaaagtttgcactgggcccactgccgagtccagaggccggagaacggccactggtgtgggaggggagcgcacgagtgggactttgcacagcaaattgtgtccccagctcctcctctcccgcctgcctggagccggccctgaaggtttctatgaagaaataatcccccaatatttttactacgtgtgtgattttcctgttttatattgaaaaaacttttttgacactcccaagaccattcagggaaattttataaaaaatgcagatactgtcttgagcagatcgaaatgccgatgaagtggatgcaatttccttttgtgcaagcagtgcacggtgcccccccctcgggtgtccgtgctgtgccttagcttccccaggtgccgggactcacacctgctaggggctgggcaaggccccggctctgctttctctgaagggcttgtccaagttcattgccctgttacaggtggtcaagacgtccggccgccttgacccaggctacccttagccaatatcctctgcccctgggtggctggtggctgggcctcagggtgggcaacgttaggggtttggcgaaagcccgccccatgggattgagggacggggctgcactccaaccgtctgcacctgctcttcccccacccctgtgggacctcatcttcacgtgccatgtgtgctgaaggcccagggcccagcagggggcagtggcacctgttgacggaaaaggccgaggtgcttaccagtggaccttctggcccgcccctcccctgtcacttgtcgggcatccagggccccgacctgtgcctagccgccagggtgacagaaggcagaactgaagcggggtctgggccacgggccaggccactgccttttgtcctcagtgaccatacattcctgctctcggacttgaactctactgtaactgttttcttgaaatgaagctgtacaggacgattcactgccatgccagtcaggcgggcttgccatgttctgtgaatctcgagtgagcggtgccacccgcccccatacctccgccaccggccgctgtcggggatgccacagcctgccacggtcgcagccagacgtgagcttggcattgaagttgcaaagcggcccctggccgggctcgccgtcgctgtccagggccgtgtccggtgctgtggctgtaaagctgtaggaccctttttaataaatagagaattattaataa

SEQ ID NO: 63523 - DNA, 3476 bp, Homo sapiens
tgttgtttctgaaagagcacaggttggcccacctggatgtctgggcaccttcctctgaggtgatgcaaaggggccactcaatgggtccttgctcaaaatgctccagccttactggccttcttcccattcctgaatgcaccaagttagtcctgtcccagggcctttgcacgtgctggttttgctgccttgagcttcctacaggaatggtggctggttcctcccttctcatccttcacatttccttagacgccaccttctccgaaagtgccatctcttactaccctaaaggtctttttattttcttatttcagtgtccattcccttatttgtgatcgcctaattattttacttatttcttgttttgtttgcgtcctctttcattctgttagctccatgtaagcaggggtccgttttgctttattcagaactgtatactcaatgcccagtacagagtaggtctcaaaacatatttgttaaatgaatgacgtggcagctccacaattccaagtaaccaatgacacctaaagttgtttccccatgaagtctctgtcttttgggttccgtgcatcgggctgggctcacaggctgcgggaacttccttcccactgcctgttttccttggatcgcggtatctctcttcctggaggaaaaaggctcttatgacctcatggcgcgctctcccgagccgcagtgacgtcattaatgcgctcacgcgtcacagcccaatcatagggcccttcccctccctttagaagtcccgactgtccctgacacattccactccaagcgagccgcgacacttacgtcacgtccgcccgcccgcgcggtgatgacgtcacgacccagggctggcgtcacgtgtcccccccgcggggggcggcccttgagggcggcgcttccggtcggcggagcctggtggccgcagcggcggtggcgacgacggccgagacgtggggatggcgggcgccgggagcgaagcccggttcgccgggctgtcgctggtgcagctcaacgagctgctggaggacgagggccagctgacggagatggtgcagaagatggaggagacacagaatgttcagcttaacaaagaaatgacacttgccagcaaccggagcctggcagaaggaaaccttttgtaccagccccagctggacacgttgaaagcacgcttgacccagaaataccaggaactccaggttctctttgaagcctatcagataaagaagaccaaattagacagacagtctagcagtgcttccttggagaccctgttagcacttcttcaggcagaaggggccaagattgaggaagacactgagaacatggcagagaagtttctggatggagaacttcctctggattccttcattgatgtctatcagagcaaacggaaactggcccacatgcgacgggtgaaaatcgagaagctccaggagatggtcctaaaggggcagagactcccaccacccccggtgcctgcgggacgcttagccaccccgtttactgcggccatgagttcgggacaggccgtgccgtacccaggattacagtgcccgcccctgcccccccgcgtgggcctccccactcagcaaggattctcttcgcagttcgtgtccccatatccgccacctctccctcagagacccccgccccggctccctccacaccagccgggtttcatcctccagtgagcgccggcgcggtccttcccgggagacttcttccacctggcgtgttgtgctctgctcacgggaaggaggctggaggtccgctctgtgccaagggctctggggccctgggccagcgtgtctgtctgattttagaactgtaggtcagtggtgagtagtaggagcccaggctttgggcatcaaggcagttgtgtgtgccgggttacagcctgacacctgtgcgttgcatcggtttgcattatccgtgtgatttctaagtatcttagcgttgatgaactcatgtttgggaagaaataggcctctcccccagtcccatttagaatcgtggtccttctgttgcagctttatttaatgagcatggttcatgatacttattttattttcgaaagacagtcctatgtgtctcacccaccggccactgcagccctggtgagggcgggtgggcgccggccggcctggaagagcgccgtggctgggccaccacctgtggctgcgttgttgctcactgaatctgttggggagaggtcaccatagtcaccgcctgacctggctgctgctcttgcttcagagccacaagcaaagtttgcactgggcccactgccgagtccagaggccggagaacggccactggtgtgggaggggagcgcacgagtgggactttgcacagcaaattgtgtccccagctcctcctctcccgcctgcctggagccggccctgaaggtttctatgaagaaataatcccccaatatttttactacgtgtgtgattttcctgttttatattgaaaaaacttttttgacactcccaagaccattcagggaaattttataaaaaatgcagatactgtcttgagcagatcgaaatgccgatgaagtggatgcaatttccttttgtgcaagcagtgcacggtgcccccccctcgggtgtccgtgctgtgccttagcttccccaggtgccgggactcacacctgctaggggctgggcaaggccccggctctgctttctctgaagggcttgtccaagttcattgccctgttacaggtggtcaagacgtccggccgccttgacccaggctacccttagccaatatcctctgcccctgggtggctggtggctgggcctcagggtgggcaacgttaggggtttggcgaaagcccgccccatgggattgagggacggggctgcactccaaccgtctgcacctgctcttcccccacccctgtgggacctcatcttcacgtgccatgtgtgctgaaggcccagggcccagcagggggcagtggcacctgttgacggaaaaggccgaggtgcttaccagtggaccttctggcccgcccctcccctgtcacttgtcgggcatccagggccccgacctgtgcctagccgccagggtgacagaaggcagaactgaagcggggtctgggccacgggccaggccactgccttttgtcctcagtgaccatacattcctgctctcggacttgaactctactgtaactgttttcttgaaatgaagctgtacaggacgattcactgccatgccagtcaggcgggcttgccatgttctgtgaatctcgagtgagcggtgccacccgcccccatacctccgccaccggccgctgtcggggatgccacagcctgccacggtcgcagccagacgtgagcttggcattgaagttgcaaagcggcccctggccgggctcgccgtcgctgtccagggccgtgtccggtgctgtggctgtaaagctgtaggaccctttttaataaatagagaattattaataa

SEQ ID NO: 63524 - DNA, 3642 bp, Homo sapiens
tgttgtttctgaaagagcacaggttggcccacctggatgtctgggcaccttcctctgaggtgatgcaaaggggccactcaatgggtccttgctcaaaatgctccagccttactggccttcttcccattcctgaatgcaccaagttagtcctgtcccagggcctttgcacgtgctggttttgctgccttgagcttcctacaggaatggtggctggttcctcccttctcatccttcacatttccttagacgccaccttctccgaaagtgccatctcttactaccctaaaggtctttttattttcttatttcagtgtccattcccttatttgtgatcgcctaattattttacttatttcttgttttgtttgcgtcctctttcattctgttagctccatgtaagcaggggtccgttttgctttattcagaactgtatactcaatgcccagtacagagtaggtctcaaaacatatttgttaaatgaatgacgtggcagctccacaattccaagtaaccaatgacacctaaagttgtttccccatgaagtctctgtcttttgggttccgtgcatcgggctgggctcacaggctgcgggaacttccttcccactgcctgttttccttggatcgcggtatctctcttcctggaggaaaaaggctcttatgacctcatggcgcgctctcccgagccgcagtgacgtcattaatgcgctcacgcgtcacagcccaatcatagggcccttcccctccctttagaagtcccgactgtccctgacacattccactccaagcgagccgcgacacttacgtcacgtccgcccgcccgcgcggtgatgacgtcacgacccagggctggcgtcacgtgtcccccccgcggggggcggcccttgagggcggcgcttccggtcggcggagcctggtggccgcagcggcggtggcgacgacggccgagacgtggggatggcgggcgccgggagcgaagcccggttcgccgggctgtcgctggtgcagctcaacgagctgctggaggacgagggccagctgacggagatggtgcagaagatggaggagacacagaatgttcagcttaacaaagaaatgacacttgccagcaaccggagcctggcagaaggaaaccttttgtaccagccccagctggacacgttgaaagcacgcttgacccagaaataccaggaactccaggttctctttgaagcctatcagataaagaagaccaaattagacagacagtctagcagtgcttccttggagaccctgttagcacttcttcaggcagaaggggccaagattgaggaagacactgagaacatggcagagaagtttctggatggagaacttcctctggattccttcattgatgtctatcagagcaaacggaaactggcccacatgcgacgggtgaaaatcgagaagctccaggagatggtcctaaaggggcagagactcccacaggccctggccccgctgccccccaggctgcccgaactggcacctaccgccccccttccctaccctgccccagaggccagtgggcctcctgccgttgcacctcggcgcatcccccccccaccacccccggtgcctgcgggacgcttagccaccccgtttactgcggccatgagttcgggacaggccgtgccgtacccaggattacagtgcccgcccctgcccccccgcgtgggcctccccactcagcaaggattctcttcgcagttcgtgtccccatatccgccacctctccctcagagacccccgccccggctccctccacaccagccgggtttcatcctccagtgagcgccggcgcggtccttcccgggagacttcttccacctggcgtgttgtgctctgctcacgggaaggaggctggaggtccgctctgtgccaagggctctggggccctgggccagcgtgtctgtctgattttagaactgtaggtcagtggtgagtagtaggagcccaggctttgggcatcaaggcagttgtgtgtgccgggttacagcctgacacctgtgcgttgcatcggtttgcattatccgtgtgatttctaagtatcttagcgttgatgaactcatgtttgggaagaaataggcctctcccccagtcccatttagaatcgtggtccttctgttgcagctttatttaatgagcatggttcatgatacttattttattttcgaaagacagtcctatgtgtctcacccaccggccactgcagccctggtgagggcgggtgggcgccggccggcctggaagagcgccgtggctgggccaccacctgtggctgcgttgttgctcactgaatctgttggggagaggtcaccatagtcaccgcctgacctggctgctgctcttgcttcagagccacaagcaaagtttgcactgggcccactgccgagtccagaggccggagaacggccactggtgtgggaggggagcgcacgagtgggactttgcacagcaaattgtgtccccagctcctcctctcccgcctgcctggagccggccctgaaggtttctatgaagaaataatcccccaatatttttactacgtgtgtgattttcctgttttatattgaaaaaacttttttgacactcccaagaccattcagggaaattttataaaaaatgcagatactgtcttgagcagatcgaaatgccgatgaagtggatgcaatttccttttgtgcaagcagtgcacggtgcccccccctcgggtgtccgtgctgtgccttagcttccccaggtgccgggactcacacctgctaggggctgggcaaggccccggctctgctttctctgaagggcttgtccaagttcattgccctgttacaggtggtcaagacgtccggccgccttgacccaggctacccttagccaatatcctctgcccctgggtggctggtggctgggcctcagggtgggcaacgttaggggtttggcgaaagcccgccccatgggattgagggacggggctgcactccaaccgtctgcacctgctcttcccccacccctgtgggacctcatcttcacgtgccatgtgtgctgaaggcccagggcccagcagggggcagtggcacctgttgacggaaaaggccgaggtgcttaccagtggaccttctggcccgcccctcccctgtcacttgtcgggcatccagggccccgacctgtgcctagccgccagggtgacagaaggcagaactgaagcggggtctgggccacgggccaggccactgccttttgtcctcagtgaccatacattcctgctctcggacttgaactctactgtaactgttttcttgaaatgaagctgtacaggacgattcactgccatgccagtcaggcgggcttgccatgttctgtgaatctcgagtgagcggtgccacccgcccccatacctccgccaccggccgctgtcggggatgccacagcctgccacggtcgcagccagacgtgagcttggcattgaagttgcaaagcggcccctggccgggctcgccgtcgctgtccagggccgtgtccggtgctgtggctgtaaagctgtaggaccctttttaataaatagagaattattaataaaaaaaaaaaaacggccaccaaaatactgaagacacactgcgagcac

SEQ ID NO: 63525 - DNA, 3047 bp, Homo sapiens
tgttgtttctgaaagagcacaggttggcccacctggatgtctgggcaccttcctctgaggtgatgcaaaggggccactcaatgggtccttgctcaaaatgctccagccttactggccttcttcccattcctgaatgcaccaagttagtcctgtcccagggcctttgcacgtgctggttttgctgccttgagcttcctacaggaatggtggctggttcctcccttctcatccttcacatttccttagacgccaccttctccgaaagtgccatctcttactaccctaaaggtctttttattttcttatttcagtgtccattcccttatttgtgatcgcctaattattttacttatttcttgttttgtttgcgtcctctttcattctgttagctccatgtaagcaggggtccgttttgctttattcagaactgtatactcaatgcccagtacagagtaggtctcaaaacatatttgttaaatgaatgacgtggcagctccacaattccaagtaaccaatgacacctaaagttgtttccccatgaagtctctgtcttttgggttccgtgcatcgggctgggctcacaggctgcgggaacttccttcccactgcctgttttccttggatcgcggtatctctcttcctggaggaaaaaggctcttatgacctcatggcgcgctctcccgagccgcagtgacgtcattaatgcgctcacgcgtcacagcccaatcatagggcccttcccctccctttagaagtcccgactgtccctgacacattccactccaagcgagccgcgacacttacgtcacgtccgcccgcccgcgcggtgatgacgtcacgacccagggctggcgtcacgtgtcccccccgcggggggcggcccttgagggcggcgcttccggtcggcggagcctggtggccgcagcggcggtggcgacgacggccgagacgtggggatggcgggcgccgggagcgaagcccggttcgccgggctgtcgctggtgcagctcaacgagctgctggaggacgagggccagctgacggagatggtgcagaagatggaggagacacagaatgttcagcttaacaaagaaatgacacttgccagcaaccggagcctggcagaaggaaaccttttgtaccagccccagctggacacgttgaaagcacgcttgacccagaaataccaggaactccaggttctctttgaagcctatcagataaagaagaccaaattagacagacagtctagcagtgcttccttggagaccctgttagcacttcttcaggcagaaggggccaagattgaggaagacactgagaacatggcagagaagtttctggatggagaacttcctctggattccttcattgatgtctatcagagcaaacggaaactggcccacatgcgacgggtgaaaatcgagaagctccaggagatggtcctaaaggggcagagactcccacaggccctggccccgctgccccccaggctgcccgaactggcacctaccgccccccttccctaccctgccccagaggccagtgggcctcctgccgttgcacctcggcgcatcccccccccaccacccccggtgcctgcgggacgcttagccaccccgtttactgcggccatgagttcgggacaggccgtgccgtacccaggattacagtgcccgcccctgcccccccgcgtgggcctccccactcagcaaggattctcttcgcagttcgtgtccccatatccgccacctctccctcagagacccccgccccggctccctccacaccagccgggtttcatcctccagtgagcgccggcgcggtccttcccgggagacttcttccacctggcgtgttgtgctctgctcacgggaaggaggctggaggtccgctctgtgccaagggctctggggccctgggccagcgtgtctgtctgattttagaactgtaggtcagtggtgagtagtaggagcccaggctttgggcatcaaggcagttgtgtgtgccgggttacagcctgacacctgtgcgttgcatcggtttgcattatccgtgtgatttctaagtatcttagcgttgatgaactcatgtttgggaagaaataggcctctcccccagtcccatttagaatcgtggtccttctgttgcagctttatttaatgagcatggttcatgatacttattttattttcgaaagacagtcctatgtgtctcacccaccggccactgcagccctggtgagggcgggtgggcgccggccggcctggaagagcgccgtggctgggccaccacctgtggctgcgttgttgctcactgaatctgttggggagaggtcaccatagtcaccgcctgacctggctgctgctcttgcttcagagccacaagcaaagtttgcactgggcccactgccgagtccagaggccggagaacggccactggtgtgggaggggagcgcacgagtgggactttgcacagcaaattgtgtccccagctcctcctctcccgcctgcctggagccggccctgaaggtttctatgaagaaataatcccccaatatttttactacgtgtgtgattttcctgttttatattgaaaaaacttttttgacactcccaagaccattcagggaaattttataaaaaatgcagatactgtcttgagcagatcgaaatgccgatgaagtggatgcaatttccttttgtgcaagcagtgcacggtgcccccccctcgggtgtccgtgctgtgccttagcttccccaggtgccgggactcacacctgctaggggctgggcaaggccccggctctgctttctctgaagggcttgtccaagttcattgccctgttacaggtggtcaagacgtccggccgcaccggccgctgtcggggatgccacagcctgccacggtcgcagccagacgtgagcttggcattgaagttgcaaagcggcccctggccgggctcgccgtcgctgtccagggccgtgtccggtgctgtggctgtaaagctgtaggaccctttttaataaatagagaattattaataa

SEQ ID NO: 63526 - DNA, 1295 bp, Homo sapiens
cgcgagacctttattctaaccgcaaggagtagcggaggggaggtcgtgatggcggcgccggaggcggaggttctgtcctcagccgcagtccctgatttggagtggtatgagaagtccgaagaaactcacgcctcccagatagaactacttgagacaagctctacgcaggaacctctcaacgcttcggaggccttttgcccaagagactgcatggtaccagtggtgtttcctgggcctgtgagccaggaaggctgctgtcagtttacttgtgaacttctaaagcatatcatgtatcaacgccagcagctccctctgccctatgaacagcttaagcacttttaccgaaaaccttctccccaggcagaggagatgctgaagaagaaacctcgggccaccactgaggtgagcagcaggaaatgccaacaagccctggcagaactggagagtgtcctcagccacctggaggacttctttgcacggacactagtaccgcgagtgctgattctccttgggggcaatgccctaagccccaaggagttctatgaactcgacttgtctctgctggccccctacagcgtggaccagagcctgagcacagcagcttgtttgcgccgtctcttccgagccatattcatggctgatgcctttagcgagcttcaggctcctccactcatgggcaccgtcgtcatggcacagggacaccgcaactgtggagaagattggtttcgacccaagctcaactatcgagtgcccagccggggccataaactgactgtgaccctgtcatgtggcagaccttccatccgaaccacggcttgggaagactacatttggttccaggcaccagtgacatttaaaggcttccgcgagtgaatgagtgcttcttaatcctaaaaacacaatggctgaattatctttctccatgtggcgctgaatcacccatctggtttggagctagagttgcttcctggtgagagaggaagcaactctccttctggttgtctgcctcccctcagatttcctgataggctgatggcatgtggctgtgactgtgactgtaatcattgctgaacaacatctctttgaatcaaaggttgattttcccagagggtgctgggtcaggcatttctattaggagttggaaagcaaaaatgggtccatagacactctatggaggtgtccctttctgctctttgctgtgtcctttcagaatttttaccaggaacataatgtggatgtgacttatgaacttaaatataaaataaatagattcttattatattttcctgaaattg

SEQ ID NO: 63527 - DNA, 1785 bp, Homo sapiens
tccgggtcgcgtcagaaacagccgcggggcaccacgggatatagagtccccaggcctgggaattcacttaaatgacacgtcgccgccctacaactcccaggaggcatcgcggcgcaagtggccgcgggagtcgtcggaggcgtggggaaggagcgcgccttggcgcgcaaaggcttaagggagctgtagtctgacttccagtcctcgcgctatgttctttttctaggacttggggggaatttagagcctcgaggcctggggtggggacgcgaggacaccagcgtagaagagcttacatcagaatcgagctttgtgggcgctccgggatttggccctttagcgcggatcctagacaacaggttttggacctcgagagctgcagaactgaggctactggtgccgccagcctgctggctccgcctctgcctcagtttcttcccctatggcccgcgtgccgctggggcggagtctcactctgtcacccaggctggagcacaatggcatgacctcagctcaccacaacttccgcctcccaggttcaagggattctcctgcctcagcctcccaagtagctgagattatagatttggagtggtatgagaagtccgaagaaactcacgcctcccagatagaactacttgagacaagctctacgcaggaacctctcaacgcttcggaggccttttgcccaagagactgcatggtaccagtggtgtttcctgggcctgtgagccaggaaggctgctgtcagtttacttgtgaacttctaaagcatatcatgtatcaacgccagcagctccctctgccctatgaacagcttaagcacttttaccgaaaaccttctccccaggcagaggagatgctgaagaagaaacctcgggccaccactgaggtgagcagcaggaaatgccaacaagccctggcagaactggagagtgtcctcagccacctggaggacttctttgcacggacactagtaccgcgagtgctgattctccttgggggcaatgccctaagccccaaggagttctatgaactcgacttgtctctgctggccccctacagcgtggaccagagcctgagcacagcagcttgtttgcgccgtctcttccgagccatattcatggctgatgcctttagcgagcttcaggctcctccactcatgggcaccgtcgtcatggcacagggacaccgcaactgtggagaagattggtttcgacccaagctcaactatcgagtgcccagccggggccataaactgactgtgaccctgtcatgtggcagaccttccatccgaaccacggcttgggaagactacatttggttccaggcaccagtgacatttaaaggcttccgcgagtgaatgagtgcttcttaatcctaaaaacacaatggctgaattatctttctccatgtggcgctgaatcacccatctggtttggagctagagttgcttcctggtgagagaggaagcaactctccttctggttgtctgcctcccctcagatttcctgataggctgatggcatgtggctgtgactgtgactgtaatcattgctgaacaacatctctttgaatcaaaggttgattttcccagagggtgctgggtcaggcatttctattaggagttggaaagcaaaaatgggtccatagacactctatggaggtgtccctttctgctctttgctgtgtcctttcagaatttttaccaggaacataatgtggatgtgacttatgaacttaaatataaaataaatagattcttattatattttcctgaaattg

SEQ ID NO: 63528 - DNA, 455 bp, Homo sapiens
gactacatagtaagacctcatccctattaaaaatcaaaaaaattagccaggcatggtgatgcgtgcctgtagtctcagctcctcaggaggcgaggcaggaagatggcttgagtctgggagatcgaggctgcagtaagctaagatcataccactgcactccagcctgggcaacagagtgagaccctgtctcaaaaaacaaaaagcatgctgagcaaaagaaaccagacacaagagtgcatgccatatgatcccatgtgtgtgaaactacagaaagataaattgtagtctaaaatgagaaaaagggccgggtgcggcagctcaagcctgtaatcccagcactttgggaggccaaggcaggcggatcacctgaggtcaggagtccgagaccagcctggccaactttagttggccatgtttttagtagagatggcaaaacttcatctctactaaaaata

SEQ ID NO: 63529 - DNA, 338 bp, Homo sapiens
cactctgaatgtgttatcccactccctcctggcttgtgtggtttcctctatgcacctgggtatatctttctctaggtttggcaagttttgtgttatcatttctttgaataagatgccttggataatcctttgaaggaagataatttagtccaacttaatgaaaccgatatccttcgtgtactgacggaaacactggcggcacatattgaggccctatttccagatcagaccgtgccggtttgaacagacgcgacaagagggagaaccctggccgaattttcgcaggtggctccagtacaactgctggtgacccatcttgctctcaggagtgcaacgag

SEQ ID NO: 63530 - DNA, 206 bp, Homo sapiens
ttatccctttctttttttatggtttatctgtttaaaaaaacccagaccatgtgatctgcacattccctgaatctggagtttttgaactgcatattcatgacactgatcacatggcgctcatcctctgtgcttcctgtaaggtgacagctacatccaggggcctggtccgcctcttggtaggtctctggaaacaccacccggggggc

SEQ ID NO: 63531 - DNA, 151 bp, Homo sapiens
tggattcctttttctcttcagcttgtgcgagctggatttctgtcatttttaactgaaagataggttttcttacaagatttttcttcagagttgtttatcgggcttaggaactgttatttatgtctctctgtgcttaatttttctatttaaa

SEQ ID NO: 63532 - DNA, 1566 bp, Homo sapiens
  misc_feature (574)..(574): n is a, c, g, or t
  misc_feature (1212)..(1212): n is a, c, g, or t
  misc_feature (1267)..(1267): n is a, c, g, or t
  misc_feature (1376)..(1376): n is a, c, g, or t
  misc_feature (1561)..(1566): n is a, c, g, or t
ccattatcatctatgggataactccaaaatcccatattcactttaggtttaccatcagcttttgactggatactggcaaaaccaccttggtcacaatagtgctttgtgacataccatctcttacctgaatacctgcaaaaacccatggtcttcataaggtttgaaaacctaacatctgttacatggctatccacaaactgcccaggtaactgccatagctgggcatacaacatcttccggcatacctacagaaactcacggatacaattaacatggatttcatctttcatgagaaacaggaaggtttcctgtgtgctcagcactgtctgaacaatctattgcaaggagaatattttagccctgtggaattagcctcaattgcacatcagctagatgaagaagagaggatgagaatggcagaaggaggagtcaccagtgaagagtatcttgcatttttacagcagccttcagaaaacatggatgataccggtttcttctccattcaggtaataagcaatgccttgaagttctggggtttagagatcatccatttcaataatcctgaatatcagangctcggcattgatcctataaatgaaagatcttttatatgtaattataaacaacactggtttactattagaaaatttggaaaacactggtttaacttgaattctctcttggcgggtccagaattaatatcagatacatgccttgcaaatttcttggctcgattacaacaacaagcatattctgtatttgttgtcaagggtgatctgccagactgtgaagctgaccaactcctgcagatcatcagtgtcgaagagatggatacaccaaaacttaatggaaaaaaattagtaaaacaaaaagagcatagagtctataaaacagtccttgaaaaagtatcagaagaaagtgatgagtctggaacatcagaccaagatgaggaggattttcagagggcccttgaactaagccgccaagaaaccaatagagaagatgaacatctccgcagtactattgagttaagcatgcaaggtagttccggaaacacatcgcaagatcttccaaagacatcatgtgtaactcctgcttcagaacagccgaagaaaataaaagaagactattttgaaaagcatcagcaggaacagaagcagcagcaacaacagtcagatctgccgggccacagttcatacctacacgaaaggncaacaacaagttcgagagcaattgagagtgatctcagtgatgacatcagtgaagncacagtacaggccgctgtcgacaccattttagaaattatgagaaagaatttgaaaatcaaaggggaaaaataatgcctttaaaaataatttagatagtcatactttccnacattatcctgtgtgattatactgtaggatccattttggtcatctgtcaaagagatgaggaaataaggcttttagacagtttgcaaacaaaatgacgagagagatgtgggactaaataatgatcgttcaactactagccaaggagacattcagcaattaattaaatttaaattagctttcaaaannnnnn

SEQ ID NO: 63533 - DNA, 728 bp, Homo sapiens
ctgcctccctggcagactcctgggagccatgcgtgggcaccaccacccagtcctggctagggttaagtcaggcacaggctcccagcccacactgattcaacagtcctttaactagggacttgagatagagaccaagagcttccagcctcagtcttgtcgatgcctgaagtgaagcaggcgagagtctggaatgagccacactgtattatagaatagtcttaggagctgagatgagaggtctgcagtgaaggagtagaaggagggcaatgagagagaattttggagttgattcctacaccaaagtcacatcttaccctcgagttctcaaagtatccttatggcaaacctcccttttccaaatcaactagatggaaagggtttctgttacatgcagccaagggtcttgtggcaagtggcaggaaaaaaaaaaacccaaccataaagacattcatttatttaccaaaatgcctggtgaaaggtagttctggaaggtagttccaggatggttccgtgttaccaaaggcataggtacttaactatctttttgtcctgccttccctggtgtgtaggcaaggattcctctcgtggtgacaagatggctgccgcagctctgagaatcacatcctcacaagatagcatccagatccaggaagggaagacagccaaagcaggaaaggcactttctctgcatgtaccactcttttattaaagggactgtgaagattacc

SEQ ID NO: 63534 - DNA, 384 bp, Homo sapiens
gtgtcttgggcattgtttcatctgactgaaaaaatgaattttggacaaatgagaaataaatgctaagacccagtcagagttcaattatcaattttatattacttaaaagcctcttctgtctagatttagcttagtatatgtcacagccagtgacaagtcactcatatggagaggactgccaagtcaccacgctactcaactgttgtacaagttttgctcctaacaccttgccaagttgttggtgactgtgcaatttatactccagagaaaatttcgtttgtcattcttacttggttaacttgcccatgaagtttgtcattaataacttgaattctctggatctaataccattaaaaatagaagcaagaatcccaggatgctaat

SEQ ID NO: 63535 - DNA, 330 bp, Homo sapiens
tgttgttgttgttcattactagtgttacatagtttcttcacatacattttgcacatttcttattaggtttcctgtgtataagtcagagtcccagcaagaaaggtatagcaaatattccaatgggctaatggaggggagtttgatgaagggattattttcaaaggtgaggaaagggttaaggagactcaacaagggacagtgtaaaggctaattttaggtgtacacttgactgcattaagtaatatccagagagccggtaaagcattatttctgggtctatgagggcgattttggaaaagattgacatttgagccagcagactacgtaagg

SEQ ID NO: 63536 - DNA, 495 bp, Homo sapiens
acttcttgaaataaaggctaaatcctttatggttatgaatgtaccttttctttccgttaattttaatctgtttttcccctttgctctcacccctccttctttcttcatttcttcctataagtcacacctctaaaattgttgtaacaaaaaattcaaaggctctttgtgtttggtgaatagagttatatagtcgtctcctggtgtctgtgggtgattattattccaaggtccctgtggatacaaaaatctgcagatataaaaggatgtactattttcacgtaacccacacgcatcctccctatataatactgtaaatccttctagattacctatacctaatatagtgcacatgctatatagttgttatactatattgtttttaatttgtattatttttattatttttattgtttttttatttttattttcacttatttacttatttttttgagatggaatctcactccagcctgggcgacagagcaagactgtctc

SEQ ID NO: 63537 - DNA, 579 bp, Homo sapiens
cactagggggaagactaggatgatacctggacggcagagacagcagtgatccagttccagtcccacttcctcaactgccggctggtggtttccacctgcatgtgctcatctctttactcatgccctaaggactcaacaccagtgcctgataggatctactgaggatgctgaaactcacttgatagatgttcaagctccccacgccttctccagctggtggtcagtattcttaggtccagcataccacccaccaagcatccttgcccgactgactaagtgttttgtacctggacaattcaaaagggaatgcggaggttgctctagcctgtatctcctcctctgggcagacccatatctctgggattccaccagctcttctgactatgcctcctgtgttccccactccccgctgtcaggaagcccttccttttgcccactttacatcactcacattgacgtttgacctccacatggaattccaatgtgcccccgttttgtgaccaggactaggcccccttgacatctacgagctcatgtgtacatggggtaactctgataaagccagcattattatgcttc

SEQ ID NO: 63538 - DNA, 462 bp, Homo sapiens
tctcaagtagataaaatcctgtgatcacatttagaacttttaaagaatagttgagattgaaaatacttactctgggggaaaaaggtaactggaacacagtgcttcagaaaagtccagacaccttgattttactaatttagaacagtttagaagaaatccaaggtaagtcaaagttgggaattataggaagcaatgaaatagtcaatttcagtgggtgtggtggcttacgcctgtaatcccagcactttgggaggccaaagtagaaggatcgcttgagcccaagagttctagaccagcctgggcaacatagtgggaccccgtctctacccctaaaaattaaccgggctaagtggcacacacttgaaatcccagccacttaggaggctgagggaggaggattggttgagcccaggaggttgaggcttcagtgagctatgatggcctgggtgacagagtgagacc

SEQ ID NO: 63539 - DNA, 584 bp, Homo sapiens
atcacattagctgacatcaggaactgagccaggcagtgtggttgtgatgtcactatctcacctcacccccacctaagagattgtggtggggaatctcagacactctaaccctctgggcccaagtcacctttctatcaggggagggaggctgtgctctcactggcttcttgttagaagttctgcctgccctacagcctgcactgagggctctcatcactgcttctgagatcttaatgggggtcaacgaagatgtgggcttctctgagtttagaccatccatctgccaaggaaaaccaagccctgagactgatagagatgagagaagagaatggtaatgtccccaagacagagcaggcaggaagtttgaagcctctgagggatacaggaaaatctaacctcaaagagaagaagatgaatatcaacaagttgtgtccgggcttgggtggtgagtgtatgactccagatgttatgctgctccagcagaaccagtcactcttgtggaagccaaggaatgggaacagaagaatatgaaatctgtggtactgatcatcagtcttaatatccaaatgaatatcatggtacat

SEQ ID NO: 63540 - DNA, 1137 bp, Homo sapiens
atcacattagctgacatcaggaactgagccaggcagtgtggttgtgatgtcactatctcacctcacccccacctaagagattgtggtggggaatctcagacactctaaccctctgggcccaagtcacctttctatcaggggagggaggctgtgctctcactggcttcttgttagaagttctgcctgccctacagcctgcactgagggctctcatcactgcttctgagatcttaatgggggtcaacgaagatgtgggcttctctgagtttagaccatccatctgccaaggaaaaccaagccctgagactgatagagatgagagaagagaatggtaatgtccccaagacagagcaggcaggaagtttgaagcctctgagggatacaggaaaatctaacctcaaagagaagaaggagaaattttgtgtcgatatggggcttcaaacatacgtgttgagttttacaagatgaattagaaaaccgttctaatcaggtgcgatgtgcagagaaaaaattacaacacaaagaattggagtcacaggaacagataacttacatacgacaagaatatgaaacaaaattgaaaggattgatgccagcatccctaagacaagaacttgaagacaccatttcctccctaaaatcacaggttaattttctgcaaaagagagcttccatccttcaggaagaactgactacatatcaaggcagaaggtaactgcacgagagaatgcaacggatgcaatttccaggctgtgctgtggacttcttccagcaggtttgaagatttggatattgtaaactgtgagatcagtggcattttttaaatccttaaatgtaattaagatcataaaaacatgcatcattcatacactagtggggtggttttatttgtgtctgcctaagttatttttttaacattcctttatttccgattttcatgtttgtgtgcatttgagtatgtgctgagaactgcttatattgggcaaagtgatttcctatgatatgccttgttaatccttttgcatagaattttaccagttgcgtacgatcaaaatcacgtttgtagtatcatatcaaaaattctaacctgtttacattgttttcatgttcatgttcctatgttattaaaatattatt

SEQ ID NO: 63541 - DNA, 777 bp, Homo sapiens
cgtcatactggattaagagcccactctactccagggtgacctcgtctgattatgtctgcaaggatcctatttccaaataaggccacgttctgaggttttacaagatgaattagaaaaccgttctaatcaggtgcgatgtgcagagaaaaaattacaacacaaagaattggagtcacaggaacagataacttacatacgacaagaatatgaaacaaaattgaaaggattgatgccagcatccctaagacaagaacttgaagacaccatttcctccctaaaatcacaggttaattttctgcaaaagagagcttccatccttcaggaagaactgactacatatcaaggcagaaggtaactgcacgagagaatgcaacggatgcaatttccaggctgtgctgtggacttcttccagcaggtttgaagatttggatattgtaaactgtgagatcagtggcattttttaaatccttaaatgtaattaagatcataaaaacatgcatcattcatacactagtggggtggttttatttgtgtctgcctaagttatttttttaacattcctttatttccgattttcatgtttgtgtgcatttgagtatgtgctgagaactgcttatattgggcaaagtgatttcctatgatatgccttgttaatccttttgcatagaattttaccagttgcgtacgatcaaaatcacgtttgtagtatcatatcaaaaattctaacctgtttacattgttttcatgttcatgttcctatgttattaaaatattatt

SEQ ID NO: 63542 - DNA, 1452 bp, Homo sapiens
  misc_feature (27)..(27): n is a, c, g, or t
tctcctcttctgaatcgctgaaatganagagcagatggaaaaagtggaggcagatctaactagatccaaatctcttcgtgagaaacaatcaaaggagtttttatggcaactggaggacatcagacagcggtatgaacaacagatagtagagctgaagctggagcatgaacaggagaagacgcacctattacagcagcataacgcagagaaggatagcctagtccgagaccatgaacgggaaattgaaaacctggaaaaacagcttcgcgctgccaatatggagcacgaaaatcaaattcaggagttcaagaaacgagatgcacaggttattgccgacatggaggcccaggttcacaagttgagagaagaattgatcaatgtgaactcacagcggaaacagcagctggtagagcttggtcttcttcgtgaagaggaaaagcaaagggctacaagggaacatgagattgtcgtcaataaactgaaggctgaatcagaaaagatgaaaatagagctgaaaaagactcatgctgctgagacagagatgacactggaaaaggccaacagcaagctgaagcagattgagaaggaatacactcagaagcttgccaaatcttcacagatcatagcagaacttcagacaaccatttcctctctgaaagaagagaacagccagcagcagcttgctgcagaaaggcggctccaggatgttagacaaaagtttgaagatgagaagaagcagctgattagagataatgaccaagcaatcaaggttttacaagatgaattagaaaaccgttctaatcaggtgcgatgtgcagagaaaaaattacaacacaaagaattggagtcacaggaacagataacttacatacgacaagaatatgaaacaaaattgaaaggattgatgccagcatccctaagacaagaacttgaagacaccatttcctccctaaaatcacaggttaattttctgcaaaagagagcttccatccttcaggaagaactgactacatatcaaggcagaaggtaactgcacgagagaatgcaacggatgcaatttccaggctgtgctgtggacttcttccagcaggtttgaagatttggatattgtaaactgtgagatcagtggcattttttaaatccttaaatgtaattaagatcataaaaacatgcatcattcatacactagtggggtggttttatttgtgtctgcctaagttatttttttaacattcctttatttccgattttcatgtttgtgtgcatttgagtatgtgctgagaactgcttatattgggcaaagtgatttcctatgatatgccttgttaatccttttgcatagaattttaccagttgcgtacgatcaaaatcacgtttgtagtatcatatcaaaaattctaacctgtttacattgttttcatgttcatgttcctatgttattaaaatattatt

SEQ ID NO: 63543 - DNA, 1307 bp, Homo sapiens
atcacattagctgacatcaggaactgagccaggcagtgtggttgtgatgtcactatctcacctcacccccacctaagagattgtggtggggaatctcagacactctaaccctctgggcccaagtcacctttctatcaggggagggaggctgtgctctcactggcttcttgttagaagttctgcctgccctacagcctgcactgagggctctcatcactgcttctgagatcttaatgggggtcaacgaagatgtgggcttctctgagtttagaccatccatctgccaaggaaaaccaagccctgagactgatagagatgagagaagagaatggtaatgtccccaagacagagcaggcaggaagtttgaagcctctgagggatacaggaaaatctaacctcaaagagaagaaggccaacagcaagctgaagcagattgagaaggaatacactcagaagcttgccaaatcttcacagatcatagcagaacttcagacaaccatttcctctctgaaagaagagaacagccagcagcagcttgctgcagaaaggcggctccaggatgttagacaaaagtttgaagatgagaagaagcagctgattagagataatgaccaagcaatcaaggttttacaagatgaattagaaaaccgttctaatcaggtgcgatgtgcagagaaaaaattacaacacaaagaattggagtcacaggaacagataacttacatacgacaagaatatgaaacaaaattgaaaggattgatgccagcatccctaagacaagaacttgaagacaccatttcctccctaaaatcacaggttaattttctgcaaaagagagcttccatccttcaggaagaactgactacatatcaaggcagaaggtaactgcacgagagaatgcaacggatgcaatttccaggctgtgctgtggacttcttccagcaggtttgaagatttggatattgtaaactgtgagatcagtggcattttttaaatccttaaatgtaattaagatcataaaaacatgcatcattcatacactagtggggtggttttatttgtgtctgcctaagttatttttttaacattcctttatttccgattttcatgtttgtgtgcatttgagtatgtgctgagaactgcttatattgggcaaagtgatttcctatgatatgccttgttaatccttttgcatagaattttaccagttgcgtacgatcaaaatcacgtttgtagtatcatatcaaaaattctaacctgtttacattgttttcatgttcatgttcctatgttattaaaatattatt

SEQ ID NO: 63544 - DNA, 935 bp, Homo sapiens
tgactctagcggatccttaggaggcaggacactggaaaagccaacagcaagctgaagcagattgagaaggaatacactcagaagcttgccaaatcttcacagatcatagcagaacttcagacaaccatttcctctctgaaagaagagaacagccagcagcagcttgctgcagaaaggcggctccaggatgttagacaaaagtttgaagatgagaagaagcagctgattagagataatgaccaagcaatcaaggttttacaagatgaattagaaaaccgttctaatcaggtgcgatgtgcagagaaaaaattacaacacaaagaattggagtcacaggaacagataacttacatacgacaagaatatgaaacaaaattgaaaggattgatgccagcatccctaagacaagaacttgaagacaccatttcctccctaaaatcacaggttaattttctgcaaaagagagcttccatccttcaggaagaactgactacatatcaaggcagaaggtaactgcacgagagaatgcaacggatgcaatttccaggctgtgctgtggacttcttccagcaggtttgaagatttggatattgtaaactgtgagatcagtggcattttttaaatccttaaatgtaattaagatcataaaaacatgcatcattcatacactagtggggtggttttatttgtgtctgcctaagttatttttttaacattcctttatttccgattttcatgtttgtgtgcatttgagtatgtgctgagaactgcttatattgggcaaagtgatttcctatgatatgccttgttaatccttttgcatagaattttaccagttgcgtacgatcaaaatcacgtttgtagtatcatatcaaaaattctaacctgtttacattgttttcatgttcatgttcctatgttattaaaatattatt

SEQ ID NO: 63545 - DNA, 1180 bp, Homo sapiens
  misc_feature (27)..(27): n is a, c, g, or t
tctcctcttctgaatcgctgaaatganagagcagatggaaaaagtggaggcagatctaactagatccaaatctcttcgtgagaaacaatcaaaggagtttttatggcaactggaggacatcagacagcggtatgaacaacagatagtagagctgaagctggagcatgaacaggagaagacgcacctattacagcagcataacgcagagaaggatagcctagtccgagaccatgaacgggaaattgaaaacctggaaaaacagcttcgcgctgccaatatggagcacgaaaatcaaattcaggagttcaagaaacgagatgcacaggttattgccgacatggaggcccaggttcacaagttgagagaagaattgatcaatgtgaactcacagcggaaacagcagctggtagagcttggtcttcttcgtgaagaggaaaagcaaagggctacaagggaacatgagattgtcgtcaataaactgaaggctgaatcagaaaagatgaaaatagagctgaaaaagactcatgctgctgagacagagatgacactggaaaaggccaacagcaagctgaagcagattgagaaggaatacactcagaagcttgccaaatcttcacagatcatagcagaacttcagacaaccatttcctctctgaaagaagagaacagccagcagcagcttgctgcagaaaggcggctccaggatgttagacaaaagtttgaagatgagaagaagcagctgattagagataatgaccaagcaatcaaggttttacaagatgaattagaaaaccgttctaatcaggtgcgatgtgcagagaaaaaattacaacacaaagaattggagtcacaggaacagataacttacatacgacaagaatatgaaacaaaattgaaaggattgatgccagcatccctaagacaagaacttgaagacaccatttcctccctaaaatcacaggttaattttctgcaaaagagagcttccatccttcaggaagaactgactacatatcaaggcagaaggtaactgcacgagagaatgcaacggatgcaatttccaggctgtgctgtggacttcttccagcaggtttgaagatttggatattgtaaactgtgagatcagtggcattttttaaatccttaaatgtaattaagatcataaaaacatgcatcattc

SEQ ID NO: 63546 - DNA, 541 bp, Homo sapiens
cggtttgatcggtctgacgtggtccaagagtctgacccaagggtttgcgactgggagaggaaatctgtgtcctggacaagattggattatggaagtgggaagtgaagaagaaaaatgggagaagctggatgcagaatttgatcactttgtggttgatatgaagccctttgttctaaaattacctcataggacagaacggcagaggtgtgctctttggattagaaagctgtgcgaaccttcaggaacaggtgcaggaataatggggaggaagaatcggaacctgtatgcaaaattgttattgcatatgcttaaacgaggtgcgcttgaaggcccttttacacaccgacctgaacccgggacactaaaaattctaccttcatacatgtccatctattttgatgaaccaaatccagcacgagcaaaaggttcaagcccagagggattaccagcctgggtactgggtgagctggagacaagtgaacacaaattaaatgaatcatggaactctcttctggagaagataacactttagtacagtcgc

SEQ ID NO: 63547 - DNA, 787 bp, Homo sapiens
cggtttgatcggtctgacgtggtccaagagtctgacccaagggtttgcgactgggagaggaaatctgtgtcctggacaagattggattatggaagtgggaagtgaagaagaaaaatgggagaagctggatgcagaatttgatcactttgtggttgatatgaagccctttgttctaaaattacctcataggacagataacttacatacgacaagaatatgaaacaaaattgaaaggattgatgccagcatccctaagacaagaacttgaagacaccatttcctccctaaaatcacaggttaattttctgcaaaagagagcttccatccttcaggaagaactgactacatatcaaggcagaaggtaactgcacgagagaatgcaacggatgcaatttccaggctgtgctgtggacttcttccagcaggtttgaagatttggatattgtaaactgtgagatcagtggcattttttaaatccttaaatgtaattaagatcataaaaacatgcatcattcatacactagtggggtggttttatttgtgtctgcctaagttatttttttaacattcctttatttccgattttcatgtttgtgtgcatttgagtatgtgctgagaactgcttatattgggcaaagtgatttcctatgatatgccttgttaatccttttgcatagaattttaccagttgcgtacgatcaaaatcacgtttgtagtatcatatcaaaaattctaacctgtttacattgttttcatgttcatgttcctatgttattaaaatattatt

SEQ ID NO: 63548 - DNA, 1531 bp, Homo sapiens
agcggatcgatggcaactgagaacgctgtgtttttctacaaagtgtttgtaagatgatttttgaatttttgttatattgtgaaaggagaatggaatggggtctggcattttcgatggaaaaagtggaggcagatctaactagatccaaatctcttcgtgagaaacaatcaaaggagtttttatggcaactggaggacatcagacagcggtatgaacaacagatagtagagctgaagctggagcatgaacaggagaagacgcacctattacagcagcataacgcagagaaggatagcctagtccgagaccatgaacgggaaattgaaaacctggaaaaacagcttcgcgctgccaatatggagcacgaaaatcaaattcaggagttcaagaaacgagatgcacaggttattgccgacatggaggcccaggttcacaagttgagagaagaattgatcaatgtgaactcacagcggaaacagcagctggtagagcttggtcttcttcgtgaagaggaaaagcaaagggctacaagggaacatgagattgtcgtcaataaactgaaggctgaatcagaaaagatgaaaatagagctgaaaaagactcatgctgctgagacagagatgacactggaaaaggccaacagcaagctgaagcagattgagaaggaatacactcagaagcttgccaaatcttcacagatcatagcagaacttcagacaaccatttcctctctgaaagaagagaacagccagcagcagcttgctgcagaaaggcggctccaggatgttagacaaaagtttgaagatgagaagaagcagctgattagagataatgaccaagcaatcaaggttttacaagatgaattagaaaaccgttctaatcaggtgcgatgtgcagagaaaaaattacaacacaaagaattggagtcacaggaacagataacttacatacgacaagaatatgaaacaaaattgaaaggattgatgccagcatccctaagacaagaacttgaagacaccatttcctccctaaaatcacaggttaattttctgcaaaagagagcttccatccttcaggaagaactgactacatatcaaggcagaaggtaactgcacgagagaatgcaacggatgcaatttccaggctgtgctgtggacttcttccagcaggtttgaagatttggatattgtaaactgtgagatcagtggcattttttaaatccttaaatgtaattaagatcataaaaacatgcatcattcatacactagtggggtggttttatttgtgtctgcctaagttatttttttaacattcctttatttccgattttcatgtttgtgtgcatttgagtatgtgctgagaactgcttatattgggcaaagtgatttcctatgatatgccttgttaatccttttgcatagaattttaccagttgcgtacgatcaaaatcacgtttgtagtatcatatcaaaaattctaacctgtttacattgttttcatgttcatgttcctatgttattaaaatattatt

SEQ ID NO: 63549 - DNA, 677 bp, Homo sapiens
agcggatcgatggcaactgagaacgctgtgtttttctacaaagtgtttgtaagatgatttttgaatttttgttatattgtgaaaggagaatggaatggggtctggcattttcgatggaaaaagtggaggcagatctaactagatccaaatctcttcgtgagaaacaatcaaaggagtttttatggcaactggaggacatcagacagcggtatgaacaacaggtgctggagaagtgttttgaagtgttaaatgggaagataaccacaggagatagcgcctgcttccagccttgcttcatctatcagcttgctaatcacagctgtgtttccagccttctgctctccctgtatcatgagcttcgggagcttcagcaggcagtagtcctggctgttgatggttggctggagaggaaaaggaataaagaagcagtgtatgctggcaggccctggtaccatctctaacagcggttatcacagcaacattaaacttttaaataaggagaacttccatgcgtaaactgaactgttgattgacagatttcatggatgtagcaaacatctaatctgggagccacatggccatccccaaatgacacattctatttctgttcttgacacactgcctgctttttacaatttttttgtgcctatttctattaaagtgttcagaaagtaaaa

SEQ ID NO: 63550 - DNA, 397 bp, Homo sapiens
aatggaaggagactggttggtatgtctttaaccatttgtttgaatcacttgaaatgaattcaagttggtaaggtatgttgccaacttatatgtttttataatttttaaaaattgtttggatataggcctgtaacttgccaaataactaaggagaaatgacagaatttaaaaaatataaatcaagacaactaacttttctttttgctctagtagggaatgaggactggtaaggaatacttgaccaagaaatgaaatattgtattttattcttgcttataaatgtttagcaatgctctctgaaggaaatgcatagcaagctatgttaggatcattttaaagttctatacggtgctgttatatcctactgatactttgaatttagtcttgaacagctcag

SEQ ID NO: 63551 - DNA, 429 bp, Homo sapiens
  misc_feature (104)..(104): n is a, c, g, or t
  misc_feature (135)..(136): n is a, c, g, or t
tgtgatgggccacaaaacaagtctcaacaaattaaaaaaaaatgaaatcataccaaacacaacattcaaccacagtgcaataaaaatagaaatcaatactaagnaaatcattcaaaaaccatacaattacatggnntttaaacaacctgctcccgaatgccatttgggcaaacaacattaagatgtgttggctattacagtgtaccaggcaataggataggcacttctgcatctaatctcacctcatcttccattaaactcagaagaaaggtggttattattattattatcatcactattactattactcccattttacaaactaggaaactaacaggaagagaggagagaggttaaataccttgatcaaagttacagacagtaagtggtagaggttacttaccctgcagccaaagttagcctaatttg

SEQ ID NO: 63552 - DNA, 400 bp, Homo sapiens
caagaacctgtggatgacatcgaggacttgttgtattttcaattcgtcctcttgtttaatccacattattactccatggagtagatacagtaatttttatttatatttcatatatgagactcagttattgagtagggggaaggtataacccaagacttctgacttggattctaatgctctttctttcaccctctacctcatttggaggtctaaaaattggaaaacaagacaaagaggatataaaagatagtgtaagacttttcttacataaaaaaaaaagagtcagaaacaaaaccttcatttttcaatgtgaaggaagttttttttgtgtgtttgttgttttgtttccccatggttttgagttttccaactttcttgctttccctcctgggctaaaaat

SEQ ID NO: 63553 - DNA, 815 bp, Homo sapiens
agctggctggagggagcgggacagagcagaggggagggggatcccactggtagcatggatggggcctatcgcccccgacacaaaccagggtctgcccagggacaggtgtgggctgtgtggaggcagaggctggagtcctcagtcctgcatgaggccccactgtttgctgtccttgccgggcggccgggcagcatgttctgtggctcagcctggctgcaacgcctgcccggcttctgagtccctgaaacctcgggcagagcctgggctctcggccctggtgagggagaggggttatggaccccaccaccacctcgggcagtggatgggacactctgaggctggcctggctcacaccgtgttggtaggaagcctgacccccactctgttcccacccccacctagggcctgttttttcaaaagtaaccgttttactgagatgtgattcatatactgtacaattcagcctttaaagtgtgcagtaaatgacttttagtacatatgcagagttgtgcagccgtcacctctaattccagaacattgcatcagctcaaatagcaactctgtccctgttagcagtcacccccatcccgactcccagccctggcacccacatccctttcctgcgtctgtggatcagcctgtcctggacgtgtcatagaagtggaatcacacactgtgtggctttctgtgtctggcgtctctcactgagtgtagcgtcctcagggttcattcgcactggggcccgtgtcagagccttgctcctgttcatggctgagtcgtgttctggtgcgtggggcgcccgtgctgcacttgtc

SEQ ID NO: 63554 - DNA, 590 bp, Homo sapiens
ctcagagaaaataacaatatgctgttactttcagagataggtatgggaatgggtgtggggagtagtaatgtagcttttgataacaacattgcccatttattaaaagaagtctgagaagccactgagaaaagccaagtaagaattctggtggagtttggatatgggtaaaaatcatgttgtatagatgtgagtgccagccagtcacatctttctggtacaaagtaggtacttaatgtttgctgagtgaatttacagatcagattaatgaagacattaattataattttcaatttactactcaaacctgtcatcattccttagctggccatatcactgttacccaatgacattaattaatttactcagttattatttagttcattcaattaataggtcagttaatctatcagtcaacaaatatttattaagtgcctattaaatgccaaaagttatgacagaccctgggaactgaaatggaaaagccatagtcaggattaaaggtatttttggtaagtcaaagagacagataagaaataataaatcccaacaacaacaacaaaaagatgctgctacaggtacagcaaaaactc

SEQ ID NO: 63555 - DNA, 572 bp, Homo sapiens
cagagagagctttccaaactacaaccctaaccagaggaagccccctcgtgactttccacatatccctaggataaaggacacactgtaacccagaaataccttaatcattgccatcttcttcaaggttttccttgctactttggccatgcaggatgaaactcttctaatgagtcatgctcttccaaaagtccatatcctttgtatatacttttccctctgcccggaatactgcatcttattccccttttccttcactgcctggatacctagagaggccatgaaacctgtaactgggagcacaggtttcaaaggcagacagactctggttccaatcccagctctgccacttactcatgtaatatctatgagagttggggtggcttattcaacctccgtgcctcagtttcctcatctgtaaaacaggaataaaaaataacggctactttacaaattgatatgaacactgaatgagataactgatgtgacacagtgcaaggcctgacatgtcaggcactacatgtactagctcctgctgttatttatttattacagttgattttcttgttgttaaa

SEQ ID NO: 63556 - DNA, 345 bp, Homo sapiens
ggtctacaaggagttcttggggaaagcgtaacacatttttgcaatctagaatctgttacatataattatagtatttaacaaattaagcatgatattttattgacggaaaattcaaaataattagttttttctatgcaaagattaacatttatgtttaaatgggaaactatagatttaaagaatgtcttcctttctgatttgtgaatattcagtattttactattttagaaatacgaacttataaaagcacaagccattcttccttagatactttatttttggaatagtttcagaataaattacgaatgtcatcttctttaaagtatttactgttcttgatgattt

SEQ ID NO: 63557 - DNA, 862 bp, Homo sapiens
tcctgggcctctcaaagtctgagccccgctccgctgatgcctgtctgcagaatccgcaccaaccagcaccatgcccatgactctggggtactgggacatccgtgggctggcccacgccatccgcttgctcctggaatacacagactcaagctatgtggaaaagaagtacacgctgggggacgctcctgactatgacagaagccagtggctgaatgaaaaattcaagctgggcctggactttcccaatctgccctacttgattgatggggctcacaagatcacccagagcaatgccatcctgcgctacattgcccgcaagcacaacctgtgtggggagacagaagaggagaagattcgtgtggacattttggagaaccaggttatggataaccacatggagctggtcagactgtgctatgacccagattttgagaaactgaagccaaaatacttggaggaactccctgaaaagctaaagctctactcagagtttctggggaagcggccatggtttgcaggagacaagatcacctttgtggatttccttgcctatgatgtccttgacatgaagcgtatatttgagcccaagtgcttggacgccttcctaaacttgaaggacttcatctcccgctttgaggtgatgcccccatcctcctttctctttgatgccccttgttcctttctctcctttcagatgctttcccagtcctggagctacacaaagaataactcgtatgtattgagtacgggcttcatgccaggaatcatgcccagcacattatacctatcgtgtagaatttgaaatttccaacattcctacagggtgacagaattatcttgcccattttagagataagaaaac

SEQ ID NO: 63558 - DNA, 1621 bp, Homo sapiens
tcctgggcctctcaaagtctgagccccgctccgctgatgcctgtctgcagaatccgcaccaaccagcaccatgcccatgactctggggtactgggacatccgtgggctggcccacgccatccgcttgctcctggaatacacagactcaagctatgtggaaaagaagtacacgctgggggacgctcctgactatgacagaagccagtggctgaatgaaaaattcaagctgggcctggactttcccaatctgccctacttgattgatggggctcacaagatcacccagagcaatgccatcctgcgctacattgcccgcaagcacaacctgtgtggggagacagaagaggagaagattcgtgtggacattttggagaaccaggttatggataaccacatggagctggtcagactgtgctatgacccagattttgagaaactgaagccaaaatacttggaggaactccctgaaaagctaaagctctactcagagtttctggggaagcggccatggtttgcaggagacaagatcacctttgtggatttccttgcctatgatgtccttgacatgaagcgtatatttgagcccaagtgcttggacgccttcctaaacttgaaggacttcatctcccgctttgagggtttgaagaagatctctgcctacatgaagtccagccaattcctccgaggtcttttgtttggaaagtcagctacatggaacagcaaatagggcccagtgatgccagaagatgggagggaggagccaaccttgctgcctgcgaccctggaggacagcctgactccctggacctgccttcttcctttttccttctttctactctcttctcttccccaaggcctcattggcttcctttcttctaacatcatccctccccgcatcgaggctctttaaagcttcagctccccactgtcctccatcaaagtccccctcctaacgtcttcctttccctgcactaacgccaacctgactgcttttcctgtcagtgcttttctcttctttgagaagccagactgatctctgagctccctagcactgtcctcaaagaccatctgtatgccctgctccctttgctgggtccctaccccagctccgtgtgatgcccagtaaagcctgaaccatgcctgccatgtcttgtcttattccctgaggctcccttgactcaggactgtgctcgaattgtgggtggttttttgtcttctgttgtccacagccagagcttagtggatgggtgtgtgtgtgtgtgtgttgggggtggtgatcaggcaggttcataaatttccttggtcatttctgccctctagccacatccctctgttcctcactgtggggattactacagaaaggtgctctgtgccaagttcctcactcattcgcgctcctgtaggccgtctagaactggcatggttcaaagaggggctaggctgatggggaagggggctgagcagctcccaggcagactgccttctttcaccctgtcctgatagacttccctgatctagatatccttcgtcatgacacttctcaataaaacgtatcccaccgtattgtaatcatggtacttgtttttcacccaaactcaatcataaatttattgaagagaaa

SEQ ID NO: 63559 - DNA, 1144 bp, Homo sapiens
tcctgggcctctcaaagtctgagccccgctccgctgatgcctgtctgcagaatccgcaccaaccagcaccatgcccatgactctggggtactgggacatccgtgggctggcccacgccatccgcttgctcctggaatacacagactcaagctatgtggaaaagaagtacacgctgggggacgctcctgactatgacagaagccagtggctgaatgaaaaattcaagctgggcctggactttcccaatctgccctacttgattgatggggctcacaagatcacccagagcaatgccatcctgcgctacattgcccgcaagcacaacctgtgtggggagacagaagaggagaagattcgtgtggacattttggagaaccaggttatggataaccacatggagctggtcagactgtgctatgacccagattttgagaaactgaagccaaaatacttggaggaactccctgaaaagctaaagctctactcagagtttctggggaagcggccatggtttgcaggagacaagatcacctttgtggatttccttgcctatgatgtccttgacatgaagcgtatatttgagcccaagtgcttggacgccttcctaaacttgaaggacttcatctcccgctttgagggtttgaagaagatctctgcctacatgaagtccagccaattcctccgaggtcttttgtttggaaagtcagctacatggaacagcaaatagggcccagtgatgccagaagatgggagggaggagccaaccttgctgcctgcgaccctggaggacagcctgactccctggacctgccttcttcctttttccttctttctactctcttctcttccccaaggcctcattggcttcctttcttctaacatcatccctccccgcatcgaggctctttaaagcttcagctccccactgtcctccatcaaagtccccctcctaacgtcttcctttccctgcactaacgccaacctgactgcttttcctgtcagtgcttttctcttctttgagaagccagactgatctctgagctccctagcactgtcctcaaagaccatctgtatgccctgctccctttgctgggtccctaccccagctccgtgtgatgcccagtaaagcctgaaccatgcctgc

SEQ ID NO: 63560 - DNA, 3279 bp, Homo sapiens
  misc_feature (1)..(1): n is a, c, g, or t
  misc_feature (123)..(123): n is a, c, g, or t
  misc_feature (2290)..(2290): n is a, c, g, or t
  misc_feature (2817)..(2817): n is a, c, g, or t
ngttttttctaaaggaccaaggctctcaataagcttccctagcccctggcaagccggctaattgcatgagggagttgacttgtacttcccagccaccaataataccgtcaattgaggagcccntggtcagctgtgacggctggggagctacggtggctccggaggcatccggaaagggcagaaatccacctgtagctctgggacctcgagggaactctctgcttgatgctgtgccgtggcatccccaaaccccatatgttgtcatctctggtccacaggtgtcacaggtggcctcccacacgccccctcctatgccttcaggcaaatggagaagctgtggcaatcgtccccgttctgtggcagatatatcgtgaggaacgcaggcgccacgctcactcgtgggagagaccaggccccaccgtggatctacacatccagactccctggcacctcgacgctacccaaatgctttcctcatcaaggcctcctcgctcctgagacctggccctgccacacgctccaagaccaccgacccctctgcccccgtcctcccttcctgggcacacggccaccccgacatccctgagcaggcaaggagctcttgcatttgctgtctcctctgctcaccaggatggcagacactgcttcttctcagggaggccctggcgcggggtcccctccccaccttctctggagctggtcctcatcccgatgggaaactgttttgcctggcgctgctgccccactgcacagagcgcacaaggtgtggggggaggggtgggcacagacactcacagccccacctagcccaaggaaggtgcatgtcaacctgtcagatgacagatggccactttgacctggggctggacgtcgctggagcccccagccagatgtggcctcagtcacaggcctggggcttgtgtggctcagggctgccggggagaccccaagaggacatgggcagctggagctcaggactagcggagcggccagacgtcctgcccatgcaggctgcatctgtgccctggctgcccacccaccaacgtcctgcccacgctcaccagggccttgcttggccagatgtccagtaggctttgggcggggccatccagccttggcaaggcccatggactgtcacagccctccccaccccacatccaggacaaggtcatctagcgccacaccaggtggatggttcagaaaggctgggttctccaagctgcacaccagaggctgcacagagctgaagtccggcgagtcccaaggctcccagggcggcccgctgccccacaccctccggcaaacacgaaggcgccaccctcggcacccagcagcatctgcctcagcccctgcagagggcggcgctggtgtgggctgcagagagtatggcccgcaggcagccgccatgggcctgcccgagctgagtggctttcagcagaccaggcggccactcaggcctgcgtggactggatgtgtccccagaatccacatgctgaaaccctcactccagtgtgatggtgttaggagagggggcctttgggggtgactgggtcaggagggtggagccctcggaagaggaccagcaccctcaggggaagagacacgggcgctgggttcccttctctgcttcgtgccatgtggggacatgggaaggcatcgtctgcaagccaggaagccggccctcacagaaccgagtctgcccgctccttgatcttgacctctggcttccagaactgtgagaaataaatttctgttgtttaaggcaccaagtcaaagttactctgttgtagttgcccaagtgagacagaacctcatgctacccagacaagtggagagagtcagcccccaccccacgggagggtggggatgggagcgagacagcgagagccttattctgagagggcgtcaggaggagggcaggaaggtgcccaggtgagtcaatttcccggcttggacacgcccctcttccctggtctcacacaggaaggtgcccaggtgagtccagttcccggctcggacacgcccctcttccctggtctctctcgggaaggtgcccaggtgagtccagttcccggctcggacacgcccctcttccctggtctcgcacgggaagtcgcccaggtgagtccagttcccggctcggacacgcccctcttccctggtctcgcacgggaagtcgcccaggtgagtccagttcccggctcggacacgcccctcttccctggtctcgtgcgggaagttgcccaggtgagtccagttcctggctcggacacgcccctcttccctggtntctcacagatcctcccactggttgaattgaagagagcatgatgtgtccatccctgcggctcggacgagctggccccatcctggagaccagccttttgcttaatcacacttcctggcatcccacctacagagatgaaatccatttaggtcaattgctctcacccaggggttttgttcccaagggagcatctagagagtctggagacagttttggtcgtcacagcagaggggcagatggtatggcatccagtgggtggaggccaggggggtgggggggcaccaagcaccctgcagggcacagggcagcccccacagagcacagcgtcatccagccccaatgccagtcatgctgacattaagaaaacatggtgtaaggccagtcacggtggctcacacctgtaatcccagcactttgggaggctgaggtgggcgaatcacaaggtcaggagttcgagaccagcctggccaacataatgaaaccccatctctactaaaaatacaataaattagctgggcatggtggtgggngcctgtaatcccagctactcgggagactgaggcagaagaatcgcttgaacccagaaggcggaagttgcagtgagccgagatcgcgccactgcacagccagggcgacggtgcaagactccgtctcaaaaaaaaaagaaaacatggtgtaagttaacaatgtcctttcttaaaatgcaaataggacgggtgaggtagctcacacctgtaatcccagcacttcgggaggtcaaggtaggtggatcacctaaggtcaggagttgaagaccagcctggccaacatggcaaaaacctgtctctactaaaaatacaaaaattagccgggcgtggtggtgggcacctattatcccagctactcgggaggccaaggcaggaagatggcttgaaccctgggagcggagattgcagtgagctgagatcgtgccattgcactccagcctggcgacaagagcgagactccgtctc

SEQ ID NO: 63561 - DNA, 626 bp, Homo sapiens
aaaatacttgtagttcagttcaatacattaagcttctactatgagtcaaatattgttctaggatttagggatataaagaaaaggccaagatgtaattctcttagccaaactggagctttgaacaataaaataggagtctgtgaggcaaacagaggagggatgggaattacaggtagagggaacagcctgtgcaaaggcactgagacagtgcctgggaaactgaaataatttaatattactggagcagagtattggcatagacaaactcagagactaggcagggcctaggtcataaaggtttatgccaagtcctataaggaataaggagcctttgaagcattttaagtaagagaataacagttgtatttgcaaaaaataactttttacttcctgattataaaatcaactatattccttatagaaaatttggaaagtacagaaaggtttttaatacagacatacacccaaattgtaataaaggtaggtacatgtatgtgtgtgtatatttctatgcatttttatcaaaggaagagaacatcttcccatatcattaaatagccttcaaaagcaggttaagttccctcagaggtttaaacgtagagttaccacatgacccaggaattggt

SEQ ID NO: 63562 - DNA, 322 bp, Homo sapiens
cccctcccagaactactgttctgtggctgccaatatgaatgcctagaataagttaagaggaagatcagtacaggtggaatagcaggagatattttagtaacagtttaattattaatttttgataaaaggttctgattggtcatttctcctacgaaagtcataattacaaggacttatacttttccaaaagtacctttttaaaaggtagagacagtccaggctgttcttgaactcctgacctcgtgatccacccccctcggcctcccaaagtgttgggaaatacaggcgtgagccaccgcgcccggcgagaccctgtcttaaa

SEQ ID NO: 63563 - DNA, 841 bp, Homo sapiens
ctagcatcagtgtgatgggctgctcctggtacagttacaaagtgaacatgcttcttgctgctcacatttatccctaatctggagggcaacctggagctaggtaagaacagaacagccctttgacttcaacgcatggacaaaggacaacaaaggcacactcattctgtctcctgctaccctgtgaaaaggtgccttctgccattattgtaagcttcctgaggcctcctcagccatgtggaactaatatttaaaaaaaccatccatgggacagtctaacataacaaagggaattattcatcaagaagaggccctttagcagggtatttaaagtgcccaggtacttacaataacaagttggactgaacacattgtatctcaggaattaagaatttttcctaaaagaagtttccagattgtttgaacttctctggccgcacaatacaggaaggaagactaaagcagcaaagggacattcagcgtctgcagcatgggctggttaactaggattgtctgtcttttctggggagtattacttacagcaagagcaaactatcagaatgggaagaacaatgtgccaaggctgaaattatcctacaaaggtaaatcttatttttcttttatttggttagctttgtaataaccgcccccccccttaattccttgaactccctcccaaccccaaatcatcaaacctttagtttaacctggtaaaccgacgtgattatgtgtatctttctgagatgctttaaacgctttttgtaaaaagcatgtcttctgtttgatatatgacaacttaaatgcaaacaaagaacatttaatcacatttgctgaaaagagctgt

SEQ ID NO: 63564 - DNA, 685 bp, Homo sapiens
cacagccccagagtgtgaaagaagatagccggaaatgtccaaagcagttaagagggcgaacagattttgtctaaaaagataaggcagctaaacagagggtgagaagacatgagccaaatttacacacacaaatagtggaaataatctctgagaatccaatttgggaagaagtgagggagataatagtgctctgagtgcctagtgatgagagaacaaagaggttaacgatgcctgagagacaggatcagtaatgtttccaaggtgtcatggaagagtctgctggcaataggacagaaaatatttaaaaaaaccatccatgggacagtctaacataacaaagggaattattcatcaagaagaggccctttagcagggtatttaaagtgcccaggtacttacaataacaagttggactgaacacattgtatctcaggaattaagaatttttcctaaaagaaggtttctcaggattcatttcattgtataaagtaggaagaaaatttggcaacattaagtttaccattccatcacggttacatatgttgctattaaaaggaatggctacaatgaacaaagaaatgaaaacatattcttgaagatctatattgtatgggactgttaagagaaaataacactgaatttaaatatgcttctttttttcttatggacctttgagtagaataaa

SEQ ID NO: 63565 - DNA, 3002 bp, Homo sapiens
ctagcatcagtgtgatgggctgctcctggtacagttacaaagtgaacatgcttcttgctgctcacatttatccctaatctggagggcaacctggagctaggtaagaacagaacagccctttgacttcaacgcatggacaaaggacaacaaaggcacactcattctgtctcctgctaccctgtgaaaaggtgccttctgccattattgtaagcttcctgaggcctcctcagccatgtggaactaatatttaaaaaaaccatccatgggacagtctaacataacaaagggaattattcatcaagaagaggccctttagcagggtatttaaagtgcccaggtacttacaataacaagttggactgaacacattgtatctcaggaattaagaatttttcctaaaagaagtttccagattgtttgaacttctctggccgcacaatacaggaaggaagactaaagcagcaaagggacattcagcgtctgcagcatgggctggttaactaggattgtctgtcttttctggggagtattacttacagcaagagcaaactatcagaatgggaagaacaatgtgccaaggctgaaattatcctacaaagaaatgttggaatccaacaatgtgatcactttcaatggcttggccaacagctccagttatcataccttccttttggatgaggaacggagtaggctgtatgttggagcaaaggatcacatattttcattcgacctggttaatatcaaggattttcaaaagattgtgtggccagtatcttacaccagaagagatgaatgcaagtgggctggaaaagacatcctgaaagaatgtgctaatttcatcaaggtacttaaggcatataatcagactcacttgtacgcctgtggaacgggggcttttcatccaatttgcacctacattgaaattggacatcatcctgaggacaatatttttaagctggagaactcacattttgaaaacggccgtgggaagagtccatatgaccctaagctgctgacagcatcccttttaatagatggagaattatactctggaactgcagctgattttatggggcgagactttgctatcttccgaactcttgggcaccaccacccaatcaggacagagcagcatgattccaggtggctcaatgatccaaagttcattagtgcccacctcatctcagagagtgacaatcctgaagatgacaaagtatactttttcttccgtgaaaatgcaatagatggagaacactctggaaaagctactcacgctagaataggtcagatatgcaagaatgactttggagggcacagaagtctggtgaataaatggacaacattcctcaaagctcgtctgatttgctcagtgccaggtccaaatggcattgacactcattttgatgaactgcaggatgtattcctaatgaactttaaagatcctaaaaatccagttgtatatggagtgtttacgacttccagtaacattttcaagggatcagccgtgtgtatgtatagcatgagtgatgtgagaagggtgttccttggtccatatgcccacagggatggacccaactatcaatgggtgccttatcaaggaagagtcccctatccacggccaggaacttgtcccagcaaaacatttggtggttttgactctacaaaggaccttcctgatgatgttataacctttgcaagaagtcatccagccatgtacaatccagtgtttcctatgaacaatcgcccaatagtgatcaaaacggatgtaaattatcaatttacacaaattgtcgtagaccgagtggatgcagaagatggacagtatgatgttatgtttatcggaacagatgttgggaccgttcttaaagtagtttcaattcctaaggagacttggtatgatttagaagaggttctgctggaagaaatgacagtttttcgggaaccgactgctatttcagcaatggagctttccactaagcagcaacaactatatattggttcaacggctggggttgcccagctccctttacaccggtgtgatatttacgggaaagcgtgtgctgagtgttgcctcgcccgagacccttactgtgcttgggatggttctgcatgttctcgctattttcccactgcaaagagacgcacaagacgacaagatataagaaatggagacccactgactcactgttcagacttacaccatgataatcaccatggccacagccctgaagagagaatcatctatggtgtagagaatagtagcacatttttggaatgcagtccgaagtcgcagagagcgctggtctattggcaattccagaggcgaaatgaagagcgaaaagaagagatcagagtggatgatcatatcatcaggacagatcaaggccttctgctacgtagtctacaacagaaggattcaggcaattacctctgccatgcggtggaacatgggttcatacaaactcttcttaaggtaaccctggaagtcattgacacagagcatttggaagaacttcttcataaagatgatgatggagatggctctaagaccaaagaaatgtccaatagcatgacacctagccagaaggtctggtacagagacttcatgcagctcatcaaccaccccaatctcaacacgatggatgagttctgtgaacaagtttggaaaagggaccgaaaacaacgtcggcaaaggccaggacataccccagggaacagtaacaaatggaagcacttacaagaaaataagaaaggtagaaacaggaggacccacgaatttgagagggcacccaggagtgtctgagctgcattacctctagaaacctcaaacaagtagaaacttgcctagacaataactggaaaaacaaatgcaatatacatgaacttttttcatggcattatgtggatgtttacaatggtgggaaattcagctgagttccaccaattataaattaaatccatgagtaactttcctaataggcttttttttcctaataccaccg

SEQ ID NO: 63566 - DNA, 540 bp, Homo sapiens
gcacagttgtcaaaacccatagaatatacagcaccagcagtgagtcctaatgtaacctacggacttgggtgataatgacgtgtgaagagacaaggcgggttcatccgttgtaacaaacagccaccctggtagtagggagggcaggaggtatgtagagaactctgtgctttccacgcgattttgctgtgaactaaacagctctaaaaaataaagttcattaattaaaaaaaaaaaaaaaaaaaagggaaatgaccacatgcaaagcactgcgtggagggccacgcatcccaagcaagtcagctagagtagaggcaggaaccaaacagctctatgaggttctggatgagaagccgcatgcaccaccccctccctgctcccgtgtgggacccagtgaagacctcctgtgcccggctgcagctgctgagtgtgggagtgtgctctccacagcaaaccagccgtgaaggctgcacaccttcctgtttctgcccagccacaccacagggcactcagcccttttcctgagcacttgaagctgcgttt

SEQ ID NO: 63567 - DNA, 476 bp, Homo sapiens
tgtgggaaccaggatggaagagtcaggcctccagatagcgtttacttctcctttcttccttgaatcactgtctcagagataattaggttcagaagaggaggaaaaaaaagatgacgtcaacatggagcagagtttttcttagaccttagcctagcaaggaaagagaaatgcctggtctcagtgctgggaagctgtttcagccagagccccgtggctgtgaagagagctctcctgtctggagccaaacagaaagctcataggtcttgaggccagaaaagttagtaggtggcggctctggtcggtgctggaaatggaggccaggatgaactaagaagcaaactaaagatacttgtaatataaggacgtgtaggctgggtgcggtggctcacgcctgtaatcccagcacttcgggaggccaaggcgggcggatcacgaggtcaggagatcgagaccatcctggctaacacggtgaaacc

SEQ ID NO: 63568 - DNA, 1863 bp, Homo sapiens
  misc_feature (251)..(252): n is a, c, g, or t
gttccatcctctgccatctactccactgttcagacacctcctaacctccgtcatgacctgtggcttcaactccataggctgtgggttccgccctggaaacttcagctgtgtctctgcctgcgggccccggccaagccgctgctgcatcaccgccgccccctaccgcggcatctcctgctaccgcggcctcaccgggggctttggcagccacagcgtgtgcgggggcttccgcgccggctcctgcggacgcnncttcggctaccgctccgggggcgtgtgcggacccagccccccatgcatcaccaccgtgtcggtcaacgagagcctcctcacgcccctcaacctggagatagaccccaacgcgcagtgcgtgaagcaggaggagaaggagcagatcaagtccctcaacagcagattcgcggccttcatcgacaaggtgcgcttcctggagcagcagaacaagctgctggagacaaagctgcagttctaccaaaactgcgagtgctgccagagtaacctggagcccctgtttgctggctacatcgagactctgcggcgggaggccgagtgcgtggaggctgacagtgggaggctggcctcagagctcaaccacgtgcaggaggtgctggagggctacaagaagaagtatgaagaagaagtagcacttcgagccacagcagagaacgagtttgtggctctaaagaaggatgtggactgtgcctacctccgcaagtcagacctggaggccaacgtggaggccctgatccaggagattgacttcctgaggcggctgtacgaggaggagatccgcattctccaatcccacatctcagacacctccgtggttgtcaagctggacaacagccgggacctgaacatggactgcatcgttgccgagatcaaggcacagtatgatgacattgccacccgtagccgggctgaggccgagtcctggtatcgcagcaagtgtgaggagatgaaggccacagtgatcaggcacggggagaccctgcgccgcaccaaggaggagatcaacgagctgaaccgcatgatccagaggctgacagccgaggtggagaatgccaagtgccagaactccaagctggaagctgcggtggcccagtctgagcagcagggtgaggcggccctcagtgatgcccgctgcaagctggccgagctggagggcgccctgcagaaggccaagcaagacatggcctgcctgatcagggagtaccaggaggtgatgaactccaagctaggcctggatatcgagatcgccacctacaggcgcctgctggagggcgaggagcagaggctgtgtgaaggtgttgaagctgtgaatgtctgtgtcagcagctcccggggtggggttgtgtgcggggacctctgcgtgtcgggctcccggccggtgacgggcagcgtctgcagtgccccctgcaacgggaacctggtggtgagcactggtttgtgcaagccctgtggccagctgaacaccacctgtggagggggctcctgcggccaggggaggtattaagtggcccaaaagagagccaggggagccccttctgcctgccagacgtgccactgccccaccaccagctgaaaacagcagcacatcgctggcttttccccttgtgttctgagaatacaccatcggctcattcccaccagtggctcctccccacctttcatcccactggaaaggggtctgtggctggggaatagacccattccttcccctgtctcagccttcagcccctcccggggagaagggccttgcttccctggaagaagcactgtgagactgttccccctgcctctctggcctcttgtctccccttttccaataaacttgggacctgc

SEQ ID NO: 63569 - DNA, 293 bp, Homo sapiens
gtttgtagttttggtaaatagaatcatgtaaaaggcatcatggggaacttgttatttccataaccctgtaataatttgttctagtaatccttcgctaatgtaggcacgtgccttctgctttactggtgtgtttgtatgctcttaaagttagacactgtaatttaaaatgctttttgaaaattaaaccaagatcttttagaattgtgcctagttattgcctagttagagtattttattatttctgttactcatcagtaaagtaagatgattggctaatcgtcctgggttctttc

SEQ ID NO: 63570 - DNA, 169 bp, Homo sapiens
  misc_feature (1)..(1): n is a, c, g, or t
  misc_feature (67)..(67): n is a, c, g, or t
nagcagcagattcagtgtctggagagggcttgcttcccggtttgcagatggacatcttattattatntcctcacatccaaaaagtaagctctgttatgtctttttataaggcactaatcccatccatgaggattctatcctaatgacctaatcacctcccaagggcccc

SEQ ID NO: 63571 - DNA, 360 bp, Homo sapiens
atcaaaagcttgagcacaaacagatacctcagcccggagtttctgttcctgttcttgaagagacagactggtgagcatgcaaaattacaggaaatgcagagaacaaaatgggcagagcaaccaaaactgtggtgtttgcatcaaatacaggtcaagagtaaacttattttcctatgaaattcaagaacatgttgaaactggaaagagcgggacaggctggtagcaccttttaaagaccaagagaggccgcctcattaaatattaagaacttggaggaaagaggtggatttacactgataaaaggttcatttaaaattccatgaggtcaataaattaccacttaagatgccatttcccaaa

SEQ ID NO: 63572 - DNA, 286 bp, Homo sapiens
attaaggtaaaggaagactttccattgttaagtagaaagagtgtcctgctattactaccattcacatctagtttgtgtgaactagggttttctatcttaaccctgttaaaaacaaaggaaagaaatgggctgaatggtgcaccagctatgcgggtagcattatcttcctgtgttccagactggaatgaatttatgaacaaggcaagcacaccattattgtaaataaaatcttacctagtttttgtttttgtatttcttactttgtagtatttttctgtgttatatt

SEQ ID NO: 63573 - DNA, 526 bp, Homo sapiens
ctggtcccctctatgaattgatagtgatttccagcattagcctatgagcgctatgcaacatagtatgttttctttatttgtccagattaaaagatagcttaaattatttttatgctcaaattgcagtagcgtcttctaacctaggatttttattatattctcccattcctagtaattataataatgctaacactagctaccactgattgaacatctactatgtgttagccatgtgattagtcttacctattctttacgaactctctgatataattagaaaataatcattcagttgctccataaccagtagtcttaaaatggagaaaaataaatgtagattcgcattcctataatgaataatttaaatgtgaaggaagtaagataacaagaaaagaaagacatttaaaggtaaaattacagcatatgaggaaagggtatggaatgggagaaacagaaacatgggagaaagaggtaagggagacctaggggaagaaagacaaaggaaaagagtttaaagtttggaggt

SEQ ID NO: 63574 - DNA, 3324 bp, Homo sapiens
cgcggggcgctctcgccagtcccgcgggccgtgcgcggtgctgtgccgcgccctgccagacacaggtgcgcccgcctagcccgaactccgcggcggcggctgccctctcgccgcgcctccgcctccttcgcagccgccgcctcctccgcgccgcgctccgcccggatggccagggctgtgcccgagaatggcggagcgagaaagcggcggcctgggagggggggccgcgtccccgcccgccgcctccccgttcctggggctgcacatcgcttcgcctcccaatttcaggctcacccatgacatcagcctggaggagtttgaggatgaagacctctcggagatcactgatgagtgtggcatcagcttacagtgcaaagacaccctgtccttacggcccccgcgcgccgggctgctctctgcgggcggcggcggcgcggggagccggttgcaggccgagatgctgcagatggacctgatcgacgcgacgggggacactcccggggccgaggacgacgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgccgcggtctcaggacacactgaataataattctctgggcaaaaagcacagttggcaggatcgggtgtctcgatcatcctcacccctgaagacaggggagcagacaccaccgcatgaacacatctgcctgagcgatgagctgcccccccagagcggccccgcccccaccacagatcgaggcacctccaccgacagcccttgccgccgcagcacagccacccagatggcacctccgggtggtccccctgctgccccgcctgggggtcggggccactcgcatcgagaccgaatccactaccaggccgatgtgcgactagaggccactgaggagatctacctgaccccagtgcagaggcccccagacgctgcagagcccacctccgccttcctgccgcccactgagagccggatgtcagtcagctccgatccagaccctgccgcctacccctccacggcagggcggccgcacccctccatcagtgaagaggaagagggcttcgactgcctgtcgtccccagagcgggctgagcccccaggcggagggtggcgggggagcctgggggagccgccgccacctccacgggcctctctgagctcggacaccagcgccctgtcctatgactctgtcaagtacacgctggtggtagatgagcatgcacagctggagctggtgagcctgcggccgtgcttcggagactacagtgacgagagtgactctgccaccgtctatgacaactgtgcctccgtctcctcgccctatgagtcggccatcggagaggaatatgaggaggccccgcggccccagccccctgcctgcctctccgaggactccacgcctgatgaacccgacgtccatttctccaagaaattcctgaacgtcttcatgagtggccgctcccgctcctccagtgctgagtccttcgggctgttctcctgcatcatcaacggggaggagcaggagcagacccaccgggccatattcaggtttgtgcctcgacacgaagacgaacttgagctggaagtggatgaccctctgctagtggagctccaggctgaagactactggtacgaggcctacaacatgcgcactggtgcccggggtgtctttcctgcctattacgccatcgaggtcaccaaggagcccgagcacatggcagccctggccaaaaacagtgactgggtggaccagttccgggtgaagttcctgggctcagtccaggttccctatcacaagggcaatgacgtcctctgtgctgctatgcaaaagattgccaccacccgccggctcaccgtgcactttaacccgccctccagctgtgtcctggagatcagcgtgcggggtgtgaagataggcgtcaaggccgatgactcccaggaggccaaggggaataaatgtagccactttttccagttaaaaaacatctctttctgcggatatcatccaaagaacaacaagtactttgggttcatcaccaagcaccccgccgaccaccggtttgcctgccacgtctttgtgtctgaagactccaccaaagccctggcagagtccgtggggagagcattccagcagttctacaagcagtttgtggagtacacctgccccacagaagatatctacctggagtagctgtgcagccccgccctctgcgtcccccagccctcaggccagtgccaggacagctggctgctgacaggatgtggcactgcttgaggaggggcacctgccaccgccagaggacaaggaagtgggggccgctggcccagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccttacctcccctgccagggctcgggcgctgtggctcctgccttgatgaagcccgtgtcctgccttgatgaagcctgtgccacctgcaagtgcccgccctgcccctgccccaacccccaccgaagagccctgagctcaggctgagcccagccacctcccaaggactttccagtgaggaaatggcaacacgtggaggtgaagtccctgttctcagctccgtcatctgcggggcttctgggtggctcctgccactgacctcaccggcatgctggcctgtggcaggcctaggacctcaggcggggaggaggagctgccgcaaggccctgtcccagcagaagagggaggcttcctgactgacacaggccagccccatcttggtcctgtcaccctggccccaactattaaagtgccatttcctcggcacgaggtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaata

SEQ ID NO: 63575 - DNA, 2999 bp, Homo sapiens
cgcggggcgctctcgccagtcccgcgggccgtgcgcggtgctgtgccgcgccctgccagacacaggtgcgcccgcctagcccgaactccgcggcggcggctgccctctcgccgcgcctccgcctccttcgcagccgccgcctcctccgcgccgcgctccgcccggatggccagggctgtgcccgagaatggcggagcgagaaagcggcggcctgggagggggggccgcgtccccgcccgccgcctccccgttcctggggctgcacatcgcttcgcctcccaatttcaggctcacccatgacatcagcctggaggagtttgaggatgaagacctctcggagatcactgatgagtgtggcatcagcttacagtgcaaagacaccctgtccttacggcccccgcgcgccgggctgctctctgcgggcggcggcggcgcggggagccggttgcaggccgagatgctgcagatggacctgatcgacgcgacgggggacactcccggggccgaggacgacgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgccgcggtctcaggacacactgaataataattctctgggcaaaaagcacagttggcaggatcgggtgtctcgatcatcctcacccctgaagacaggggagcagacaccaccgcatgaacacatctgcctgagcgatgagctgcccccccagagcggccccgcccccaccacagatcgaggcacctccaccgacagcccttgccgccgcagcacagccacccagatggcacctccgggtggtccccctgctgccccgcctgggggtcggggccactcgcatcgagaccgaatccactaccaggccgatgtgcgactagaggccactgaggagatctacctgaccccagtgcagaggcccccagacgctgcagagcccacctccgccttcctgccgcccactgagagccggatgtcagtcagctccgatccagaccctgccgcctacccctccacggcagggcggccgcacccctccatcagtgaagaggaagagggcttcgactgcctgtcgtccccagagcgggctgagcccccaggcggagggtggcgggggagcctgggggagccgccgccacctccacgggcctctctgagctcggacaccagcgccctgtcctatgactctgtcaagtacacgctggtggtagatgagcatgcacagctggagctggtgagcctgcggccgtgcttcggagactacagtgacgagagtgactctgccaccgtctatgacaactgtgcctccgtctcctcgccctatgagtcggccatcggagaggaatatgaggaggccccgcggccccagccccctgcctgcctctccgaggactccacgcctgatgaacccgacgtccatttctccaagaaattcctgaacgtcttcatgagtggccgctcccgctcctccagtgctgagtccttcgggctgttctcctgcatcatcaacggggaggagcaggagcagacccaccgggccatattcaggtttgtgcctcgacacgaagacgaacttgagctggaagtggatgaccctctgctagtggagctccaggctgaagactactggtacgaggcctacaacatgcgcactggtgcccggggtgtctttcctgcctattacgccatcgaggtcaccaaggagcccgagcacatggcagccctggccaaaaacagtgactgggtggaccagttccgggtgaagttcctgggctcagtccaggttccctatcacaagggcaatgacgtcctctgtgctgctatgcaaaagattgccaccacccgccggctcaccgtgcactttaacccgccctccagctgtgtcctggagatcagcgtgcggggtgtgaagataggcgtcaaggccgatgactcccaggaggccaaggggaataaatgtagccactttttccagttaaaaaacatctctttctgcggatatcatccaaagaacaacaagtactttgggttcatcaccaagcaccccgccgaccaccggtttgcctgccacgtctttgtgtctgaagactccaccaaagccctggcagagtccgtggggagagcattccagcagttctacaagcagtttgtggagtacacctgccccacagaagatatctacctggagtagctgtgcagccccgccctctgcgtcccccagccctcaggccagtgccaggacagctggctgctgacaggatgtggcactgcttgaggaggggcacctgccaccgccagaggacaaggaagtgggggccgctggcccagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccttacctcccctgccagggctcgggcgctgtggctcctgccttgatgaagcccgtgtcctgccttgatgaagcctgtgccacctgcaaccacctcccaaggactttccagtgaggaaatggcaacacgtggaggtgaagtccctgttctcagctccgtcatctgcggggcttctgggtggctcctgccactgacctcaccggcatgctggcctgtggcaggcctaggacctcaggcggggaggaggagctgccgcaaggccctgtcccagcagaagagggaggcttcctgactgacacaggccagccccatcttggtcctgtcaccctggccccaactattaaagtgccatttcct

SEQ ID NO: 63576 - DNA, 3102 bp, Homo sapiens
ggaaggtgcctgcagctgagggctgcgctgggaagagctggggctgggacccgggtcggcagctgcagcctcctctcctggcctgtctatttttaatgagctccccaggcttctgcagcaggcaggacgcagaaagacaggcccaagcggtggaggccagaggcccccagccctgccttgagccctggcccccccacccttccgggcatgagagggcagccctggggccccgcagccccccggccgggcagggctctccatgcagctggtgctgaagatggattcgagcccagacaatgacagctggttggaggatcaatgggagcgctggctcacccatgacatcagcctggaggagtttgaggatgaagacctctcggagatcactgatgagtgtggcatcagcttacagtgcaaagacaccctgtccttacggcccccgcgcgccgggctgctctctgcgggcggcggcggcgcggggagccggttgcaggccgagatgctgcagatggacctgatcgacgcgacgggggacactcccggggccgaggacgacgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgccgcggtctcaggacacactgaataataattctctgggcaaaaagcacagttggcaggatcgggtgtctcgatcatcctcacccctgaagacaggggagcagacaccaccgcatgaacacatctgcctgagcgatgagctgcccccccagagcggccccgcccccaccacagatcgaggcacctccaccgacagcccttgccgccgcagcacagccacccagatggcacctccgggtggtccccctgctgccccgcctgggggtcggggccactcgcatcgagaccgaatccactaccaggccgatgtgcgactagaggccactgaggagatctacctgaccccagtgcagaggcccccagacgctgcagagcccacctccgccttcctgccgcccactgagagccggatgtcagtcagctccgatccagaccctgccgcctacccctccacggcagggcggccgcacccctccatcagtgaagaggaagagggcttcgactgcctgtcgtccccagagcgggctgagcccccaggcggagggtggcgggggagcctgggggagccgccgccacctccacgggcctctctgagctcggacaccagcgccctgtcctatgactctgtcaagtacacgctggtggtagatgagcatgcacagctggagctggtgagcctgcggccgtgcttcggagactacagtgacgagagtgactctgccaccgtctatgacaactgtgcctccgtctcctcgccctatgagtcggccatcggagaggaatatgaggaggccccgcggccccagccccctgcctgcctctccgaggactccacgcctgatgaacccgacgtccatttctccaagaaattcctgaacgtcttcatgagtggccgctcccgctcctccagtgctgagtccttcgggctgttctcctgcatcatcaacggggaggagcaggagcagacccaccgggccatattcaggtttgtgcctcgacacgaagacgaacttgagctggaagtggatgaccctctgctagtggagctccaggctgaagactactggtacgaggcctacaacatgcgcactggtgcccggggtgtctttcctgcctattacgccatcgaggtcaccaaggagcccgagcacatggcagccctggccaaaaacagtgactgggtggaccagttccgggtgaagttcctgggctcagtccaggttccctatcacaagggcaatgacgtcctctgtgctgctatgcaaaagattgccaccacccgccggctcaccgtgcactttaacccgccctccagctgtgtcctggagatcagcgtgcggggtgtgaagataggcgtcaaggccgatgactcccaggaggccaaggggaataaatgtagccactttttccagttaaaaaacatctctttctgcggatatcatccaaagaacaacaagtactttgggttcatcaccaagcaccccgccgaccaccggtttgcctgccacgtctttgtgtctgaagactccaccaaagccctggcagagtccgtggggagagcattccagcagttctacaagcagtttgtggagtacacctgccccacagaagatatctacctggagtagctgtgcagccccgccctctgcgtcccccagccctcaggccagtgccaggacagctggctgctgacaggatgtggcactgcttgaggaggggcacctgccaccgccagaggacaaggaagtgggggccgctggcccagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccttacctcccctgccagggctcgggcgctgtggctcctgccttgatgaagcccgtgtcctgccttgatgaagcctgtgccacctgcaagtgcccgccctgcccctgccccaacccccaccgaagagccctgagctcaggctgagcccagccacctcccaaggactttccagtgaggaaatggcaacacgtggaggtgaagtccctgttctcagctccgtcatctgcggggcttctgggtggctcctgccactgacctcaccggcatgctggcctgtggcaggcctaggacctcaggcggggaggaggagctgccgcaaggccctgtcccagcagaagagggaggcttcctgactgacacaggccagccccatcttggtcctgtcaccctggccccaactattaaagtgccatttcct

SEQ ID NO: 63577 - DNA, 2149 bp, Homo sapiens
gctgcagatgaacccgacgtccatttctccaagaaattcctgaacccgacgtccatttctccaagaaattccgaatccactaccaggccgatgtgcgactagaggccactgaggagatctacctgaccccagtgcagaggcccccagacgctgcagagcccacctccgccttcctgccgcccactgagagccggatgtcagtcagctccgatccagaccctgccgcctacccctccacggcagggcggccgcacccctccatcagtgaagaggaagagggcttcgactgcctgtcgtccccagagcgggctgagcccccaggcggagggtggcgggggagcctgggggagccgccgccacctccacgggcctctctgagctcggacaccagcgccctgtcctatgactctgtcaagtacacgctggtggtagatgagcatgcacagctggagctggtgagcctgcggccgtgcttcggagactacagtgacgagagtgactctgccaccgtctatgacaactgtgcctccgtctcctcgccctatgagtcggccatcggagaggaatatgaggaggccccgcggccccagccccctgcctgcctctccgaggactccacgcctgatgaacccgacgtccatttctccaagaaattcctgaacgtcttcatgagtggccgctcccgctcctccagtgctgagtccttcgggctgttctcctgcatcatcaacggggaggagcaggagcagacccaccgggccatattcaggtttgtgcctcgacacgaagacgaacttgagctggaagtggatgaccctctgctagtggagctccaggctgaagactactggtacgaggcctacaacatgcgcactggtgcccggggtgtctttcctgcctattacgccatcgaggtcaccaaggagcccgagcacatggcagccctggccaaaaacagtgactgggtggaccagttccgggtgaagttcctgggctcagtccaggttccctatcacaagggcaatgacgtcctctgtgctgctatgcaaaagattgccaccacccgccggctcaccgtgcactttaacccgccctccagctgtgtcctggagatcagcgtgcggggtgtgaagataggcgtcaaggccgatgactcccaggaggccaaggggaataaatgtagccactttttccagttaaaaaacatctctttctgcggatatcatccaaagaacaacaagtactttgggttcatcaccaagcaccccgccgaccaccggtttgcctgccacgtctttgtgtctgaagactccaccaaagccctggcagagtccgtggggagagcattccagcagttctacaagcagtttgtggagtacacctgccccacagaagatatctacctggagtagctgtgcagccccgccctctgcgtcccccagccctcaggccagtgccaggacagctggctgctgacaggatgtggcactgcttgaggaggggcacctgccaccgccagaggacaaggaagtgggggccgctggcccagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccttacctcccctgccagggctcgggcgctgtggctcctgccttgatgaagcccgtgtcctgccttgatgaagcctgtgccacctgcaagtgcccgccctgcccctgccccaacccccaccgaagagccctgagctcaggctgagcccagccacctcccaaggactttccagtgaggaaatggcaacacgtggaggtgaagtccctgttctcagctccgtcatctgcggggcttctgggtggctcctgccactgacctcaccggcatgctggcctgtggcaggcctaggacctcaggcggggaggaggagctgccgcaaggccctgtcccagcagaagagggaggcttcctgactgacacaggccagccccatcttggtcctgtcaccctggccccaactattaaagtgccatttcct

SEQ ID NO: 63578 - DNA, 1518 bp, Homo sapiens
gcctggtggcgaattcggcacgaggggacaaggaagtggggcaatggggagaggcaaatccagtgctgagtccttcgggctgttctcctgcatcatcaacggggaggagcaggagcagacccaccgggccatattcaggtttgtgcctcgacacgaagacgaacttgagctggaagtggatgaccctctgctagtggagctccaggctgaagactactggtacgaggcctacaacatgcgcactggtgcccggggtgtctttcctgcctattacgccatcgaggtcaccaaggagcccgagcacatggcagccctggccaaaaacagtgactgggtggaccagttccgggtgaagttcctgggctcagtccaggttccctatcacaagggcaatgacgtcctctgtgctgctatgcaaaagattgccaccacccgccggctcaccgtgcactttaacccgccctccagctgtgtcctggagatcagcgtgcggggtgtgaagataggcgtcaaggccgatgactcccaggaggccaaggggaataaatgtagccactttttccagttaaaaaacatctctttctgcggatatcatccaaagaacaacaagtactttgggttcatcaccaagcaccccgccgaccaccggtttgcctgccacgtctttgtgtctgaagactccaccaaagccctggcagagtccgtggggagagcattccagcagttctacaagcagtttgtggagtacacctgccccacagaagatatctacctggagtagctgtgcagccccgccctctgcgtcccccagccctcaggccagtgccaggacagctggctgctgacaggatgtggcactgcttgaggaggggcacctgccaccgccagaggacaaggaagtgggggccgctggcccagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccttacctcccctgccagggctcgggcgctgtggctcctgccttgatgaagcccgtgtcctgccttgatgaagcctgtgccacctgcaagtgcccgccctgcccctgccccaacccccaccgaagagccctgagctcaggctgagcccagccacctcccaaggactttccagtgaggaaatggcaacacgtggaggtgaagtccctgttctcagctccgtcatctgcggggcttctgggtggctcctgccactgacctcaccggcatgctggcctgtggcaggcctaggacctcaggcggggaggaggagctgccgcaaggccctgtcccagcagaagagggaggcttcctgactgacacaggccagccccatcttggtcctgtcaccctggccccaactattaaagtgccatttcct

SEQ ID NO: 63579 - DNA, 112 bp, Homo sapiens
tgctcagctccctcctgctctttctgcccctcctcaattcacgcttgctttccagccctggccaaaaacagtgactgggtggaccagttccgggtgaagttcctgggctcag

SEQ ID NO: 63580 - DNA, 300 bp, Homo sapiens
gctggccgtcagaggcacggctggatcggggaggcggcggcctcgcgcttcctcgcggcggacgggcgagagcgccccagtctccggcggcccctgctcggctcccctcgtgcccccttcgcgccacagaatggactcgcccgggcggggggcggtgcaagcggcctcggccccgccccggccccgccccctgacgcccctccgtgcgctgtgcagcccccgcgcgccgggctgctctctgcgggcggcggcggcgcggggagccggttgcaggccgagatgctgcagatggacctgatc

SEQ ID NO: 63581 - DNA, 3060 bp, Homo sapiens
cgcggggcgctctcgccagtcccgcgggccgtgcgcggtgctgtgccgcgccctgccagacacaggtgcgcccgcctagcccgaactccgcggcggcggctgccctctcgccgcgcctccgcctccttcgcagccgccgcctcctccgcgccgcgctccgcccggatggccagggctgtgcccgagaatggcggagcgagaaagcggcggcctgggagggggggccgcgtccccgcccgccgcctccccgttcctggggctgcacatcgcttcgcctcccaatttcaggctcacccatgacatcagcctggaggagtttgaggatgaagacctctcggagatcactgatgagtgtggcatcagcttacagtgcaaagacaccctgtccttacggcccccgcgcgccgggctgctctctgcgggcggcggcggcgcggggagccggttgcaggccgagatgctgcagatggacctgatcgacgcgacgggggacactcccggggccgaggacgacgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgccgcggtctcaggacacactgaataataattctctgggcaaaaagcacagttggcaggatcgggtgtctcgatcatcctcacccctgaagacaggggagcagacaccaccgcatgaacacatctgcctgagcgatgagctgcccccccagagcggccccgcccccaccacagatcgaggcacctccaccgacagcccttgccgccgcagcacagccacccagatggcacctccgggtggtccccctgctgccccgcctgggggtcggggccactcgcatcgagaccgaatccactaccaggccgatgtgcgactagaggccactgaggagatctacctgaccccagtgcagaggcccccagacgctgcagagcccacctccgccttcctgccgcccactgagagccggatgtcagtcagctccgatccagaccctgccgcctacccctccacggcagggcggccgcacccctccatcagtgaagaggaagagggcttcgactgcctgtcgtccccagagcgggctgagcccccaggcggagggtggcgggggagcctgggggagccgccgccacctccacgggcctctctgagctcggacaccagcgccctgtcctatgactctgtcaagtacacgctggtggtagatgagcatgcacagctggagctggtgagcctgcggccgtgcttcggagactacagtgacgagagtgactctgccaccgtctatgacaactgtgcctccgtctcctcgccctatgagtcggccatcggagaggaatatgaggaggccccgcggccccagccccctgcctgcctctccgaggactccacgcctgatgaacccgacgtccatttctccaagaaattcctgaacgtcttcatgagtggccgctcccgctcctccagtgctgagtccttcgggctgttctcctgcatcatcaacggggaggagcaggagcagacccaccgggccatattcaggtttgtgcctcgacacgaagacgaacttgagctggaagtggatgaccctctgctagtggagctccaggctgaagactactggtacgaggcctacaacatgcgcactggtgcccggggtgtctttcctgcctattacgccatcgaggtcaccaaggagcccgagcacatggcagccctggccaaaaacagtgactgggtggaccagttccgggtgaagttcctgggctcagtccaggttccctatcacaagggcaatgacgtcctctgtgctgctatgcaaaagattgccaccacccgccggctcaccgtgcactttaacccgccctccagctgtgtcctggagatcagcgtgcggggtgtgaagataggcgtcaaggccgatgactcccaggaggccaaggggaataaatgtagccactttttccagttaaaaaacatctctttctgcggatatcatccaaagaacaacaagtactttgggttcatcaccaagcaccccgccgaccaccggtttgcctgccacgtctttgtgtctgaagactccaccaaagccctggcagagtccgtggggagagcattccagcagttctacaagcagtttgtggagtacacctgccccacagaagatatctacctggagtagctgtgcagccccgccctctgcgtcccccagccctcaggccagtgccaggacagctggctgctgacaggatgtggcactgcttgaggaggggcacctgccaccgccagaggacaaggaagtgggggccgctggcccagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccttacctcccctgccagggctcgggcgctgtggctcctgccttgatgaagcccgtgtcctgccttgatgaagcctgtgccacctgcaagtgcccgccctgcccctgccccaacccccaccgaagagccctgagctcaggctgagcccagccacctcccaaggactttccagtgaggaaatggcaacacgtggaggtgaagtccctgttctcagctccgtcatctgcggggcttctgggtggctcctgccactgacctcaccggcatgctggcctgtggcaggcctaggacctcaggcggggaggaggagctgccgcaaggccctgtcccagcagaagagggaggcttcctgactgacacaggccagccccatcttggtcctgtcaccctggccccaactattaaagtgccatttcct

SEQ ID NO: 63582 - DNA, 2957 bp, Homo sapiens
cgcggggcgctctcgccagtcccgcgggccgtgcgcggtgctgtgccgcgccctgccagacacaggtgcgcccgcctagcccgaactccgcggcggcggctgccctctcgccgcgcctccgcctccttcgcagccgccgcctcctccgcgccgcgctccgcccggatggccagggctgtgcccgagaatggcggagcgagaaagcggcggcctgggagggggggccgcgtccccgcccgccgcctccccgttcctggggctgcacatcgcttcgcctcccaatttcaggctcacccatgacatcagcctggaggagtttgaggatgaagacctctcggagatcactgatgagtgtggcatcagcttacagtgcaaagacaccctgtccttacggcccccgcgcgccgggctgctctctgcgggcggcggcggcgcggggagccggttgcaggccgagatgctgcagatggacctgatcgacgcgacgggggacactcccggggccgaggacgacgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgccgcggtctcaggacacactgaataataattctctgggcaaaaagcacagttggcaggatcgggtgtctcgatcatcctcacccctgaagacaggggagcagacaccaccgcatgaacacatctgcctgagcgatgagctgcccccccagagcggccccgcccccaccacagatcgaggcacctccaccgacagcccttgccgccgcagcacagccacccagatggcacctccgggtggtccccctgctgccccgcctgggggtcggggccactcgcatcgagaccgaatccactaccaggccgatgtgcgactagaggccactgaggagatctacctgaccccagtgcagaggcccccagacgctgcagagcccacctccgccttcctgccgcccactgagagccggatgtcagtcagctccgatccagaccctgccgcctacccctccacggcagggcggccgcacccctccatcagtgaagaggaagagggcttcgactgcctgtcgtccccagagcgggctgagcccccaggcggagggtggcgggggagcctgggggagccgccgccacctccacgggcctctctgagctcggacaccagcgccctgtcctatgactctgtcaagtacacgctggtggtagatgagcatgcacagctggagctggtgagcctgcggccgtgcttcggagactacagtgacgagagtgactctgccaccgtctatgacaactgtgcctccgtctcctcgccctatgagtcggccatcggagaggaatatgaggaggccccgcggccccagccccctgcctgcctctccgaggactccacgcctgatgaacccgacgtccatttctccaagaaattcctgaacgtcttcatgagtggccgctcccgctcctccagtgctgagtccttcgggctgttctcctgcatcatcaacggggaggagcaggagcagacccaccgggccatattcaggtttgtgcctcgacacgaagacgaacttgagctggaagtggatgaccctctgctagtggagctccaggctgaagactactggtacgaggcctacaacatgcgcactggtgcccggggtgtctttcctgcctattacgccatcgaggtcaccaaggagcccgagcacatggcagccctggccaaaaacagtgactgggtggaccagttccgggtgaagttcctgggctcagtccaggttccctatcacaagggcaatgacgtcctctgtgctgctatgcaaaagattgccaccacccgccggctcaccgtgcactttaacccgccctccagctgtgtcctggagatcagcgtgcggggtgtgaagataggcgtcaaggccgatgactcccaggaggccaaggggaataaatgtagccactttttccagttaaaaaacatctctttctgcggatatcatccaaagaacaacaagtactttgggttcatcaccaagcaccccgccgaccaccggtttgcctgccacgtctttgtgtctgaagactccaccaaagccctggcagagtccgtggggagagcattccagcagttctacaagcagtttgtggagtacacctgccccacagaagatatctacctggagtagctgtgcagccccgccctctgcgtcccccagccctcaggccagtgccaggacagctggctgctgacaggatgtggcactgcttgaggaggggcacctgccaccgccagaggacaaggaagtgggggccgctggcccagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccttacctcccctgccagggctcgggcgctgtggctcctgccttgatgaagcccgtgtcctgccttgatgaagcctgtgccacctgcaagtgcccgccctgcccctgccccaacccccaccgaagagccctgagctcaggctgagcccagccacctcccaaggactttccagtgaggaaatggcaacacgtggaggtgaagtccctgttctcagctccgtcatctgcggggcttctgggtggctcctgccactgacctcgccagccccatcttggtcctgtcaccctggccccaactattaaagtgccatttcct

SEQ ID NO: 63583 - DNA, 2398 bp, Homo sapiens
gcactgttgaccacttccatcacaagagccttttgttccctgcacaggacacactgaataataattctctgggcaaaaagcacagttggcaggatcgggtgtctcgatcatcctcacccctgaagacaggggagcagacaccaccgcatgaacacatctgcctgagcgatgagctgcccccccagagcggccccgcccccaccacagatcgaggcacctccaccgacagcccttgccgccgcagcacagccacccagatggcacctccgggtggtccccctgctgccccgcctgggggtcggggccactcgcatcgagaccgaatccactaccaggccgatgtgcgactagaggccactgaggagatctacctgaccccagtgcagaggcccccagacgctgcagagcccacctccgccttcctgccgcccactgagagccggatgtcagtcagctccgatccagaccctgccgcctacccctccacggcagggcggccgcacccctccatcagtgaagaggaagagggcttcgactgcctgtcgtccccagagcgggctgagcccccaggcggagggtggcgggggagcctgggggagccgccgccacctccacgggcctctctgagctcggacaccagcgccctgtcctatgactctgtcaagtacacgctggtggtagatgagcatgcacagctggagctggtgagcctgcggccgtgcttcggagactacagtgacgagagtgactctgccaccgtctatgacaactgtgcctccgtctcctcgccctatgagtcggccatcggagaggaatatgaggaggccccgcggccccagccccctgcctgcctctccgaggactccacgcctgatgaacccgacgtccatttctccaagaaattcctgaacgtcttcatgagtggccgctcccgctcctccagtgctgagtccttcgggctgttctcctgcatcatcaacggggaggagcaggagcagacccaccgggccatattcaggtttgtgcctcgacacgaagacgaacttgagctggaagtggatgaccctctgctagtggagctccaggctgaagactactggtacgaggcctacaacatgcgcactggtgcccggggtgtctttcctgcctattacgccatcgaggtcaccaaggagcccgagcacatggcagccctggccaaaaacagtgactgggtggaccagttccgggtgaagttcctgggctcagtccaggttccctatcacaagggcaatgacgtcctctgtgctgctatgcaaaagattgccaccacccgccggctcaccgtgcactttaacccgccctccagctgtgtcctggagatcagcgtgcggggtgtgaagataggcgtcaaggccgatgactcccaggaggccaaggggaataaatgtagccactttttccagttaaaaaacatctctttctgcggatatcatccaaagaacaacaagtactttgggttcatcaccaagcaccccgccgaccaccggtttgcctgccacgtctttgtgtctgaagactccaccaaagccctggcagagtccgtggggagagcattccagcagttctacaagcagtttgtggagtacacctgccccacagaagatatctacctggagtagctgtgcagccccgccctctgcgtcccccagccctcaggccagtgccaggacagctggctgctgacaggatgtggcactgcttgaggaggggcacctgccaccgccagaggacaaggaagtgggggccgctggcccagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccttacctcccctgccagggctcgggcgctgtggctcctgccttgatgaagcccgtgtcctgccttgatgaagcctgtgccacctgcaagtgcccgccctgcccctgccccaacccccaccgaagagccctgagctcaggctgagcccagccacctcccaaggactttccagtgaggaaatggcaacacgtggaggtgaagtccctgttctcagctccgtcatctgcggggcttctgggtggctcctgccactgacctcaccggcatgctggcctgtggcaggcctaggacctcaggcggggaggaggagctgccgcaaggccctgtcccagcagaagagggaggcttcctgactgacacaggccagccccatcttggtcctgtcaccctggccccaactattaaagtgccatttcct

SEQ ID NO: 63584 - DNA, 1915 bp, Homo sapiens
cgcaggtaggcatgtttgaggaacagaagagatcacttggttggatcgttgtaagtggttaggaagagcagggtgagagaagataagagaaggaatgcgggggccaagccttgtagggccatggtaagacatggtaaattttcagtacagaaataatcagatttatttctgagataattttggctgccatgtgaagaatgggctgtagggggcgagagtggaagcaggaagaccagctttaggaggtctttgcagaagttgagcaatgatggtggcctgaaataggatgggagtggcagctgtgggagccaccctgtgggcggggccttgtaccgtacaaggccccgcggccccagccccctgcctgcctctccgaggactccacgcctgatgaacccgacgtccatttctccaagaaattcctgaacgtcttcatgagtggccgctcccgctcctccagtgctgagtccttcgggctgttctcctgcatcatcaacggggaggagcaggagcagacccaccgggccatattcaggtttgtgcctcgacacgaagacgaacttgagctggaagtggatgaccctctgctagtggagctccaggctgaagactactggtacgaggcctacaacatgcgcactggtgcccggggtgtctttcctgcctattacgccatcgaggtcaccaaggagcccgagcacatggcagccctggccaaaaacagtgactgggtggaccagttccgggtgaagttcctgggctcagtccaggttccctatcacaagggcaatgacgtcctctgtgctgctatgcaaaagattgccaccacccgccggctcaccgtgcactttaacccgccctccagctgtgtcctggagatcagcgtgcggggtgtgaagataggcgtcaaggccgatgactcccaggaggccaaggggaataaatgtagccactttttccagttaaaaaacatctctttctgcggatatcatccaaagaacaacaagtactttgggttcatcaccaagcaccccgccgaccaccggtttgcctgccacgtctttgtgtctgaagactccaccaaagccctggcagagtccgtggggagagcattccagcagttctacaagcagtttgtggagtacacctgccccacagaagatatctacctggagtagctgtgcagccccgccctctgcgtcccccagccctcaggccagtgccaggacagctggctgctgacaggatgtggcactgcttgaggaggggcacctgccaccgccagaggacaaggaagtgggggccgctggcccagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccttacctcccctgccagggctcgggcgctgtggctcctgccttgatgaagcccgtgtcctgccttgatgaagcctgtgccacctgcaagtgcccgccctgcccctgccccaacccccaccgaagagccctgagctcaggctgagcccagccacctcccaaggactttccagtgaggaaatggcaacacgtggaggtgaagtccctgttctcagctccgtcatctgcggggcttctgggtggctcctgccactgacctcaccggcatgctggcctgtggcaggcctaggacctcaggcggggaggaggagctgccgcaaggccctgtcccagcagaagagggaggcttcctgactgacacaggccagccccatcttggtcctgtcaccctggccccaactattaaagtgccatttcct

SEQ ID NO: 63585 - DNA, 250 bp, Homo sapiens
cacaggatgcttttgcaaatgtttactgaaataacgatgctgctgtggctcccagaccccagagtaggcctggctggacaggccttggtgccgaatttctcacctgtccttgctggggacaggtttgtgcctcgacacgaagacgaacttgagctggaagtggatgaccctctgctagtggagctccaggctgaagactactggtacgaggcctacaacatgcgcactggtgcccggggtgtctttcctg

SEQ ID NO: 63586 - DNA, 2233 bp, Homo sapiens
ctctctccacactgggaggaggaggaggaggaaggggaggcagcaggggaaaacataggagaaaaaagtgaaagcagagaagaaaagttaggagactcattgcaagatttatacagggcactggagcaggccagtctgtcaccactaggagaacatcgtatttcaaccaagatggaatacaagctatcatttataaaaagatgtaatgatcctgtaatgaatgaaaaactacaccggctgagaattctcaaaagcactttaaaggccagagaaggggaagtagccattatcgataaagtcctagacaatccagacttgacatctaaagaattccaacaatggaagcagatgtacctcgaccttttcttggatatctgtcaaaataccacctcaaatgacccactgagtatttcttctgaagtagatgtaatcacttcctctctagcacacactcattcatacattgaaacgcatgtctaaatgtattctgccttcagaccatctagtacctgctggtactctgaacaagtatataaggtagtttttatatcaatgtgtggaacacttgacaagctatactttaatgttaccaaactatatgaaacaaaccatatatggtcacaataccactatctttaatgagcatttgtatattttatatgcaacagtgctcagcttatgtttaccatgtgcaaaatcaactgtctttaatgacttaaaattaacttttgcaaacaattctaaatacaggtggtcttcaagtagtaaaaccacaaaaggcagttttctatctatggtcatcttttctccctttaagttaattttatataaacaagacttcaaaagtaaatcacattttttcaggtgcagacatccttgtgggtgggaaagaatttaaaccttttttatatttattaaaatgttctaagaattttcttaaacattgcacaaagtttaatgctgtagttttatttttgtgaaatgtagatgcgcatacaagagctaagcaaaatagaagagcatcgacataagaaaagttcaggtatctaatattcgtcttaatagtctattaacttgtgaaagctaagttaatggaaatattattccaaatctatgagaacacttggtgtatcagggcaaagctttgtaagatgtttttgtaactaagaccaaaattgaagatagagctgctttattttcttggtttaaaatcttcctttatttttgtagtgatgagatgctgattgtgtacagaagaatttgagaggggatttttaaaaactgacttaacacacccagaaaggcagctaacagctatatatatatataaatttcagcccaaactcatgtttttaaactccaactcttaaaagacaacaaggtataaactgaaatgaatcaactttccacttagtttccaattttcccctagtccactaattaaacttaggtaattatacttcaggtagggaagtacaatatgtttagtttcaggctgatgtgtgttataaaaaacaacactgaaaaataaaaatgtacttcccttctaaggagcaagcaggtgatggtcattcaaagagatgtcacattgaattatgagagaaacaatttagaggtttttttcctggcttcatgaattgttctatagagtggatgaagtctaaggaaaagtcctcttcatatatttccatttataagcgtcttgtttttgaaagtgatcacagcatgaaaatgactgtgctgctttttagtgtctggctgcataatgtacaagtcacaatttgctgtttttttcaggaggagaaagggaacctcctttactattctatatcctaaaatctacttctaatcagctttatactgttgcctgtacagctcagtgaatgtactttcatctttaagagttcagatatatgccagtgaatatttttgctgtagaggagaaagtaaaaactccacagcggggatctttttctttgcttttgaaaccaccattgaatcactatcgttttgcagactttgcacaactgtacaggagagtggcctttctacagcacattttcagtaatcctatatttagtcaaaatggatgagaaatcatgtattaatgtttgtatggaattttgggtccagtgtaatatttttatcatttaaaaagaactctatttgtaaaaacatttatttactgcatggatattgacgcacattaaatttgtgggattttgtatatgta

SEQ ID NO: 63587 - DNA, 3245 bp, Homo sapiens
  misc_feature (2377)..(2377): n is a, c, g, or t
  misc_feature (2522)..(2522): n is a, c, g, or t
ctctctccacactgggaggaggaggaggaggaaggggaggcagcaggggaaaacataggagaaaaaagtgaaagcagagaagaaaagttaggagactcattgcaagatttatacagggcactggagcaggccagtctgtcaccactaggagaacatcgtatttcaaccaagatggaatacaagctatcatttataaaaagatgtaatgatcctgtaatgaatgaaaaactacaccggctgagaattctcaaaagcactttaaaggccagagaaggggaagtagccattatcgataaagtcctagacaatccagacttgacatctaaagaattccaacaatggaagcagatgtacctcgaccttttcttggatatctgtcaaaataccacctcaaatgacccactgagtatttcttctgaagtagatgtaatcacttcctctctagcacacactcattcatacattgaaacgcatgtctaaatgtattctgccttcagaccatctagtacctgctggtactctgaacaagtatataaggtagtttttatatcaatgtgtggaacacttgacaagctatactttaatgttaccaaactatatgaaacaaaccatatatggtcacaataccactatctttaatgagcatttgtatattttatatgcaacagtgctcagcttatgtttaccatgtgcaaaatcaactgtctttaatgacttaaaattaacttttgcaaacaattctaaatacaggtggtcttcaagtagtaaaaccacaaaaggcagttttctatctatggtcatcttttctccctttaagttaattttatataaacaagacttcaaaagtaaatcacattttttcaggtgcagacatccttgtgggtgggaaagaatttaaaccttttttatatttattaaaatgttctaagaattttcttaaacattgcacaaagtttaatgctgtagttttatttttgtgaaatgtagatgcgcatacaagagctaagcaaaatagaagagcatcgacataagaaaagttcaggtatctaatattcgtcttaatagtctattaacttgtgaaagctaagttaatggaaatattattccaaatctatgagaacacttggtgtatcagggcaaagctttgtaagatgtttttgtaactaagaccaaaattgaagatagagctgctttattttcttggtttaaaatcttcctttatttttgtagtgatgagatgctgattgtgtacagaagaatttgagaggggatttttaaaaactgacttaacacacccagaaaggcagctaacagctatatatatatataaatttcagcccaaactcatgtttttaaactccaactcttaaaagacaacaaggtataaactgaaatgaatcaactttccacttagtttccaattttcccctagtccactaattaaacttaggtaattatacttcaggtagggaagtacaatatgtttagtttcaggctgatgtgtgttataaaaaacaacactgaaaaataaaaatgtacttcccttctaaggagcaagcaggtgatggtcattcaaagagatgtcacattgaattatgagagaaacaatttagaggtttttttcctggcttcatgaattgttctatagagtggatgaagtctaaggaaaagtcctcttcatatatttccatttataagcgtcttgtttttgaaagtgatcacagcatgaaaatgactgtgctgctttttagtgtctggctgcataatgtacaagtcacaatttgctgtttttttcaggaggagaaagggaacctcctttactattctatatcctaaaatctacttctaatcagctttatactgttgcctgtacagctcagtgaatgtactttcatctttaagagttcagatatatgccagtgaatatttttgctgtagaggagaaagtaaaaactccacagcggggatctttttctttgcttttgaaaccaccattgaatcactatcgttttgcagactttgcacaactgtacaggagagtggcctttctacagcacattttcagtaatcctatatttagtcaaaatggatgagaaatcatgtattaatgtttgtatggaattttgggtccagtgtaatatttttatcatttaaaaagaactctatttgtaaaaacatttatttactgcatggatattgacgcacattaaatttgtgggattttgtatatgtaaaaaaaaaaaaaaaaaaaaaaaacaaaaaaaacctctcttgtgttccttaaaagtgaagtgtggtgctgtgtgttaacacgggtgtgttttagaactttttggaatgttttcacttagaaccaactgtgtgtgtcttgtgttcncactttaaaaattatttgtgttccctgtgattggcagtggtgtctaagtggtctcaccagtgggcccagggtctgtggtgcgcctgtgttaaaacaacgcaaagccagttctgaacggggcaagaacttacgcctcgtgttggcnatacataaagcaagctttataaccgtttgtgggtaaaggctcaagcccatgtgcgtgggcttctcacaacggtgggtacacaaccatcttcaaacgcttaactggggaacttttggcacacaaagcactctcggggggctattcgctctatagtcatttgaaacaagagaccccttcttgcaccactttattttataacctaccctccgggtacccattgtgttaatttgggcaactcccgggctttccaacgaaacctccctaaggggaaccgaacaacagcgcggcgcagcccccctgttggctaaccacctggggagcaggtccccacaaactctacaaccttctcacgacggctgtgggcttcacaacgtggcaaaccaacatacgacaagcacacaaaaacagctctcctacacaagagcgcgcgttggagaaatcgccgacggccaaacatgagagggagccacgagaccaacacattctaccgaagcgggggggggaggaccgccgcgagatacacaccaccagcagttgattggtggttcccccatcttatagggagcgagcgcggcgcgtatcaacaatcacccaccgaaagccatgagatgggcagggagaaaaacacaagtggagtcacgaagagcagcgcagggctgccccgtcggggcggctagaaccaagctgtgagtaacataccgcggaccaccagcaatgtcccca

SEQ ID NO: 63588 - DNA, 287 bp, Homo sapiens
ctctctccacactgggaggaggaggaggaggaaggggaggcagcaggggaaaacataggagaaaaaagtgaaagcagagaagaaaagttaggagactcattgcaagatttatacagggcactggagcaggccagtctgtcaccactaggagaacatcgtatttcaaccaagatggaatacaagctatcatttataaaaagatgtaatgatcctgtaatgaatgaaaaactacaccggctgagaattctcaaaagcactttaaaggtaagacaagaaatggaaggaca

SEQ ID NO: 63589 - DNA, 2667 bp, Homo sapiens
ctctctccacactgggaggaggaggaggaggaaggggaggcagcaggggaaaacataggagaaaaaagtgaaagcagagaagaaaagttaggagactcattgcaagatttatacagggcactggagcaggccagtctgtcaccactaggagaacatcgtatttcaaccaagatggaatacaagctatcatttataaaaagatgtaatgatcctgtaatgaatgaaaaactacaccggctgagaattctcaaaagcactttaaaggccagagaaggggaagtagccattatcgataaagtcctagacaatccagacttgacatctaaagaattccaacaatggaagcagatgtacctcgaccttttcttggatatctgtcaaaataccacctcaaatgacccactgagtatttcttctgaagtagatgtaatcacttcctctctagcacacactcattcatacattgaaacgcatgtctaaatgtattctgccttcagaccatctagtacctgctggtactctgaacaagtatataaggtagtttttatatcaatgtgtggaacacttgacaagctatactttaatgttaccaaactatatgaaacaaaccatatatggtcacaataccactatctttaatgagcatttgtatattttatatgcaacagtgctcagcttatgtttaccatgtgcaaaatcaactgtctttaatgacttaaaattaacttttgcaaacaattctaaatacaggtggtcttcaagtagtaaaaccacaaaaggcagttttctatctatggtcatcttttctccctttaagttaattttatataaacaagacttcaaaagtaaatcacattttttcaggtgcagacatccttgtgggtgggaaagaatttaaaccttttttatatttattaaaatgttctaagaattttcttaaacattgcacaaagtttaatgctgtagttttatttttgtgaaatgtagatgcgcatacaagagctaagcaaaatagaagagcatcgacataagaaaagttcaggtatctaatattcgtcttaatagtctattaacttgtgaaagctaagttaatggaaatattattccaaatctatgagaacacttggtgtatcagggcaaagctttgtaagatgtttttgtaactaagaccaaaattgaagatagagctgctttattttcttggtttaaaatcttcctttatttttgtagtgatgagatgctgattgtgtacagaagaatttgagaggggatttttaaaaactgacttaacacacccagaaaggcagctaacagctatatatatatataaatttcagcccaaactcatgtttttaaactccaactcttaaaagacaacaaggtataaactgaaatgaatcaactttccacttagtttccaattttcccctagtccactaattaaacttaggtaattatacttcaggtagggaagtacaatatgtttagtttcaggctgatgtgtgttataaaaaacaacactgaaaaataaaaatgtacttcccttctaaggagcaagcaggtgatggtcattcaaagagatgtcacattgaattatgagagaaacaatttagaggtttttttcctggcttcatgaattgttctatagagtggatgaagtctaaggaaaagtcctcttcatatatttccatttataagcgtcttgtttttgaaagtgatcacagcatgaaaatgactgtgctgctttttagtgtctggctgcataatgtacaagtcacaatttgctgtttttttcaggaggagaaagggaacctcctttactattctatatcctaaaatctacttctaatcagctttatactgttgcctgtacagctcagtgaatgtactttcatctttaagagttcagatatatgccagtgaatatttttgctgtagaggagaaagtaaaaactccacagcggggatctttttctttgcttttgaaaccaccattgaatcactatcgttttgcagactttgcacaactgtacaggagagtggcctttctacagcacattttcagtaatcctatatttagtcaaaatggatgagaaatcatgtattaatgtttgtatggaattttgggtccagtgtaatatttttatcatttaaaaagaactctatttgtaaaaacatttatttactgcatggatattgacgcacattaaatttgtgggattttgtatatgtaaaaaaaaaaaaaaaaaaaaaaaacaaaaaacctcttgtcctaaaatgaagtgtgcttgttaacaggtgtttagacttattgatgtttactagaccaaatgtgtatgttcacttaaaaatatatgtacctgatggatgtgtcatgtttacagtggccaggttgtggcctgtaaacagcaagcagttgacgggaagactagctctgttgctactaagcagcttttacttttgtaaagtcagctctgttgttttaaatggtaaaaattaaactaatgaatttgacaagactcgtggctagcctagcatgaaagagaccttttaacactatataatatctgtacattttattgcattcgtttcaaatctaggagagaggcagcactgtaaactgaagtcaaataaattcagctcttaatgaatccttgttagggccct

SEQ ID NO: 63590 - DNA, 985 bp, Homo sapiens
ccaaggttcagtgttacccctcatcaaccagcccagcagcatcttcgggattcccaatggcattgccctttgctttaatgatggccctggtggtgctcagctgcaagtcaagctgctctctgggctgtaatctgtctcaaacccacagcctgaataacaggaggactttgatgctcatggcacaaatgaggagaatctctcctttctcctgcctgaaggacagacatgactttgaatttccccaggaggaatttgatggcaaccagttccagaaagctcaagccatctctgtcctccatgagatgatgcagcagaccttcaatctcttcagcacaaagaactcatctgctgcttgggatgagaccctcctagaaaaattctacattgaacttttccagcaaatgaatgacctggaagcctgtgtgatacaggaggttggggtggaagagactcccctgatgaatgaggactccatcctggctgtgaagaaatacttccaaagaatcactctttatctgatggagaagaaatacagcccttgtgcctgggaggttgtcagagcagaaatcatgagatccttctctttttcaacaaacttgcaaaaaagattaaggaggaaggattgaaaactggttcatcatggaaatgattctcattgactaatacatcatctcacactttcatgttcttccatttcaaagactcacttctataaccaccacaagttgaatcaaaatttccaaatgttttcaggagtgttaagaagcatcgtgtttacctgtgcaggcactagtcctttacagatgaccattctgatgtctcctttcatctatttatttaaatatttatttatttaactatttttattatttaaattattttttatgtaatatcatgagtacctttacattgtggttaatgtaacaaatatgttcttcatatttagccaatatattaatttcctttttcattaaatttttactat

SEQ ID NO: 63591 - DNA, 295 bp, Homo sapiens
atcccaaagattctcctgaggaagcccagaagagccacggggaaatgcaggctctgccagcaattgggccttggagggctgccctgctaagggggtggaaaggctgtttgcctccctccccccatgcccagagctgccagagcacattccttttgtgaggaggccacagacgttcagctgccccagcttccagtttcgggtggcccagccaactttcatgccagccgtcctcagcccttcctggtgctgggtctgccaggctcatggtcagccaggcctggggccctggagaggt

SEQ ID NO: 63592 - DNA, 446 bp, Homo sapiens
ttgatttatcccatttttaatcaaagtaaggtaccaacacatgcaggatgtagtaattcacagtctcaagattaaatgctgataaaaatttgtagcagttttagcatcaaatatatcctcacccataacaaggaggtcactctattagtgagcaagtctgggcacaaaatggggaagtccattgtccagtttgaataatgtagtggaatctaaagctttgtggataagaatgactgaccctgtaatgtcctcggtgcatctgtacttgaagtgagattaacataagcgtgatctgcaggaaataggtaccctttaaagataccttcagctgtgtgtgtgagagagagcagggccacggggtgtcgtggggtagggggaaaggagagaggacctaagagactgagtgaaggcaatttacttatcaatgttcaattttcctaaatgtc

SEQ ID NO: 63593 - DNA, 330 bp, Homo sapiens
ctctccaggtgtctagtattttttttaacatgaatatcttggcactgtccatagccaggctttctaccttttgtggataagggacaaggaagaatgagagagagaatagaacaaattaggtctcttattcagagacagagaaagaggattcctccagatttttccagccttccagtccattttgaatgcctaagcacacatccattcttagattctgagacatttcagttgctttcaaatatttatcactttttaaaataaactttaaaaactttagaatagttttagatttatagaaagttgtaaagataatacagttttcataaaccg

SEQ ID NO: 63594 - DNA, 375 bp, Homo sapiens
  misc_feature (30)..(30): n is a, c, g, or t
  misc_feature (37)..(37): n is a, c, g, or t
  misc_feature (77)..(77): n is a, c, g, or t
  misc_feature (131)..(131): n is a, c, g, or t
gcccaaaataaccttccctcaaaaccctanggggccnccctgtaaaaattgggggctcacctcccctaaacaaaagnccacacccctaaaaatcccctttgaggataagcccattcctcgttccttgaaantcccgctgagaggcaatagcttttagcttccttagaaactctcctctttgatggttgggcgtgggtggcacgcttgtactcccaaaatgctgggattacaggcgtgagccactgcacaggcctaattgatattattcttgtattaaattatttcatggtattgctctaaaattttaaactcttaggacataatgtcctgtgtttagtcctaaacctatactttcagtcagaacttaaaattata

SEQ ID NO: 63595 - DNA, 2156 bp, Homo sapiens
tcatgccgttgcactccagcgtgggtgacagagagactccatctcaaaaaatacatatagagagagagaggatttctaccccctccagttccccaactttagttccccaacatcagtatttcccatgtttgcttcgttattctctctctccctctctctcttatttttctggacagaaggagagtcacttcatacatgatacccctttaacctaaaatacttccatgtatatttcctcaagataaagacacttataaaaccacagtacagtgatcaaaatgaagaagttgacactgatccaatgctattctctaattgtagaccttactcatgtttctccaattgtccttttaacatcctttatagcaaaaaaaaaaaaaaaaagctcttgttgtttctcctgacatgggatccaatccaggatcccatgtcgtatctctttaatttcctttccttgggatcggtttctctgtttttcatgacctttacttttttgaagagtgcagcgcatttattttttagaggatcccttggtcagggtgcatgccccatgtcttcccagtcaggttcagataccatgttttggcggcaacaccactgatgtggccagtccctgttggtatatcccaccaggaagtgggtgacggtgtctgtcccatcactggggatgggaactctgatcctgggttgagctggtctgcccattttcactacggtcaagttaatatttctcctttgctaattagtaagtgtcttatggggaaatgagtatcctgtttttattgaacattcaccgactagttgtagcatccattaatgattcttgccggaaatgtttattactgtgttgtcatatggtccgatttttttttttttttgagatggagtttcgctcttgttgtccaggctggagtgcagtggcacgatctcagctcaccacaacctccgcttcccgggttcaagcgattctcctgcctcagcctctcaagtagctgggattacaggcatgcaccaccacacccggctaattttgtgtagtagagatgggatttcaccttgttggtcaggctggtctcaaactcccgacctcagttgatccgcctgcctcagcctcccaaagtgctgggattacaggcgtgagctgccacccctggcccaaatggtgaattttctaatattattctttctatatttgttacttgccattcaactgtaggaagagctttccaacctcatgtgtttttttcattcacttagttatatcaggatagatccacgaagttttacttgatgctatagatgagaatcttttacgaacactctttatgttgctgttttgattgtctgagattcggtcagtgggagccccctcggaatggctttttccttagaccatttgatgcggccctaccagcctttaagcattttatactttgtgtcatggttcgatgctccgggctcatctcgtgtcttctctctcccagccctgaaccagccatttctccaaggagccctcctctttcttcaacagtggtgttcagaaacccagacctggacactgccatatggcattgcttttaggccctctcagtcagcagagcaggaggagtgggggtgtgagcatgtgcacacgagcgcctgccacctacacacactaattgctatgtacaagccgtgagttcccacagatatcccagccccactccctgtgctacagtgagcgttctcccttccccgtccacctttgtaactccttagacagtaagaacctggaccccatcatccatggtgcctttactgacttgctgagtcctacaacacaggtaaagggttcagaagtccctgcccttacccgatggaaaactccgggcatgctttcggtatttgttcagttctttttgtctttagcctcagggtgtggtgattacactgaatttacaaatgacttaaattagttcttttcacctttagtacaattacgttattgattgaaaacacacctgattgcgtttttccatttgtgttccatttgttttctcccctacccagttcctctttttttttaatctgttcccacccactccctgtaggtaactaatcagtttcttatttgcttttcttttttacataaaaggtagtgtattatagacataata

SEQ ID NO: 63596 - DNA, 517 bp, Homo sapiens
gaaatgcttttggcagagtttctcataagccccagcatttctaaaggttggtggtgggtggagccgtgctcctaacactgatgactctcccttccccgtccacctttgtaactccttagacagtaagaacctggaccccatcatccatggtgcctttactgacttgctgagtcctacaacacaggtaaagggttcagaagtccctgcccttacccgatggaaaactccgggcatgctttcggtatttgttcagttctttttgtctttagcctcagggtgtggtgattacactgaatttacaaatgacttaaattagttcttttcacctttagtacaattacgttattgattgaaaacacacctgattgcgtttttccatttgtgttccatttgttttctcccctacccagttcctctttttttttaatctgttcccacccactccctgtaggtaactaatcagtttcttatttgcttttcttttttacataaaaggtagtgtattatagacataata

SEQ ID NO: 63597 - DNA, 501 bp, Homo sapiens
aatgaagagcacatcaaggcaagcagatccagaggtgaagaagagagcctgatgacattgcatggtctcctcaatgtatttgtacctgacccatgacagactgcccacttacttaagatgataaatttcctcctttctgtctgtttgcttagggtaatttgagatatatttctagcctaactttgagaaacttctaatatgcccattaatctttaattaaaatgtagtatcatatagtcatattttgcctaatacataatatgatttccaaaaccttgtctagatgggaagcttaccagacttccaatagcaaaactgtgatatatttaaactatgccgtggagtacagatcactgtaagaaatctcaacaaaactgaatatctgtatttgtgtcctagattttttttaactcattattttcaatactgtttatgcttcccaactcaagagtgcctaggaagaattgagaagacatgaaaacatggattttacttgatcaa

SEQ ID NO: 63598 - DNA, 436 bp, Homo sapiens
tttttttttgagatggaatcttgctctgtcgcccatgctggagtgcggtggcgccatctcagctcactgcaatctccgtttcctgggttcaagcgattctcctgcctcggcctcttgagtagctgggattacaggcgcctaccacctcacccagctaattttttattttttagtagacacagggtttcaccatgttggtcaggctggtcttgaactcctgacctcgtgatccacccgcctcagcctcccaaagtgctgggattacaggcacaagccaccgcgcccggccgacagtaaatacttttaatagaccaccagcatcttgaaaatatggaccacgtattccttattcaactttatatcccagaatcagcattgtgtacataagaggtactccatgtttgctgaatggatgattaaataagcaaatgaattc

SEQ ID NO: 63599 - DNA, 464 bp, Homo sapiens
gtatataatacatttacaaaatatgtgctaatcaattatttttatctttttaaaaatagagatggggtctcgctatgttgcccaggctcaaactcctggtctcaagtggtcctcctgccttggcctcctaaaatgctggaattacaggtgtgagccaccatgccccaaccagaatacagtatatactacatataacatataaaatatgttaatcaacaatttctattatcagtaaggcttccagttaatggtaggctattagtagttaagtttttgggaatcaagttacatgtaggttttcattgtgtgggggttggcaccccaacgcccatattaagggtcaactgtatatggaaatatagcctgaaatctgtaatgaattacacttatttgaaaattgcttttggctggaagtatttcaggtaagtttctacttcaactttagtgtcattgtttacatattc

SEQ ID NO: 63600 - DNA, 314 bp, Homo sapiens
cattcagtagtatgtgttcaaaaagggtaaaaggaagcctatgaagaagagggagaaaagaaacaattttctgagtatcagatgagtgactggaaacacctgaatcctattaaatttcagagtcttggttatcaaaaggaattttaaaatatttgggaggagaaaaaagattcaagtaattaagaattataattcaagcaaaagatttcccaaaacttcatttaactgtattggagtgctttacacttggtttaacattgaaagtatgttcttttagaataaaatgatttccagatgcatgtactttacataga

SEQ ID NO: 63601 - DNA, 421 bp, Homo sapiens
acatgtctattcaggtcttttgcccattttgaaatagcattgcttgttcttttgctggatattaaccccttgtcaggtgcacagtttgcaagttaccttttctcatcctataggttatctcctcactcttgattgtttctgttgctgtgcagtagcttttaagtttggtgtaataccattgtgttttctctgctgcccttttaagtttcactgggtcaaaagtttaaaatttgtgaattcctatatttttagggcaattctcctgccactgttggaattatgcctcaatctatgcagtagaatattagtgtgaaatgcttctgtaccaatggagatgatgctgatgtctctatcataaacccatacctcatcaacacaaactgcaattacacaagtgctctaatatcatgtatctccattt

SEQ ID NO: 63602 - DNA, 454 bp, Homo sapiens
aaaaaatactagtaaaatctgcagaccttgggtaaaggcatacaagtactatcaggacactgccagactagatggtagttcttaacatatattgcttaacctgtctgagacacaatttcttctgtgaaatgagtggggctgatttttctttctagttttaaaattcccaagataaagcgttttgaaacaacagcaaaaagcaagaaaaggaagtagtcaaaaacttcatttccattatgcagacataaagaacattctcagtaaagccatctcttccgtgggtcttccacaccctaggaagtcatcagtggccttcctgttgtaagcataaaacatagtgcagttcagcttttagagccaacaattgcagtaagtctttctttataccttcttaaaatcatatttttatttccaacattgtactatttttttattttttaagaagcacatgtac

SEQ ID NO: 63603 - DNA, 759 bp, Homo sapiens
gggacacagaaccaaaccatatcacctcgctagatgggatttcccgcgtcaggtgcttgatggtgaaaatgaatcctaggacagctgtttaatctgtggctgtcacttcagaaatcgggagacaagttctggaagccagaagtctgcaatccaggtgctgtccaggctggtgccttctggaggctctgagggtgagcctccagctcttccaccttgcctcttccagcatgaggtggcgctggcaggctttgctgttccttggcttgtgcacttgaccttgaaccacaaggtctgaactgcaggggccacttagatgcacatttcttctggttctgccaccccgagacaccaagatcagcaacctcctctgcctgttcagtgtgaagatgatgaggatgaagagctcgataatgacccacttccacctcacaaatagtaaacatattttcccttccttacgattttcttaataacattttccttttctgggtgactttattgtgagaaaaacagtatatgatacatacaacatatacatatgtgtcaatcaactgcttacgttattggtaagtcttgttgtcaacaataggctgttactagttaacgttttggggaagtcaaaagttatataaaggccgagcgctgtaactcacatctgtaatctgagcactttggggagggcgaggtgggaggaccacttgaacccagcggtttgaaaccagcctgggccgcatattgagacccatctgttaaagaaca

SEQ ID NO: 63604 - DNA, 391 bp, Homo sapiens
gcgtggtggtgcgtgcctgtaaatcccagctactacggagtctgaggcaggaaaatcccttgaaccagggagtcggaggttgcagtgagccgagagcacgccactgcactcccgcctagcgacagagtgagactccgtctcaaaacaaaacaaaacaaaacaaaaaaccaaaaacactgggagtcccagtttgtaggaaatcattaagattttattatttgagctccagaacgagtgaggatgacctgataattttggtttggctcaggttgtaatgtgtttctgttttgctcgatgactactagaacagttctcaaactgtgtggtgggtaagaatcacctgggaacttgaccaagtgacatgtctacaccacccgcccctacaggctct

SEQ ID NO: 63605 - DNA, 468 bp, Homo sapiens
gaacagttcacaatagggttcactctccaatgagaatctaatgctgccgctgatctgacaggtgccagagctcaggcggtaatacgagaggctggagatacagataaagcttcagttgcttgcccgccacttacctcctcttgtgcggcccagttcctaacaggccacagaccgctaccagtccatggcctggaagttggggacccctctactgggatatttataattgcatatgtggttacctaatatttccatgatacaacactggtctagattctaggccattctccttcaaaaagaaccctgcttccttacagttttactgtttagcagcaatgttttctaccccttcttaaaattttcagctaccacacccctgttttgttctaatattaaagatgacatctaacactcaatttttctttctgctccaagctccatcatcattctgggacatttttggcccat

SEQ ID NO: 63606 - DNA, 882 bp, Homo sapiens
gtcatataatagttaaaacaacagtaccaacctacatgaagaatttagaaatggcatatatacaagactgttcattgcaactcattcattacataagaggaagggggacactaaatcactgtcagtaaggcgttaatattatattacatttctgcattagaatacccttcagccataaaaaagaataaagagtatttttgtgtagaatgatctgcaagatacatttaatgaaaaagcaaggtgctgaacaatatgtaatatgctgcctactcttgctattaaaatgggaggaaatgaggatgatttttacataaatacatattgcttgtatatgcataaaatatttcttgaagcctttagagaagggaaccaggtaactaggaataaaagtaaggagggaaacttttcattacatacctatctagttcaggccactataacaaagccctatagactgattggctaatgaacaacagaagttttatttctcacagttctagaaactggaagtctgagatcagcgtgctagcggggttggattctagtgagagcgtttttctgggttggagactgctgacatctccttgtagcctcatatggcagaaagaatgagggagttatcttggggtcccttttataaaggcatgaatcccattcatgtgggccctgctctcataaattatggcataattacttctcaaaggctctacctcccaataccatcactttaggagttaggatttcaacataccaattttgggaggcaggacacaaacattcagtccataacaatgccattttgcaacttgaaagttttaactgtgtgattatgttgcctgtttaaaacatttgttaggttaattgaaaaagatgaaaaaaaaa

SEQ ID NO: 63607 - DNA, 426 bp, Homo sapiens
ctcctgccacagcctcccaaagtgctgggattacaggcatgagccaccatgcccagcccctgcctttctgagtagctgggactagtggtgcttgcctctgcgccaggctccagtcatttcttagtgttcaatacacacgctctgagttctccacatagaatagatgactaagagtggatgtccctgtggccagcagctatgcccctcaccagcctttgtgaatgaccttcaaagctcttgttgaattttctgtctctgaggtctcttgaaataaggcttgtgaagtgtcttgagatcctcacaacaggtggtatacaatgaaaaatgtcaatgttctcctagttttgtttctttgatcaccatttcatccctccttccggtgcctgcagctgccctcagccttcaaagtgattctcactggagaga

SEQ ID NO: 63608 - DNA, 166 bp, Homo sapiens
aaacaaatgagctctgggtggaaataaaaatagcctccaatgataaagtaatgtaaaaataaaaaggaatatacgttctctagaaaaactggaaaatgtgaacaatagtttgacatgctacattgagttccgcagaaacaacaaaaacaagaacgacacagggcgg

SEQ ID NO: 63609 - DNA, 362 bp, Homo sapiens
ttacctcagttcactctcatgctatatattaaaaataatttacagggacactcagtaggaggttgaattatacgccagactgagacaggatgctgctgggggtgctgtatggaatttcccagcaaaagattctttcattagtttcaccaaatataccatttccacttagttttaaaagaaagtcaaactgaactgccatttgagattacatagaatgcacaagacccaatctgagaccctatgtttaaaaaaacaaaactgttttataatctaatcagcctgtcaaaggcatcactcataagcaaccgaattgtatttttggagagcaccattaaagatgtcttttaaaaaacagttataga

SEQ ID NO: 63610 - DNA, 1022 bp, Homo sapiens
acaaaagagtgctaactactctaggagagattaaagcctgtgaaatagaacttttccagataatggcgagtttttaggcttgctcatgctgaagcttaatataagctaataagtagagaaattaggaggcttggatattgcaaactttattggttggggtgttacccaggctaatagaaaaaaaattatatcctagaaagacagaacaggtgcgacttctgagaagaaaggttagagaagactagaaaggctgggaccaccttgaatttggcacacacacacacacacccacacgcacacacaaaatcaccaaatgatctggaatgtgctatgcgatgagtcagcctccactgctgtacgtccttggctacagactcctggaacagcagctcttctcaaggctagttgtgacagactcctggaacagcagctcttctcaaggctagttgtgacatccaaagtgacaagagcaggcccatattcagccacctcatccaggccttatcaaagaagagtcttatatgagatcaaatggctgcctttccccacaagattatatttttcctggtatgctctactttgacacatgtggctttctcaggaattttcaataaacgtgacttcactaggtggcctaagccccgatgtaaaatgtatatcccactggaccctgattacaatgcagactgccccaatgtgacagcacctgtttgtgcctcaaatggccacactttccagaatgagtgtttcttttgtgttgaacagagggaatttcattatcgtataaaatttgaaaaatatggaaaatgtgattaatgggtaccagagtaactacacttgcttattctttttctacttaattcagaatagtatttcttttagagtgtgagaatgtaaattaaataacatccctatgctgtacttaaatgtcgaacaaaatgagagacaaaaatgaaggaatcaaactgacaagaaccaaatatcacatttgttacaaataaacaacaaaagagctgatattc

SEQ ID NO: 63611 - DNA, 407 bp, Homo sapiens
aaacaaaaatgaaaaaaaaaaagaaggatgtaaagggaatttaaaagcagctcccttttcaggacctcttttagaagataaggaaaagtacattcaataccaatgttcactttccttatgatactaatcttctttttttctcttctctttagggaatttcattatcgtataaaatttgaaaaatatggaaaatgtgattaatgggtaccagagtaactacacttgcttattctttttctacttaattcagaatagtatttcttttagagtgtgagaatgtaaattaaataacatccctatgctgtacttaaatgtcgaacaaaatgagagacaaaaatgaaggaatcaaactgacaagaaccaaatatcacatttgttacaaataaacaacaaaagagctgatattc

SEQ ID NO: 63612 - DNA, 109 bp, Homo sapiens
cctacaaacaattagatctttaaaatttattgaatgctcaagatgtaaaagtagatattaaagtatgtcagcattttcattcaaagtttaccggcaaattgtaggtaaa

SEQ ID NO: 63613 - DNA, 947 bp, Homo sapiens
ggctcggggccggggccagcacccacactgggtctccacagcggcatggaggcctgcgtgtcttcactgctggtgctggccctgggggccctgtcagtaggcagctcctttgggacccagatcatcgggggccgggaggtgatcccccactcgcgcccgtacatggcctcactgcagagaaatggctcccacctgtgcgggggtgtcctggtgcacccaaagtgggtgctgacggctgcccactgcctggcccagcggatggcccagctgaggctggtgctggggctccacaccctggacagccccggtctcaccttccacatcaaggcagccatccagcaccctcgctacaagcccgtccctgccctggagaacgacctcgcgctgcttcagctggacgggaaagtgaagcccagccggaccatccggccgttggccctgcccagtaagcgccaggtggtggcagcagggactcggtgcagcatggccggctgggggctgacccaccagggcgggcgcctgtcccgggtgctgcgggagctggacctccaagtgctggacacccgcatgtgtaacaacagccgcttctggaacggcagcctctcccccagcatggtctgcctggcggccgactccaaggaccaggctccctgcaagggtgactcgggcgggcccctggtgtgtggcaaaggccgggtgttggccggagtcctgtccttcagctccagggtctgcactgacatcttcaagcctcccgtggccaccgctgtggcgccttacgtgtcctggatcaggaaggtcaccggccgatcggcctgatgccctggggtgatggggaccccctcgctgtctccacaggacccttcccctccaggggtgcagtggggtgggtgaggacgggtgggagggacagggagggaccaataaatcataatgaagaaacgctc

SEQ ID NO: 63614 - DNA, 946 bp, Homo sapiens
gcgaacgccgggtaaaagatcgggagcggaagtgggcgagtcagagcacatccggtgttagaagcgctggtaggccttggagaggcgggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcag

SEQ ID NO: 63615 - DNA, 967 bp, Homo sapiens
  misc_feature (28)..(28): n is a, c, g, or t
  misc_feature (761)..(761): n is a, c, g, or t
  misc_feature (763)..(763): n is a, c, g, or t
  misc_feature (766)..(766): n is a, c, g, or t
atacggctaggtacgaggccgggtggtncgctggtaggcctggagaggcgggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctgggcctgcttgatctctcttgattcattactgcgttcgaaaaactctgtgtccgggcngntgnaggtctgagcacgcggattgtgggcgtccccctttccataagttctccctttcccccttcttttgcccttcgggggttcgggttaagccccacgtgtgggggggccttcgtcttggacagccatatcggggggttcggcccccctagcacgtcttctctccccgcgaaggagggtgcccacgccagagctcttgggtgaga

SEQ ID NO: 63616 - DNA, 2657 bp, Homo sapiens
gcgaacgccgggtaaaagatcgggagcggaagtgggcgagtcagagcacatccggtgttagaagcgctggtaggccttggagaggcgggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagccagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatacgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatatt

SEQ ID NO: 63617 - DNA, 1536 bp, Homo sapiens
gcgaacgccgggtaaaagatcgggagcggaagtgggcgagtcagagcacatccggtgttagaagcgctggtaggccttggagaggcgggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctaagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatatt

SEQ ID NO: 63618 - DNA, 2636 bp, Homo sapiens
aaaaaaaaaaaaaaaaaaaaaaaagcacatccggtgttagaagcgctggtaggccttggagaggcgggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagccagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatacgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatatt

SEQ ID NO: 63619 - DNA, 2857 bp, Homo sapiens
agcgggggtggggcggaggcgagtctgcgggggttttggggggtgtcgaggcctctattctgccccagagcgctggcgaaggccccttctcagcccgccttttcctttctcccgctccttctcctctactaagtgtagacgcagggccccttggcctagcttcgatcgttcgaattcagagcacgtccttccgaggtgaaggaacgcgaaactccacccatccgattgctgttcggctgcgggcgggtcctttggtcgggctgaccctgggtgagcggcccggagccaagactcgagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagccagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatacgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatatt

SEQ ID NO: 63620 - DNA, 2689 bp, Homo sapiens
gtgacacgcgaggctcctcagttacttagccaacggcagaggcgggaagtgagaggagtctggggctggggctgccttccaggcccacggggcggccccgctcttttcggattggttacctttgggcagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagccagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatacgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatatt

SEQ ID NO: 63621 - DNA, 3034 bp, Homo sapiens
aaaaaaaaaaaaaaaaaaaaaaaagcacatccggtgttagaagcgctggtaggccttggagaggcgggttaggaagacgcagggccccttggcctagcttcgatcgttcgaattcagagcacgtccttccgaggtgaaggaacgcgaaactccacccatccgattgctgttcggctgcgggcgggtcctttggtcgggctgaccctgggtgagcggcccggagccaagactcgagagacagggtttcgccgtgttggccagactggtctcgaactcctgacgtcaaagtgatccacctgcctcggcctcccaaagtactgggattacaggcgtgagccactgtgcccaacctgtaagtcatttttgagtcaacgatatttttaatttacaatgggtgtatccagatgtaagccatcgcaaatcaaggagtgtaccgaatgagtatcaatttctcccagtgataggtcaaccctgagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagccagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatacgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatatt

SEQ ID NO: 63622 - DNA, 2607 bp, Homo sapiens
tgtgattctgtatgacttaatgactctaacctttctttattctgcagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagccagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatacgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatatt

SEQ ID NO: 63623 - DNA, 2596 bp, Homo sapiens
tgtggctgttctagaggatcccaggctgaatggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagccagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatacgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatatt

SEQ ID NO: 63624 - DNA, 2570 bp, Homo sapiens
gctgacccaggtacttattcgtgttgccggcctctgggtcatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagccagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatacgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatatt

SEQ ID NO: 63625 - DNA, 698 bp, Homo sapiens
gcgaacgccgggtaaaagatcgggagcggaagtgggcgagtcagagcacatccggtgttagaagcgctggtaggccttggagaggcgggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggtaagacttagcctggaactttccagcagccatttgcctcacacttctttctttcctt

SEQ ID NO: 63626 - DNA, 911 bp, Homo sapiens
aaaaaaaaaaaaaaaaaaaaaaaagcacatccggtgttagaagcgctggtaggccttggagaggcgggttaggaagacgcagggccccttggcctagcttcgatcgttcgaattcagagcacgtccttccgaggtgaaggaacgcgaaactccacccatccgattgctgttcggctgcgggcgggtcctttggtcgggctgaccctgggtgagcggcccggagccaagactcgagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcatagatccttcttagattcattatg

SEQ ID NO: 63627 - DNA, 2177 bp, Homo sapiens
gcgaacgccgggtaaaagatcgggagcggaagtgggcgagtcagagcacatccggtgttagaagcgctggtaggccttggagaggcgggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacagtcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagccagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatacgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatatt

SEQ ID NO: 63628 - DNA, 1965 bp, Homo sapiens
gcgaacgccgggtaaaagatcgggagcggaagtgggcgagtcagagcacatccggtgttagaagcgctggtaggccttggagaggcgggttaggaagagtggagactgctgcacggactctggaaccatgaacatatttgatcgaaagatcaactttgatgcgcttttaaaattttctcatatctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagccagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatacgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatatt

SEQ ID NO: 63629 - DNA, 437 bp, Homo sapiens
aggaccacaggtggacgtcaccagctccagctaatttttgtattttttgtggagatggggtatcaccatgttgcccaggcttaccaactccagaactcaagcgatttatttatttattattattattatgttttttttttgagacagtctcactcccttacccaagctggagtgcagtggtgcaatctcggctcactgcaacctccgcctccctggtgcattcaattctcatgcctcagcctcctaagcagctgagatgacaggcgcgcaccaccatgcccagctaatttttgtatttttagtagagacgggcttttgccaagttgtccagcctggtctcgaactccacacctcaagcgattcgcccgccttgacctcccaaattgctaggattacaggtgtaatcctttcctaaagaaaaagagtcatctctcctg

SEQ ID NO: 63630 - DNA, 964 bp, Homo sapiens
tgtggctgttctagaggatcccaggctgaatggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaagtagagagagaggaagggtgacatcagccttccagtgagtccgtcttcaactcattccttggccctaggggggtcggaaagcagaccaaaaccggcggggccatacaaggcaacacggcaatgggggggccccgggccacttgagccggccctagagaccgaagaaggagagcacccacaaagcgctggcggggaggtctaacatactta

SEQ ID NO: 63631 - DNA, 524 bp, Homo sapiens
  misc_feature (499)..(499): n is a, c, g, or t
gtgacacgcgaggctcctcagttacttagccaacggcagaggcgggaagtgagaggagtctggggctggggctgccttccaggcccacggggcggccccgctcttttcggattggttacctttgggcagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacagcaaggggtggctggcctcctgggggtttgttttctgaacccagaccctcccctncttcagggacggaaatattttacct

SEQ ID NO: 63632 - DNA, 2661 bp, Homo sapiens
  misc_feature (19)..(19): n is a, c, g, or t
  misc_feature (43)..(43): n is a, c, g, or t
aattcgcggccgcgtacgnaccggctgcgagaagacgacaganccggaggcacatccggtgttagaagcgctggtaggccttggagaggcgggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagccagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatacgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatatt

SEQ ID NO: 63633 - DNA, 1033 bp, Homo sapiens
  misc_feature (887)..(887): n is a, c, g, or t
gcgaacgccgggtaaaagatcgggagcggaagtgggcgagtcagagcacatccggtgttagaagcgctggtaggccttggagaggcgggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaagtagagacgagagaaatgaatgacatcagcttccatagatcttcttcacctcattctttggccttacggggngtccgggatatgaacctcagaaaaaaaaaatcaaaaaaggggcgctgattccggggcactggccctttgaaaggccagggaataaggggcgaacggggaaacaggttggccttgggtatgccacaataaatgttcttgttgtaaac

SEQ ID NO: 63634 - DNA, 2795 bp, Homo sapiens
aaaaaaaaaaaaaaaaaaaaaaaagcacatccggtgttagaagcgctggtaggccttggagaggcgggttaggaagacgcagggccccttggcctagcttcgatcgttcgaattcagagcacgtccttccgaggtgaaggaacgcgaaactccacccatccgattgctgttcggctgcgggcgggtcctttggtcgggctgaccctgggtgagcggcccggagccaagactcgagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagccagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatacgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatatt

SEQ ID NO: 63635 - DNA, 2608 bp, Homo sapiens
aaaaaaaaaaaaaaaaaaaaaaaagcacatccggtgttagaagcgctgagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagccagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatacgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatatt

SEQ ID NO: 63636 - DNA, 2620 bp, Homo sapiens
  misc_feature (28)..(28): n is a, c, g, or t
atacggctaggtacgaggccgggtggtncgctggtaggcctggagaggcgggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagccagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatacgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatatt

SEQ ID NO: 63637 - DNA, 2838 bp, Homo sapiens
gtgacacgcgaggctcctcagttacttagccaacggcagaggcgggaagtgagaggagtctggggctggggctgccttccaggcccacggggcggccccgctcttttcggattggttacctttgggcagtagagacgggcttttgccaagttgtccagcctggtctcgaactccacacctcaagcgattcgcccgccttgacctcccaaattgctaggattacaggtgtaatcctttcctaaagaaaaagagtcatctctcctgaagaataagaaaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagccagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatacgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatatt

SEQ ID NO: 63638 - DNA, 2500 bp, Homo sapiens
atacggctaggtacgaggccgggtggaaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagccagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatacgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatatt

SEQ ID NO: 63639 - DNA, 2611 bp, Homo sapiens
gcgaacgccgggtaaaagatcgggagcggaagtgggcgagtcagagcacatccggtgttagaagcgctggtaggccttggagaggcgggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagccagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatacgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatatt

SEQ ID NO: 63640 - DNA, 658 bp, Homo sapiens
gcgaacgccgggtaaaagatcgggagcggaagtgggcgagtcagagcacatccggtgttagaagcgctggtaggccttggagaggcgggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggtaagacttagcctggaactttccagcagccatttgcctcacacttctttctttcctt

SEQ ID NO: 63641 - DNA, 1066 bp, Homo sapiens
gcctcctgtccttgggccctcccagctgcttcctttgctcctgcgctgaggaaggcttttgccccccagtggggcagcatgggccctccctgttgccggcatcgttattttctcccagctcctgatgggtcccttgggttgtgcttcggggcggggcaggcgggtgtgactgcactgcgcccgtccagcctcccacccgcacctcctgcccttcccgagccccctcctctgtcatttctccccctggagttcctcacgcacagggctttgtcctaagtggtcgcacacgccgttttaagagaaacctgagcgttggggaagcaggtcctggggaccaaggtggacgcggagcgtgacggcgtgaaggtgcccaccacgctggccgagtactgcgtgaagaccaaggcgccggcgcccgacgagggctcagacctcttctacgacgactactacgaggacggcgaggtggaggaggaggccgacagctgcttcggggacgatgaggatgactctggcacggaggagtcctgacaccaccagaataaacttgccgagtttacctcactagggccggacccgtggctccttagacgacagactacctcacggaggttttgtgctggtccccgtctcctctggttgtttcgttttggctttttctccctccccatgtctgttctgggttttcacgtgcttcagagaagaggggctgccccaccgccactcacgtcactcggggctcggtggacgggcccagggtgggagcggccggcccacctgtcccctcgggaggggagctgagcccgacttctaccggggtcccccagcttccggactggccgcaccccggaggagccacgggggcgctgctgggaacgtgggcggggggccgtttcctgacactaccagcctgggaggcccaggtgtagcggtccgaggggcccggtcctgcctgtcagctccaggtcctggagccacgtccagcacagagtggacggattcaccgtggccgactcttttccctgctttggtttgtttgaaatctaaataaaactactttatgaga

SEQ ID NO: 63642 - DNA, 403 bp, Homo sapiens
gcggggcccgaagcgtttactttgaaaaaattagagcgctcggggtccccgggcggcggcggcggcgcagaggaggaggcaggcggcggccccggtggctcccccccggcccacctgtcccctcgggaggggagctgagcccgacttctaccggggtcccccagcttccggactggccgcaccccggaggagccacgggggcgctgctgggaacgtgggcggggggccgtttcctgacactaccagcctgggaggcccaggtgtagcggtccgaggggcccggtcctgcctgtcagctccaggtcctggagccacgtccagcacagagtggacggattcaccgtggccgactcttttccctgctttggtttgtttgaaatctaaataaaactactttatgaga

SEQ ID NO: 63643 - DNA, 1030 bp, Homo sapiens
ttgtcggtgtcctgaccaaagagtgtggcaccactaacagcgtacgagacgggggacgtgtgtatctccatcctccacccgccggtggacgacccccagagcggggagctgccctcagagaggtggaaccccacgcagaacgtcaggaccattctcctgagtgtgatctccctcctgaacgagcccaacaccttctcgcccgcaaacgtggacgcctccgtgatgtacaggaagtggaaagagagcaaggggaaggatcgggagtacacagacatcatccggaagcaggtcctggggaccaaggtggacgcggagcgtgacggcgtgaaggtgcccaccacgctggccgagtactgcgtgaagaccaaggcgccggcgcccgacgagggctcagacctcttctacgacgactactacgaggacggcgaggtggaggaggaggccgacagctgcttcggggacgatgaggatgactctggcacggaggagtcctgacaccaccagaataaacttgccgagtttacctcactagggccggacccgtggctccttagacgacagactacctcacggaggttttgtgctggtccccgtctcctctggttgtttcgttttggctttttctccctccccatgtctgttctgggttttcacgtgcttcagagaagaggggctgccccaccgccactcacgtcactcggggctcggtggacgggcccagggtgggagcggccggcccacctgtcccctcgggaggggagctgagcccgacttctaccggggtcccccagcttccggactggccgcaccccggaggagccacgggggcgctgctgggaacgtgggcggggggccgtttcctgacactaccagcctgggaggcccaggtgtagcggtccgaggggcccggtcctgcctgtcagctccaggtcctggagccacgtccagcacagagtggacggattcaccgtggccgactcttttccctgctttggtttgtttgaaatctaaataaaactactttatgaga

SEQ ID NO: 63644 - DNA, 946 bp, Homo sapiens
agagaagagccggaaggctggggtgccccgggccgccccactccgacccactctccccacaggaccattctcctgagtgtgatctccctcctgaacgagcccaacaccttctcgcccgcaaacgtggacgcctccgtgatgtacaggaagtggaaagagagcaaggggaaggatcgggagtacacagacatcatccggaagcaggtcctggggaccaaggtggacgcggagcgtgacggcgtgaaggtgcccaccacgctggccgagtactgcgtgaagaccaaggcgccggcgcccgacgagggctcagacctcttctacgacgactactacgaggacggcgaggtggaggaggaggccgacagctgcttcggggacgatgaggatgactctggcacggaggagtcctgacaccaccagaataaacttgccgagtttacctcactagggccggacccgtggctccttagacgacagactacctcacggaggttttgtgctggtccccgtctcctctggttgtttcgttttggctttttctccctccccatgtctgttctgggttttcacgtgcttcagagaagaggggctgccccaccgccactcacgtcactcggggctcggtggacgggcccagggtgggagcggccggcccacctgtcccctcgggaggggagctgagcccgacttctaccggggtcccccagcttccggactggccgcaccccggaggagccacgggggcgctgctgggaacgtgggcggggggccgtttcctgacactaccagcctgggaggcccaggtgtagcggtccgaggggcccggtcctgcctgtcagctccaggtcctggagccacgtccagcacagagtggacggattcaccgtggccgactcttttccctgctttggtttgtttgaaatctaaataaaactactttatgaga

SEQ ID NO: 63645 - DNA, 1319 bp, Homo sapiens
gggcggggcgcgcgggcccggccaaggcaagcgccggtggggcggcggcgccagagctgctggagcgctcggggtccccgggcggcggcggcggcgcagaggaggaggcaggcggcggccccggtggctcccccccggacggtgcgcggcccggcccgtctcgcgaactcgcggtggtcgcgcggccccgcgctgctccgaccccgggcccctccgccgccgccatggctcggccgctagtgcccagctcgcagaaggcgctgctgctggagctcaaggggctgcaggaagagccggtcgagggattccgcgtgacactggtggacgagggcgatctatacaactgggaggtggccatcttcgggccccccaacacctactacgagggcggctacttcaaggcgcgcctcaagttccccatcgactacccatactctccaccagcctttcggttcctgaccaagatgtggcaccctaacatctacgagacgggggacgtgtgtatctccatcctccacccgccggtggacgacccccagagcggggagctgccctcagagaggtggaaccccacgcagaacgtcaggaccattctcctgagtgtgatctccctcctgaacgagcccaacaccttctcgcccgcaaacgtggacgcctccgtgatgtacaggaagtggaaagagagcaaggggaaggatcgggagtacacagacatcatccggaagcaggtcctggggaccaaggtggacgcggagcgtgacggcgtgaaggtgcccaccacgctggccgagtactgcgtgaagaccaaggcgccggcgcccgacgagggctcagacctcttctacgacagactacctcacggaggttttgtgctggtccccgtctcctctggttgtttcgttttggctttttctccctccccatgtctgttctgggttttcacgtgcttcagagaagaggggctgccccaccgccactcacgtcactcggggctcggtggacgggcccagggtgggagcggccggcccacctgtcccctcgggaggggagctgagcccgacttctaccggggtcccccagcttccggactggccgcaccccggaggagccacgggggcgctgctgggaacgtgggcggggggccgtttcctgacactaccagcctgggaggcccaggtgtagcggtccgaggggcccggtcctgcctgtcagctccaggtcctggagccacgtccagcacagagtggacggattcaccgtggccgactcttttccctgctttggtttgtttgaaatctaaataaaactactttatgaga

SEQ ID NO: 63646 - DNA, 1181 bp, Homo sapiens
gggcggggcgcgcgggcccggccaaggcaagcgccggtggggcggcggcgccagagctgctggagcgctcggggtccccgggcggcggcggcggcgcagaggaggaggcaggcggcggccccggtggctcccccccggacggtgcgcggcccggcccgtctcgcgaactcgcggtggtcgcgcggccccgcgctgctccgaccccgggcccctccgccgccgccatggctcggccgctagtgcccagctcgcagaaggcgctgctgctggagctcaaggggctgcaggaagagccggtcgagggattccgcgtgacactggtggacgagggcgatctatacaactgggaggtggccatcttcgggccccccaacacctactacgagggcggctacttcaaggcgcgcctcaagttccccatcgactacccatactctccaccagcctttcggttcctgaccaagatgtggcaccctaacatctacgagacgggggacgtgtgtatctccatcctccacccgccggtggacgacccccagagcggggagctgccctcagagaggtggaaccccacgcagaacgtcaggaccattctcctgagtgtgatctccctcctgaacgagcccaacaccttctcgcccgcaaacgtggacgcctccgtgatgtacaggaagtggaaagagagcaaggggaaggatcgggagtacacagacatcatccggaagcaggtcctggggaccaaggtggacgcggagcgtgacggcgtgaaggtgcccaccacgctggccgagtactgcgtgaagaccaaggcgccggcgcccgacgagggctcagacctcttctacgacgactactacgaggacggcgaggtggaggaggaggccgacagctgcttcggggacgatgaggatgactctggcacggaggagtcctgacaccaccagaataaacttgccgagtttacctcactaggcgggggcgctgctgggaacgtgggcggggggccgtttcctgacactaccagcctgggaggcccaggtgtagcggtccgaggggcccggtcctgcctgtcagctccaggtcctggagccacgtccagcacagagtggacggattcaccgtggccgactcttttccctgctttggtttgtttgaaatctaaataaaactactttatgaga

SEQ ID NO: 63647 - DNA, 913 bp, Homo sapiens
gggcggggcgcgcgggcccggccaaggcaagcgccggtggggcggcggcgccagagctgctggagcgctcggggtccccgggcggcggcggcggcgcagaggaggaggcaggcggcggccccggtggctcccccccggacggtgcgcggcccggcccgtctcgcgaactcgcggtggtcgcgcggccccgcgctgctccgaccccgggcccctccgccgccgccatggctcggccgctagtgcccagctcgcagaaggcgctgctgctggagctcaaggggctgcaggaagagccggtcgagggattccgcgtgacactggtggacgagggcgatctatacaactgggaggtggccatcttcgggccccccaacacctactacgagggcggctacttcaaggcgcgcctcaagttccccatcgactacccatactctccaccagcctttcggttcctgaccaagatgtggcaccctaacatctacgagacgggggacgtgtgtatctccatcctccacccgccggtggacgacccccagagcggggagctgccctcagagaggtggaaccccacgcagaacgtcaggaccattctcctgagtgtgatctccctcctgaacgagcccaacaccttctcgcccgcaaacgtggacgcctccgtgatgtacaggaagtggaaagagagcaaggggaaggatcgggagtacacagacatcatccggacccaggagcatccagggcaccttccatcctgcactcgctggtacctggtgtcgtggggtcatctcggggcagcatcctggtgctgggcggtctcggcttccttggcccggttcttcccggccacctccctgaggcaccacctccttgagatcccagcacagaaataaaagccacactatttttatccctc

SEQ ID NO: 63648 - DNA, 892 bp, Homo sapiens
gggcggggcgcgcgggcccggccaaggcaagcgccggtggggcggcggcgccagagctgctggagcgctcggggtccccgggcggcggcggcggcgcagaggaggaggcaggcggcggccccggtggctcccccccggacggtgcgcggcccggcccgtctcgcgaactcgcggtggtcgcgcggccccgcgctgctccgaccccgggcccctccgccgccgccatggctcggccgctagtgcccagctcgcagaaggcgctgctgctggagctcaaggggctgcaggaagagccggtcgagggattccgcgtgacactggtggacgagggcgatctatacaactgggaggtggccatcttcgggccccccaacacctactacgagggcggctacttcaaggcgcgcctcaagttccccatcgactacccatactctccaccagcctttcggttcctgaccaagatgtggcaccctaacatctacgagacgggggacgtgtgtatctccatcctccacccgccggtggacgacccccagagcggggagctgccctcagagaggtggaaccccacgcagaacgtcaggaccattctcctgagtgtgatctccctcctgaacgagcccaacaccttctcgcccgcaaacgtggacgcctccgtgatgtacaggaagtggaaagagacgggggcgctgctgggaacgtgggcggggggccgtttcctgacactaccagcctgggaggcccaggtgtagcggtccgaggggcccggtcctgcctgtcagctccaggtcctggagccacgtccagcacagagtggacggattcaccgtggccgactcttttccctgctttggtttgtttgaaatctaaataaaactactttatgaga

SEQ ID NO: 63649 - DNA, 754 bp, Homo sapiens
gggcggggcgcgcgggcccggccaaggcaagcgccggtggggcggcggcgccagagctgctggagcgctcggggtccccgggcggcggcggcggcgcagaggaggaggcaggcggcggccccggtggctcccccccggacggtgcgcggcccggcccgtctcgcgaactcgcggtggtcgcgcggccccgcgctgctccgaccccgggcccctccgccgccgccatggctcggccgctagtgcccagctcgcagaaggcgctgctgctggagctcaaggggctgcaggaagagccggtcgagggattccgcgtgacactggtggacgagggcgatctatacaactgggaggtggccatcttcgggccccccaacacctactacgagggcggctacttcaaggcgcgcctcaagttccccatcgactacccatactctccaccagcctttcggttcctgaccaagatgtggcaccctaacatctacgagacgggggacgtgtgtatctccatcctccacccgccggtggacgcggagcgtgacggcgtgaaggtgcccaccacgctggccgagtactgcgtgaagaccaaggcgccggcgcccgacgagggctcagacctcttctacgacgactactacgaggacggcgaggtggaggaggaggccgacagctgcttcggggacgatgaggatgactctggcacggaggagtcctgacaccaccagaataaacttgccgagtttacctcactagg

SEQ ID NO: 63650 - DNA, 1470 bp, Homo sapiens
gggcggggcgcgcgggcccggccaaggcaagcgccggtggggcggcggcgccagagctgctggagcgctcggggtccccgggcggcggcggcggcgcagaggaggaggcaggcggcggccccggtggctcccccccggacggtgcgcggcccggcccgtctcgcgaactcgcggtggtcgcgcggccccgcgctgctccgaccccgggcccctccgccgccgccatggctcggccgctagtgcccagctcgcagaaggcgctgctgctggagctcaaggggctgcaggaagagccggtcgagggattccgcgtgacactggtggacgagggcgatctatacaactgggaggtggccatcttcgggccccccaacacctactacgagggcggctacttcaaggcgcgcctcaagttccccatcgactacccatactctccaccagcctttcggttcctgaccaagatgtggcaccctaacatctacgagacgggggacgtgtgtatctccatcctccacccgccggtggacgacccccagagcggggagctgccctcagagaggtggaaccccacgcagaacgtcaggaccattctcctgagtgtgatctccctcctgaacgagcccaacaccttctcgcccgcaaacgtggacgcctccgtgatgtacaggaagtggaaagagagcaaggggaaggatcgggagtacacagacatcatccggaagcaggtcctggggaccaaggtggacgcggagcgtgacggcgtgaaggtgcccaccacgctggccgagtactgcgtgaagaccaaggcgccggcgcccgacgagggctcagacctcttctacgacgactactacgaggacggcgaggtggaggaggaggccgacagctgcttcggggacgatgaggatgactctggcacggaggagtcctgacaccaccagaataaacttgccgagtttacctcactagggccggacccgtggctccttagacgacagactacctcacggaggttttgtgctggtccccgtctcctctggttgtttcgttttggctttttctccctccccatgtctgttctgggttttcacgtgcttcagagaagaggggctgccccaccgccactcacgtcactcggggctcggtggacgggcccagggtgggagcggccggcccacctgtcccctcgggaggggagctgagcccgacttctaccggggtcccccagcttccggactggccgcaccccggaggagccacgggggcgctgctgggaacgtgggcggggggccgtttcctgacactaccagcctgggaggcccaggtgtagcggtccgaggggcccggtcctgcctgtcagctccaggtcctggagccacgtccagcacagagtggacggattcaccgtggccgactcttttccctgctttggtttgtttgaaatctaaataaaactactttatgaga

SEQ ID NO: 63651 - DNA, 1586 bp, Homo sapiens
  misc_feature (1502)..(1502): n is a, c, g, or t
  misc_feature (1521)..(1521): n is a, c, g, or t
  misc_feature (1531)..(1531): n is a, c, g, or t
  misc_feature (1534)..(1534): n is a, c, g, or t
  misc_feature (1570)..(1572): n is a, c, g, or t
  misc_feature (1583)..(1583): n is a, c, g, or t
gggcggggcgcgcgggcccggccaaggcaagcgccggtggggcggcggcgccagagctgctggagcgctcggggtccccgggcggcggcggcggcgcagaggaggaggcaggcggcggccccggtggctcccccccggacggtgcgcggcccggcccgtctcgcgaactcgcggtggtcgcgcggccccgcgctgctccgaccccgggcccctccgccgccgccatggctcggccgctagtgcccagctcgcagaaggcgctgctgctggagctcaaggggctgcaggaagagccggtcgagggattccgcgtgacactggtggacgagggcgatctatacaactgggaggtggccatcttcgggccccccaacacctactacgagggcggctacttcaaggcgcgcctcaagttccccatcgactacccatactctccaccagcctttcggttcctgaccaagatgtggcaccctaacatctacgagacgggggacgtgtgtatctccatcctccacccgccggtggacgacccccagagcggggagctgccctcagagaggtggaaccccacgcagaacgtcaggaccattctcctgagtgtgatctccctcctgaacgagcccaacaccttctcgcccgcaaacgtggacgcctccgtgatgtacaggaagtggaaagagagcaaggggaaggatcgggagtacacagacatcatccggaagcaggtcctggggaccaaggtggacgcggagcgtgacggcgtgaaggtgcccaccacgctggccgagtactgcgtgaagaccaaggcgccggcgcccgacgagggctcagacctcttctacgacgactactacgaggacggcgaggtggaggaggaggccgacagctgcttcggggacgatgaggatgactctggcacggaggagtcctgacaccaccagaataaacttgccgagtttacctcactagggccggacccgtggctccttagacgacagactacctcacggaggttttgtgctggtccccgtctcctctggttgtttcgttttggctttttctccctccccatgtctgttctgggttttcacgtgcttcagagaagaggggctgccccaccgccactcacgtcactcggggctcggtggacgggcccagggtgggagcggccggcccacctgtcccctcgggaggggagctgagcccgacttctaccggggtcccccagcttccggactggccgcaccccggaggagccacgggggcgctgctgggaacgtgggcggggggccgtttcctgacactaccagcctgggaggcccaggtgtagcggtccgaggggcccggtcctgcctgtcagctccaggtcctggagccacgtccagcacagagtggacggattcaccgtggccgactcttttccctgctttggtttgtttgaaatctaaataaaactactttatgagaaaaaaaaaaaaaaaaaaaaaaaaaaagaaaanaaacaaaaaaaaaaaaaanaaaaaaaaanaanaaaaaaaaaaaaacaacaaaaaaaaaaaaacaaaannnaacaaaaaaanaaa

SEQ ID NO: 63652 - DNA, 1152 bp, Homo sapiens
gcctcctgtccttgggccctcccagctgcttcctttgctcctgcgctgaggaaggcttttgccccccagtggggcagcatgggccctccctgttgccggcatcgttattttctcccagctcctgatgggtcccttgggttgtgcttcggggcggggcaggcgggtgtgactgcactgcgcccgtccagcctcccacccgcacctcctgcccttcccgagccccctcctctgtcatttctccccctggagttcctcacgcacagggctttgtcctaagtggtcgcacacgccgttttaagagaaacctgagcgttggggtgagcgtcggacctgggggaggggggccgggcaggggccgagtccaggcacgtgggtggcgccctcacccaccctgtccccccaggaagcaggtcctggggaccaaggtggacgcggagcgtgacggcgtgaaggtgcccaccacgctggccgagtactgcgtgaagaccaaggcgccggcgcccgacgagggctcagacctcttctacgacgactactacgaggacggcgaggtggaggaggaggccgacagctgcttcggggacgatgaggatgactctggcacggaggagtcctgacaccaccagaataaacttgccgagtttacctcactagggccggacccgtggctccttagacgacagactacctcacggaggttttgtgctggtccccgtctcctctggttgtttcgttttggctttttctccctccccatgtctgttctgggttttcacgtgcttcagagaagaggggctgccccaccgccactcacgtcactcggggctcggtggacgggcccagggtgggagcggccggcccacctgtcccctcgggaggggagctgagcccgacttctaccggggtcccccagcttccggactggccgcaccccggaggagccacgggggcgctgctgggaacgtgggcggggggccgtttcctgacactaccagcctgggaggcccaggtgtagcggtccgaggggcccggtcctgcctgtcagctccaggtcctggagccacgtccagcacagagtggacggattcaccgtggccgactcttttccctgctttggtttgtttgaaatctaaataaaactactttatgaga

SEQ ID NO: 63653 - DNA, 973 bp, Homo sapiens
gggcggggcgcgcgggcccggccaaggcaagcgccggtggggcggcggcgccagagctgctggagcgctcggggtccccgggcggcggcggcggcgcagaggaggaggcaggcggcggccccggtggctcccccccggacggtgcgcggcccggcccgtctcgcgaactcgcggtggtcgcgcggccccgcgctgctccgaccccgggcccctccgccgccgccatggctcggccgctagtgcccagctcgcagaaggcgctgctgctggagctcaaggggctgcaggaagagccggtcgagggattccgcgtgacactggtggacgagggcgatctatacaactgggaggtggccatcttcgggccccccaacacctactacgagggcggctacttcaaggcgcgcctcaagttccccatcgactacccatactctccaccagcctttcggttcctgaccaagatgtggcaccctaacatctacgagacgggggacgtgtgtatctccatcctccacccgccggtggacgacccccagagcggggagctgccctcagagaggtggaaccccacgcagaacgtcaggaccattctcctgagtgtgatctccctcctgaacgagcccaacaccttctcgcccgcaaacgtggacgcctccgtgatgtacaggaagtggaaagagagcaaggggaaggatcgggagtacacagacatcatccggaagcaggtcctggggaccaaggtggacgcggagcgtgacggcgtgaaggtgcccaccacgctggccgagtactgcgtgaagaccaaggcgccggcgcccgacgagggctcagacctcttctacgacgactactacgaggacggcgaggtggaggaggaggccgacagctgcttcggggacgatgaggatgactctggcacggaggagtcctgacaccaccagaataaacttgccgagtttacctcactagg

SEQ ID NO: 63654 - DNA, 1076 bp, Homo sapiens
gggcggggcgcgcgggcccggccaaggcaagcgccggtggggcggcggcgccagagctgctggagcgctcggggtccccgggcggcggcggcggcgcagaggaggaggcaggcggcggccccggtggctcccccccggacggtgcgcggcccggcccgtctcgcgaactcgcggtggtcgcgcggccccgcgctgctccgaccccgggcccctccgccgccgccatggctcggccgctagtgcccagctcgcagaaggcgctgctgctggagctcaaggggctgcaggaagagccggtcgagggattccgcgtgacactggtggacgagggcgatctatacaactgggaggtggccatcttcgggccccccaacacctactacgagggcggctacttcaaggcgcgcctcaagttccccatcgactacccatactctccaccagcctttcggttcctgaccaagatgtggcaccctaacatctacgagacgggggacgtgtgtatctccatcctccacccgccggtggacgacccccagagcggggagctgccctcagagaggtggaaccccacgcagaacgtcaggaccattctcctgagtgtgatctccctcctgaacgagcccaacaccttctcgcccgcaaacgtggacgcctccgtgatgtacaggaagtggaaagagagcaaggggaaggatcgggagtacacagacatcatccggacccaggagcatccagggcaccttccatcctgcactcgctggtacctggtgtcgtggggtcatctcggggcagcatcctggtgctgggcggtctcggctctgagcagccatggtgggcgggccccgtgcggcctcctgggaagtggcctgcaagcacctgctggcctctggaggtcacagggtagctgccctggccgtccctctggtgcagatgtcctcggtggccccggtccggtcgtgtcacctggcccaggtggctggctccttggcccggttcttcccggccacctccctgaggcaccacctccttgagatcccagcacagaaataaaagccacactatttttatccctc

SEQ ID NO: 63655 - DNA, 961 bp, Homo sapiens
gggcggggcgcgcgggcccggccaaggcaagcgccggtggggcggcggcgccagagctgctggagcgctcggggtccccgggcggcggcggcggcgcagaggaggaggcaggcggcggccccggtggctcccccccggacggtgcgcggcccggcccgtctcgcgaactcgcggtggtcgcgcggccccgcgctgctccgaccccgggcccctccgccgccgccatggctcggccgctagtgcccagctcgcagaaggcgctgctgctggagctcaaggggctgcaggaagagccggtcgagggattccgcgtgacactggtggacgagggcgatctatacaactgggaggtggccatcttcgggccccccaacacctactacgagggcggctacttcaaggcgcgcctcaagttccccatcgactacccatactctccaccagcctttcggttcctgaccaagatgtggcaccctaacatctacgagacgggggacgtgtgtatctccatcctccacccgccggtggacgacccccagagcggggagctgccctcagagaggtggaaccccacgcagaacgtcaggtaagccggcccaaccccctgtgtccacccagaacatcaggtaggccgggctccgtcccgtatccacccagaccatcaggtaggccgggctcccccacaggctgtggcgccaaggcctgattcgggacctgccagctggcggtcctgggcctcgctgtacctgcacggtaggtgctttcacggggcctgcggcaccgtgtgtcggtgcagactcccaccaggaccccaggccggccccaccgtctggaaccacctagaggtgtcccgccatcctcagtcctggggccttctccttacccagccgtctctgggttggtcacctcgtgccacgtgtgccgcctgggcctcgtccccaggtacaagcactgggccgtg

SEQ ID NO: 63656 - DNA, 346 bp, Homo sapiens
acaatattaaatgggaaatgtacttatgattggacaaaagtattgcatatatgacaagacagaatcaaggccactctttaggactgcacgcaggctgttcacgatacctttacccacattggaccactctttggcctatacctggaatggagctttcacattttcagtagcaccatgagccccttggtcaggatgggcagtactccattcctcacatatgactgccttgaaggttatacctactcttagactaacagtgtactgtggtcactatttacagagctctgatatagagcaccgtattactgaaacaagaagctcaggttaaaaatttaaatctaaagaa

SEQ ID NO: 63657 - DNA, 494 bp, Homo sapiens
cactgctgagctaagggaggatctcgaccaagccaagacccagatcgggatgactgaatccctcttaaaagccctgtctccttctgacagcttggagatcttcactaaactagaggagatacaacagcagattctacagcaaaaacacagtatgatattacttgagaatcaaataggttgtctgactcctgaactctctgaattgaaaaagcaatatgaaagtgtcagtgatttatttaataccaaaaaaagtgttttgcaagatcacttttctaagttattgaatgatcaatgcaagaactttaatgactggttcagcaacattaaagtgaaccttaaggagtgttttgaatcatcagaaacaaaaaagagtgtggaacaaaagctacaaaaactttctgatttcttgactcttgaaggaagaaacagtaaaataaagcaggtggacagcgtactgaagcatgtgaagaagcatctgcccaaagcacatgtga

SEQ ID NO: 63658 - DNA, 2008 bp, Homo sapiens
ttacgtagatagttcggatgcaaatggtcatttggcttgaatgttctctactttctttgtatggatcttttgccaataaactggttatctgttaccagtaaaacagtccagattttgactctgaatctgaacgggttcactaaatataataacaaaaggaaatatttgtttccccttgatttcctcaactcacgtaattcttgaaacaaacccgtaacgtgggtattattttattcctattttacaggtgaggaaactgagctttagagaggtcaagtctatttttaaatttacacagctccattatttcagtaacagaactgacatttgaaaagcagtctaacttcagaatctattgttttaactattctagaaattaacacgctatagagaatgagcagacgttttgagacagaacttttaaaaaaaagcatttccatgataatcccctgctattcaaaatcaatgacaaaaattgctcgtcattttgttctttcttttccttcactagctatcagttctcatctgggaaaactactaacaacgtatggaatagtttcatgtaaagtatctagtatgaagttagacatcgatgatcataaatttcacttttttgggcattttagataaggagattatccgagtttataacacatagttcaatggaaattaggtttgataagacacaagtcaatgcgatatagtaaacagtagacacatcaaatgtgtcaaatttcagaagtgttgatattttaatagttatatcttttagtatctatagtgtgtaccaagttttggtttaatatctcctgataaccaacccaaaaaataagaaatgtataaaataatattctgtactccctagctaagtttttatgtaacatgtaataattatacctttgttacaaaagcaaacaagaaaaaagccctgaataattgtgttcccataagtagaacttcgggcagggatcactgattgcagtttgaaaaccagaagccccttggcaagagtgtgccactgttcacagcacttttgaggttcggaggttcagggctatttgttcaccataacgaagaaaagctcaaagcatgagatttattggcagaaaccatccatagcatgattgctgtcattttctaggaagatcaaatgaccaacatatttattttgccataggggggtagtcaaatttgttaactcagggttacacaatctcttttcctgtaaatagcataatcactgtgtataaatgcatattttacatcccacattttaactattttatattgttttcaaatcaacaaaacaacaaacaattttatattgtttcaaatcttattggcatactgtcacatgagtccccaacaaaaacatgtctttgcatttcagtttatagtttaaggggaaaatagaatgtatgtgatcaagtgttgtaagacaggtaagaacaggtcatgagaacccagataaggtagctaatacataaatctgaaacaaaatgcatgactatagaaaaagagagtcttgaaatacgggcaggttttcaacaaggggagagggaagtgattaggtagtgatactccagatgaagtaaaacctgggaagcaaaggctctgagtttcaaaaccacagggtgtgttggaggtcagtagcacagtttggctgagatgcatggtacttgttagaaaacaagattagaaaatattactgaaagtggccaggtgcggtggctcatgcctgtaatcccagccctttggaaggccgaggtgggcggatcacgaggtcaggagattgagaccatcctggctaacacggtgaaaccccatctccactaaaaaaaaaaaaaaaaaaaaaaaaattagccgggcatggtggcgggagcatgtagtcccagctaatctggaggctgaggcaggagaatggcgtgaacccgggaggcagaggttgcggtgagccgagatcatgccactgcactccagcctgggcaactgagcaagactctgcctc

SEQ ID NO: 63659 - DNA, 478 bp, Homo sapiens
atccacttcccagcctcatccggatgaacacaaattttctcagtgatataatgggcctactaaaaaaatcactaacccgtttactcaatcagcaccaaataaaaacaacagtcaaattgtatttattagaaaactttattttaaagctaactcaggcatgctttccaaagagatgaaggtttggaaaatgtgttagaatctaatcactaaaataagaacaatcaatgtttgcttgctttggggaagacagtatttactcctttcaattatttcccaaaataaccggctaaaagtagatgaaaaagaccaatcagctgagtacagaaaccatagcctttgtccacattgaaattatacagtgagaatgtttattcctgatttctcttgctttcttagaaaggagtgactttatgctccatgccccaggaaagaaatgtgtgggagagacacatctgactaatgcattcaataaaaaaaa

SEQ ID NO: 63660 - DNA, 1020 bp, Homo sapiens
cgagaccctgtctccactaaacataaaaacaaaattactggggccccatggcacacacctgtagtcccagctgctcgggaagctgagatgggcggattgcttgagcccaggtattcaagtctggagtgagctatgactgtgccactgcactccagcctgggcgacagagcaaaccctgtttccaaacaaacaaccaaacaaacaaacaaatacacagacagaagtagttaaacatctacaaggtaagtgcatcttgaagacgtgttaagttaaagaagccaattacaaaaggtttcacgttgtatgatttcgtttatatgaaatgtccagaataggcaaatctgtttgagagagagaaagtagatgagtacttgcctaggactgggaggaggattgcgaggaaatggagattcactgctaatgagtacagggtttcttttgggggcgcttatgaagatgctctgaaattgattgtgatggttgtacaactctgaatacatgaaacagcattaaacatcactttaagtaagtcaactgtatagtgtctgaattatgtctcaatactgttgtttttaaaaaacaaaacaggccaggcacggtgtctcattcctgaaatcccagaactctgagaggcctaggcaaggggattgcttgaatccaggagttcaagagcagcctgggcaacatggtgaaatcccatcttgacaaaatatacaaaaattagctgggtggtggcaaacccactgtttgggtagaactcagtgggggaagcctcatctgttccccggtgtctgaggcgtgatttagcagctgtaggctagggtcacctgaagacattcacttatcagctgctgtcattaactggcacacatgtggcctctgcatgtggcttccaagggagcacatctcaagcaatctaggcagaagccatgtggccttttatgtcccagcctcaggagtccatagcatcactcttgtgtcctgggaggggagtcaaagatacctgtacaaagagcattt

SEQ ID NO: 63661 - DNA, 336 bp, Homo sapiens
gttactaataaaatttaagtgttaatataagtttcagaaaaggcaggaccatagaatggcagtgttgggaatgacagtgggcttattttttccctcctgatatatggaaggggattttgagaatagcagtatttgagtaaaatttagagaggaggcctctttttaaagtgacctgtctatattccctggtggaactgactgccttaggctctgatacattggtgacagacctggagatgaataatatgcatcctcatttttattgtatacttgtgactcaggtgttctcaaaggttataattcatgaaactcatgaaggtgttgaacaaaagaggg

SEQ ID NO: 63662 - DNA, 488 bp, Homo sapiens
agtttcacttcatcaagattttagctgaaggttaatgcagttaagtaagattaatctggccatactgtttctgtcctcagattgtaaatgctattgttcaaacagggatgcttcaaatgtcattggagagcattctctgaaagctgtggacccccatttatgcttggttttctctcgcagttcactttagaatactccttccctttttccaacttggtaattgtttatggaaatgggtgaacacgctctgaagttctgacagacctacgtgagagccgtgctcttctttttgtttgtatgacccccaaattcagccttgttttggaactaccgttcacttgtaaatctgctttgtactatacagttttacaatctggccgcctcctcatcttgccaacttgtaaccttctctccagagctggttcagacactatcatctgccattcttacatgtgaaaccattagagaagcctaatgatcctttctaa

SEQ ID NO: 63663 - DNA, 987 bp, Homo sapiens
atgcaaataaaatatttaattggctctccactcctgcctctgtccccttaccgctaccaccctaagagattatcattgttaacatttgaggacatggtgttttgtaacctgttgttttttcttaatatgacaatggcccatattttagcagtaaacaaaaagatacagaagatgaaagcttagccaaacactgtaaatagaaatgggaagctttttcatatcggggaacggtggcttaattgattcttggggaatgggggatcaactaaccataaacaatttcatttaggatttttgcatcatgagggtatttggagagaaatatatcatcctataatgtgcacagtaagtttttcctaatttgttgctttgaggaaagacacaaagcaaactaaacagcctttcatagataaataagtatacagagagtgaaagatatgggtacaagtatatagagacctatcaaaaatacattgcttgtggtattaattctcatgtgtgattttagcatattaaaaggctgttttgtgtttttagaaccataagaataaatggggatgttacctttcagtttgttccaaagattgcatgcatcattaccaaagcttgagtctttttactcccctgtcttgttgagatacctactacttgagcatactctggaatgagaaagtttatcgattaacatgctgcttacgcagataggattagcatttccttaatttagtataccacgtgttgtatcaggcataaaagccagctttttttagtcataccccaatgtttaaaattgttaaatgcagacttcatgttcttttgatcatttaaatcatgacatggatatttttaatttttatattctagtaattatcaattgtcctggtctggctgcttagagtatcagtttgctcaaaattgcttgaatcattaaagcaaatactaattgtgagcattgaccagatcttaagttaaaaaaaaaaaaaaagc

SEQ ID NO: 63664 - DNA, 381 bp, Homo sapiens
gctcgacgtataccacgtgttgtatactaaattaacgaaatgctaatcctatctgcgtaagacagtgtttatcgattaacatgctgcttacgcagataggattagcatttccttaatttagtataccacgtgttgtatcaggcataaaagccagctttttttagtcataccccaatgtttaaaattgttaaatgcagacttcatgttcttttgatcatttaaatcatgacatggatatttttaatttttatattctagtaattatcaattgtcctggtctggctgcttagagtatcagtttgctcaaaattgcttgaatcattaaagcaaatactaattgtgagcattgaccagatcttaagttaaaaaaaaaaaaaaagc

SEQ ID NO: 63665 - DNA, 438 bp, Homo sapiens
tggagaatcaacgtggcattcctgactctcctagagtcctaggaaagacttaaagtaattttattgaatatttatctcttttggcaaaattgtatccaaagaatgttttttgacaaaaatagttctccaaaccatgctgaaaaggtacacttagagttccaaggccaggcgcagtggcttatgcctgtaatcctagcactttgggaggctgaggggaaggatcgcctgagcccaggagttcaagaccaggctggccagcagagggagacctgtctctacaaaaaatccaaaaattagctgggtgcagtggtacaccctgtggccctagctattcaggaggctgaggtgggaggattcttgcgcccaagagttagaagctgctgtgagttatgctccagccactgcactcagccttggtgacagagcaagaccccgttc

SEQ ID NO: 63666 - DNA, 1554 bp, Homo sapiens
agcggacgtgtcccatcatgtttcgtgcgctcccattacggatcatacctcgcacctcaccgcgtggcctctgtagttccagagctcgcgagggccaggccgttggcggcggttggaacgaaacgatgagtgcctcctcgtggccccagaatggaatgccgccgtcgtccctgtacgagcggttaagtcagaggatgctggacatctcgggggaccggggcgtgctgaaggacgtcatccgagaaggagctggagacctagtggcgcctgatgcttcggtgctagtgaaatactcgggatacctggaacacatggacagacccttcgattctaattactttaggaaaactcctcggctaatgaaacttggagaggatattacactgtggggcatggagctgggccttctgagcatgcggagaggagagctggccaggtttctgttcaaaccgaactacgcctatggaacgctgggctgccctcccttgatccccccaaacaccactgtcctgtttgagattgagctgcttgacttcctggactgtgctgagtcagacaagttttgtgctctctcagctgagcagcaagaccaatttccacttcagaaggtcctgaaagtggcagctacggaacgggagtttggcaactaccttttccgccagaatcgtttctatgatgccaaagtgagatataaaagggccctgttgcttctgcgccggcgatcagcaccccctgaagagcagcacctggtggaggccgccaagcttcctgttctcctgaacctgtcctttacatacctgaagctagaccgacccaccatagccctgtgctatggagagcaggctttgatcattgaccaaaagaatgccaaggccctcttcaggtgtggacaggcttgtcttctcctgactgagtatcaaaaggcccgggattttctagttcgagcccagaaggagcaacccttcaatcatgacatcaataatgagctgaagaaactggctagctgttacagggactatgtggataaagagaaagaaatgtggcaccgcatgttcgcgccctgtggcgatggttctacagcaggagaaagttgaaggttcttcacctaccaacgaggggagagagctgtggttctccatcattgggggagtggaagggagctcccagcgcagccgtggcagccaccttccaggagcaggggctggaatgtcctgtggccgcatctctcatggacgcggctgaaacgtgttttcacaggtgctgttttctgttttccgtgttcgtaacagaagggaggggaaagcgcagctactgacaagtagaacactgctactttttttaaggcagtttcttgtttttttagacggaattagtccttggcttccctcccagtcccagccctgcttccggctgcgaatgtccctgagtcaacaccaatagagattgctttgtgtattttgtagggttctctgttttgaagacagaattatgttacaaatgtttttgttgtaaataaataaaacacttccttgtccttgcaagatccagtataaa

SEQ ID NO: 63667 - DNA, 1448 bp, Homo sapiens
agcggacgtgtcccatcatgtttcgtgcgctcccattacggatcatacctcgcacctcaccgcgtggcctctgtagttccagagctcgcgagggccaggccgttggcggcggttggaacgaaacgatgagtgcctcctcgtggccccagaatggaatgccgccgtcgtccctgtacgagcggttaagtcagaggatgctggacatctcgggggaccggggcgtgctgaaggacgtcatccgagaaggagctggagacctagtggcgcctgatgcttcggtgctagtgaaatactcgggatacctggaacacatggacagacccttcgattctaattactttaggaaaactcctcggctaatgaaacttggagaggatattacactgtggggcatggagctgggccttctgagcatgcggagaggagagctggccaggtttctgttcaaaccgaactacgcctatggaacgctgggctgccctcccttgatccccccaaacaccactgtcctgtttgagattgagctgcttgacttcctggactgtgctgagtcagacaagttttgtgctctctcagctgagcagcaagaccaatttccacttcagaaggtcctgaaagtggcagctacggaacgggagtttggcaactaccttttccgccagaatcgtttctatgatgccaaagtgagatataaaagggccctgttgcttctgcgccggcgatcagcaccccctgaagagcagcacctggtggaggccgccaagcttcctgttctcctgaacctgtcctttacatacctgaagctagaccgacccaccatagccctgtgctatggagagcaggctttgatcattgaccaaaagaatgccaaggccctcttcaggtgtggacaggcttgtcttctcctgactgagtatcaaaaggcccgggattttctagttcgagcccagaaggagcaacccttcaatcatgacatcaataatgagctgaagaaactggctagctgttacagggactatgtggataaagagaaagaaatgtggcaccgcatgttcgcgccctgtggcgatggttctacagcaggagaaagttgaaggttcttcacctaccaacgaggggagagagctgtggttctccatcattgggggagtggaagggagctcccagcgcagccgtggcagccaccttccaggagcaggggctggaatgtcctgtggccgcatctctcatggacgcggctgaaacgtgttttcacagacggaattagtccttggcttccctcccagtcccagccctgcttccggctgcgaatgtccctgagtcaacaccaatagagattgctttgtgtattttgtagggttctctgttttgaagacagaattatgttacaaatgtttttgttgtaaataaataaaacacttccttgtccttgcaagatccagtataaa

SEQ ID NO: 63668 - DNA, 1505 bp, Homo sapiens
ccagggagggcagcggggcgcaccaggccgaagtccacgccacagggagggcagctaggacatggggggaagcgcgttaaaccagggagtcctggaaggggacgacgcccccggccagtccctgtacgagcggttaagtcagaggatgctggacatctcgggggaccggggcgtgctgaaggacgtcatccgagaaggagctggagacctagtggcgcctgatgcttcggtgctagtgaaatactcgggatacctggaacacatggacagacccttcgattctaattactttaggaaaactcctcggctaatgaaacttggagaggatattacactgtggggcatggagctgggccttctgagcatgcggagaggagagctggccaggtttctgttcaaaccgaactacgcctatggaacgctgggctgccctcccttgatccccccaaacaccactgtcctgtttgagattgagctgcttgacttcctggactgtgctgagtcagacaagttttgtgctctctcagctgagcagcaagaccaatttccacttcagaaggtcctgaaagtggcagctacggaacgggagtttggcaactaccttttccgccagaatcgtttctatgatgccaaagtgagatataaaagggccctgttgcttctgcgccggcgatcagcaccccctgaagagcagcacctggtggaggccgccaagcttcctgttctcctgaacctgtcctttacatacctgaagctagaccgacccaccatagccctgtgctatggagagcaggctttgatcattgaccaaaagaatgccaaggccctcttcaggtgtggacaggcttgtcttctcctgactgagtatcaaaaggcccgggattttctagttcgagcccagaaggagcaacccttcaatcatgacatcaataatgagctgaagaaactggctagctgttacagggactatgtggataaagagaaagaaatgtggcaccgcatgttcgcgccctgtggcgatggttctacagcaggagaaagttgaaggttcttcacctaccaacgaggggagagagctgtggttctccatcattgggggagtggaagggagctcccagcgcagccgtggcagccaccttccaggagcaggggctggaatgtcctgtggccgcatctctcatggacgcggctgaaacgtgttttcacaggtgctgttttctgttttccgtgttcgtaacagaagggaggggaaagcgcagctactgacaagtagaacactgctactttttttaaggcagtttcttgtttttttagacggaattagtccttggcttccctcccagtcccagccctgcttccggctgcgaatgtccctgagtcaacaccaatagagattgctttgtgtattttgtagggttctctgttttgaagacagaattatgttacaaatgtttttgttgtaaataaataaaacacttccttgtccttgcaagatccagtataaa

SEQ ID NO: 63669 - DNA, 1434 bp, Homo sapiens
agcggacgtgtcccatcatgtttcgtgcgctcccattacggatcatacctcgcacctcaccgcgtggcctctgtagttccagagctcgcgagggccaggccgttggcggcggttggaacgaaacgatgagtgcctcctcgtggccccagaatggaatgccgccgtcgtccctgtacgagcggttaagtcagaggatgctggacatctcgggggaccggggcgtgctgaaggacgtcatccgagaaggagctggagacctagtggcgcctgatgcttcggtgctagtgaaatactcgggatacctggaacacatggacagacccttcgattctaattactttaggaaaactcctcggctaatgaaacttggagaggatattacactgtggggcatggagctgggccttctgagcatgcggagaggagagctggccaggtttctgttcaaaccgaactacgcctatggaacgctgggctgccctcccttgatccccccaaacaccactgtcctgtttgagattgagctgcttgacttcctggactgtgctgagtcagacaagttttgtgctctctcagctgccctgttgcttctgcgccggcgatcagcaccccctgaagagcagcacctggtggaggccgccaagcttcctgttctcctgaacctgtcctttacatacctgaagctagaccgacccaccatagccctgtgctatggagagcaggctttgatcattgaccaaaagaatgccaaggccctcttcaggtgtggacaggcttgtcttctcctgactgagtatcaaaaggcccgggattttctagttcgagcccagaaggagcaacccttcaatcatgacatcaataatgagctgaagaaactggctagctgttacagggactatgtggataaagagaaagaaatgtggcaccgcatgttcgcgccctgtggcgatggttctacagcaggagaaagttgaaggttcttcacctaccaacgaggggagagagctgtggttctccatcattgggggagtggaagggagctcccagcgcagccgtggcagccaccttccaggagcaggggctggaatgtcctgtggccgcatctctcatggacgcggctgaaacgtgttttcacaggtgctgttttctgttttccgtgttcgtaacagaagggaggggaaagcgcagctactgacaagtagaacactgctactttttttaaggcagtttcttgtttttttagacggaattagtccttggcttccctcccagtcccagccctgcttccggctgcgaatgtccctgagtcaacaccaatagagattgctttgtgtattttgtagggttctctgttttgaagacagaattatgttacaaatgtttttgttgtaaataaataaaacacttccttgtccttgcaagatccagtataaa

SEQ ID NO: 63670 - DNA, 201 bp, Homo sapiens
ctgatgttgctactgtaatgtggcgaagaatgctaggcattttgggagatgtaaattcaatcatggatcctgaaatacatgctcaagtttttgattacctctgtgaactttggcagaatctagctaagattagagataaccttggcatttcaactgataacctgacctccccttctccaccagttttaattcctccactga

SEQ ID NO: 63671 - DNA, 636 bp, Homo sapiens
  misc_feature (568)..(568): n is a, c, g, or t
atgatacgaatccgagctgtacctagctgggtgaagggaagtgtgactcaatcttgcctgccttctgggagctctagaattgttcccaacccagtccatggcttctagccaccactacagggctgtttcatgtacttctctctctgactctgtcttgtccgactctcttgagaatttctcaacgattgctcatgcctgtcagtatcagtgcttccatcgttccatctttgattcacttctctttcctttctatttactcccaaaatggagtcattcatcctgatgtcctcaattgctgctgatatgctggtgattcccaaatacatagctccaacccccaacttcccccagactttagatctgtattggtattacctactggacatctctatggacagttccgtatagactcaactcatctgcccaaccaagtatgttcctcctgaattcctctcctggttacttcatcacaatctacataggctcaccagctagaaacatttatgagcttacattccttcttcccatatcttatcagcatatcatatccatttcactccttcacccnagctatagcttgggtgaaggagtgacattggctgacatcacagttgtctgcaccctgttgtggctcta

SEQ ID NO: 63672 - DNA, 911 bp, Homo sapiens
  misc_feature (311)..(311): n is a, c, g, or t
  misc_feature (313)..(313): n is a, c, g, or t
  misc_feature (316)..(316): n is a, c, g, or t
gcgggtttattagctccctgtcagaggttgtaacgttgtctaagtggctaattatagagcttagttaagttaccaggggtttgtattggagggggtttattatagaagacgatgtgagaactaagtcgggcgtgatctagaggttatgtaattgccggttttagggctctttgttgaagattttatggcgtcagcgaagggttgtagtaacccgtagggcctacaacgtttgggcctttgcgtagttgtatatagcctagaatttttcgtttcggtaagcattaggaatgccattgcgattagaatgggtncnatncctaatgctttcatcggctcagatgtggtggactggctgtaccacaatgtggaaggcttcacggaccggagggaggcccgcaagtatgccagcaacctgctgaaagctggcttcatccgccataccgtcaacaagatcaccttctccgagcagtgctactacatcttcggtgacctctgcggcaacatggccaacctgtctctccacgatcacgatggctccagtggcgcctctgaccaggacacactggcccctttgccgcacccgggggccgccccttggcccatggctttcccgtaccagtacccgccacccccgcacccatacaacccgcacccgggcttcccggagctgggctacagctacggcgggggcagcgccagcagtcagcacagcgaaggcagtcggagcagtggctccaaccgtagcggcagcgatcggaggaaggagaaggacccgaaggccggggactccaagtccgggggcagcggcagcgaatcggaccacaccacacgcagcagcctgcgggggccgcgggagcgggcgcccagcgagcgctcagcctctccgaattcacacccgcctctacctagcc

SEQ ID NO: 63673 - DNA, 474 bp, Homo sapiens
caaagagctgtctctgggtctccccaacctctgctttcatttgaacagtcttgtgctggtggtttgattcccagtttaggatggaggagcccctgagagttgggatttgaggatcctccatttgcaccctagaaggttctctgtgacatccccctttctctgcagagtggtgaaggaggagatctcggatgacaatgccaagctaccatgcttcaatggccgggtggtgtcctgggtaaggagccctcagccttccatccacctgcatccctgtgctgggctggacgagggaaaggcatcactgagattgtagctggtggttttaagcttcagtatctgaatctttctttacttttgcaaatgaactgcttctcaccccagattctgtaacctttgatgaaaagtgagaaattagtgggaagggggaagagggagagacggaaacacacagtggagacagtaacgtttcctatg

SEQ ID NO: 63674 - DNA, 5588 bp, Homo sapiens
atcgtctgtttcatcaagaggagtcgcggcggcaagtacccaggtgagatgtgcaagaggcgtgggcttgcagggtggggcacgtccactttcccgtgagtctccaggtctccagccagatccggggaatgtgttctctcagtgaagccgcggccaccggaagagtcgcggtcgccagtccagtcgggagagtggggagcggaagcgcggccgcggcggcggcgggcggcgctgggacccggtagcccccggagaacaagggagctggcgccgccagcagccgccgagctgggttgagccgctgggccgcgccgcgcgccgccgccgtctgggaggctcggcccggccgcccgagcaggccgcgcgcgggccgccgggcccgaggccagagccatgggcgagaccaagatcatctaccacttggatgggcaggagacgccgtaccttgtgaagctgcccctgcccgccgagcgcgtcaccttggcggactttaagggcgttttgcagcgacccagctataagttcttcttcaagtctatggacgacgatttcggagtggtgaaggaggagatctcggatgacaatgccaagctaccatgcttcaatggccgggtggtgtcctggctggtgtcagctgagggctcacacccagacccagcccccttctgtgctgataacccatcggagctgccaccacctatggagcgcacgggaggcatcggggactcccgacccccatccttccaccctcatgctggtgggggcagccaggagaacctggacaatgacacagagacggactctttggtgtctgcccagcgagagcggccacgccggagggatggcccagagcatgcaacccggctaaatggaactgcgaagggggaacggcggcgagaaccagggggttatgatagctcatccacccttatgagcagtgagctggagaccaccagcttctttgactcagatgaggatgactccaccagcaggttcagcagctccacagaacagagcagtgcctcacgcctgatgagaagacacaagcggcggcggcggaagcagaaggtttctcggattgagcggtcctcgtccttcagcagcatcacggactccaccatgtcactcaacatcatcacggtcactctcaacatggaaaaatataacttcttgggcatctccattgtgggccaaagcaacgagcgtggtgacggcggcatctacattggctctatcatgaagggtggggccgtggctgctgatggacgcatcgagccaggagatatgttgttacaggtaaacgagatcaactttgagaacatgagtaatgacgatgcagtccgggtactgcgggagattgtgcacaaaccggggcccatcaccctgactgtagccaagtgctgggacccaagtccacgtggttgcttcacattgcccaggagcgagcccatccggcccattgaccctgcggcctgggtctcccacactgcagccatgaccggcaccttccctgcatacggcatgagcccctccctgagcaccatcacctccaccagctcctccatcaccagttccatccctgacacagagcgcctagacgacttccacttgtccatccacagtgacatggctgccatcgtaaaagccatggcctcccctgaatcagggttggaggtccgtgaccgcatgtggctcaagattaccatccctaatgctttcatcggctcagatgtggtggactggctgtaccacaatgtggaaggcttcacggaccggagggaggcccgcaagtatgccagcaacctgctgaaagctggcttcatccgccataccgtcaacaagatcaccttctccgagcagtgctactacatcttcggtgacctctgcggcaacatggccaacctgtctctccacgatcacgatggctccagtggcgcctctgaccaggacacactggcccctttgccgcacccgggggccgccccttggcccatggctttcccgtaccagtacccgccacccccgcacccatacaacccgcacccgggcttcccggagctgggctacagctacggcgggggcagcgccagcagtcagcacagcgaaggcagtcggagcagtggctccaaccgtagcggcagcgatcggaggaaggagaaggacccgaaggccggggactccaagtccgggggcagcggcagcgaatcggaccacaccacacgcagcagcctgcgggggccgcgggagcgggcgcccagcgagcgctcagggccggcggccagcgagcacagccaccgcagccaccattccctggccagcagccttcgcagccaccacacacacccgagctacggtcctcccggagtgccccctctctacggcccccccatgctgatgatgcccccgccgcccgcggccatggggcccccaggagcccctccgggccgcgacctggcctcagtgcccccggaactgaccgccagcagacagtccttccgcatggccatgggaaaccccagtgagttctttgtggatgtgatgtgagcagggcccctcccccagctccattccgctcccaccccagccggctgcgttcctctctccatccgtccgtcttttttactttgtctggtacctgaaagggaaataaaaggaactaaatccaggtgcgctaactgctcgcagggtgctgcgagggtggggtgcacctaccgattggctctgcagccccctaacctgcctctggccccagttcgtttcctctgcccactaatccctgcgcaggacttcccaggaccccttttgtctctgggaccagacttgttggtgctaccccttactcccctctgcaacccccattttgggagttgaccccagcaatgaccttggtggcacgctcactccctcattctctcgtttcccctttagctccctttcaccatttattcagctacatcatccctctattaaccccaccccatcaggcacgtgtgcaaacctcttgactttaccccacattactgaaaccaaaatatatttgcttcatctgcccctactaaccatccccctgcctgctgcctcagtcctgcaacctaaagctgtagtcgcctccaatagccatccatgccatccctgcctgtgcctagatcagaggcccagagggccccctcagttgcctgagcagctggtggcttccagggagcatctctgctctacccctgccccatgcctgccctgcgtgctggttccttcagacccctaaccctactaaccagcaggctcatctcacctccaggcctgaaacatttcttttctttcttttttcctcccccaattttccctgggcctggagcagccaagaatttcgggctgtttgactttctgtgagcccccagcgaggggaggcccagcctccgaggagaccaggaaccctgcttcagcagcccctcagggcttcccaaggatgtccagcccccacacccacacgttaacataatgagtcactaggcttctggggagggcccaacttcacccatgcatgagagactctcctcctttccagagagaatcggatcgcaccacgtgtggcagcctgcggcggggggaggggggcctctttagctctctttatctttctctctcactcatgtatgcatacatgcacagagatgcatacacaggtgcctatgcaagttcatttaagcctcagggctggtccctgcccaaagggctggaccctcctaatcctctcctaggttgtggggctggtcccctgacacccttctccccttcctggtagaccttaaacctcgcacacatgtccccagcattttctcacctggataaagcccataagctgggtctcaggctgggctcagcaaaggactcgccttgcaaccgacaggccattcccacccccacacacaacctcccctgttttcacattcaccatggcatcccagagcaaggacacaggagcccacaggccagttgaggttgggcaaggagacttccaggacttccagacagagtaccaggttttatttttcaccttattctctactttaaacaaatcataactttctctttaagcctctgctataaattctcctggctctcctgggcttccatattttgggggctggggtgtcaaaagtgagatgaagttcttagctccaggttttggggtaaaccaaggtaggaacattttggcatttatttcaattaacaatacttccttggacgggtgcggtggctcacgtctgtaatcccagcactttgggaggctgagacaggtggatcacttgaggtcgggagttcgagaccagcctggccaacatagcaaaaccctgtctctactaaaaatacaaaaattagatgggtgttttggcacctgcctgtaatctcagctactcaggaggctgaggcacaagaatcgcttgaatccaggaagcaagcggaggttgcagtgagttgagatcgcactccagcctgggtgacagagtgagattctgtctcaaaagcaaactaacaaagaaaaacaatacttcctggggttttggtgtgcagagggctttgttggaagtgtgactcaatcttgcctgccttctgggagctctagaattgttcccaacccagtccatggcttctagccaccactacagggctgtttcatgtacttctctctctgactctgtcttgtccgactctcttgagaatttctcaacgattgctcatgcctgtcagtatcagtgcttccatcgttccatctttgattcacttctctttcctttctatttactcccaaaatggagtcattcatcctgatgtcctcaattgctgctgatatgctggtgattcccaaatacatagctccaacccccaacttcccccagactttagatctgtattggtattacctactggacatctctatggacagttccgtatagactcaactcatctgcccaaccaagtatgttcctcctgaattcctctcctggttacttcatcacaatctacataggctcaccagctagaaacatttatgagcttacattccttcttcccatatcttatcagcatatcatatccatttcactccaacactctgtcttgaatttggccctccctctcccctctctactttaattcattggagcatgggatttggagttaggtggttttgggtttgaattccagctctactatttttggttgtgtgatagagttatttaacctctctgagcctcagttccctcgtatgtaaaatgatgataataatacctacctcacagggttgttgtgaggatttaaattagatattgtacgaaaagtgcctagcacagtgcctggcacacagtagagtaggtgctcaataaatggtagctattattattattaaaaaaaaaaaaggggcgtctaaatttctcgaggggccagttagggtaccgtttctgtcaaggggccaaggagggtttagagacggcggtttaagtggtggaaaggtctgggtttggagggctctctggggattggaaacacaggtagcgaaaataggtggaaagtctggaatgcagttaaagaac

SEQ ID NO: 63675 - DNA, 5107 bp, Homo sapiens
agcggagagtggggagcggaagccgccgccgtctgggaggctcggcccggccgcccgagcaggccgcgcgcgggccgccgggcccgaggccagagccatgggcgagaccaagatcatctaccacttggatgggcaggagacgccgtaccttgtgaagctgcccctgcccgccgagcgcgtcaccttggcggactttaagggcgttttgcagcgacccagctataagttcttcttcaagtctatggacgacgatttcggagtggtgaaggaggagatctcggatgacaatgccaagctaccatgcttcaatggccgggtggtgtcctggctggtgtcagctgagggctcacacccagacccagcccccttctgtgctgataacccatcggagctgccaccacctatggagcgcacgggaggcatcggggactcccgacccccatccttccaccctcatgctggtgggggcagccaggagaacctggacaatgacacagagacggactctttggtgtctgcccagcgagagcggccacgccggagggatggcccagagcatgcaacccggctaaatggaactgcgaagggggaacggcggcgagaaccagggggttatgatagctcatccacccttatgagcagtgagctggagaccaccagcttctttgactcagatgaggatgactccaccagcaggttcagcagctccacagaacagagcagtgcctcacgcctgatgagaagacacaagcggcggcggcggaagcagaaggtttctcggattgagcggtcctcgtccttcagcagcatcacggactccaccatgtcactcaacatcatcacggtcactctcaacatggaaaaatataacttcttgggcatctccattgtgggccaaagcaacgagcgtggtgacggcggcatctacattggctctatcatgaagggtggggccgtggctgctgatggacgcatcgagccaggagatatgttgttacaggtaaacgagatcaactttgagaacatgagtaatgacgatgcagtccgggtactgcgggagattgtgcacaaaccggggcccatcaccctgactgtagccaagtgctgggacccaagtccacgtggttgcttcacattgcccaggagcgagcccatccggcccattgaccctgcggcctgggtctcccacactgcagccatgaccggcaccttccctgcatacggcatgagcccctccctgagcaccatcacctccaccagctcctccatcaccagttccatccctgacacagagcgcctagacgacttccacttgtccatccacagtgacatggctgccatcgtaaaagccatggcctcccctgaatcagggttggaggtccgtgaccgcatgtggctcaagattaccatccctaatgctttcatcggctcagatgtggtggactggctgtaccacaatgtggaaggcttcacggaccggagggaggcccgcaagtatgccagcaacctgctgaaagctggcttcatccgccataccgtcaacaagatcaccttctccgagcagtgctactacatcttcggtgacctctgcggcaacatggccaacctgtctctccacgatcacgatggctccagtggcgcctctgaccaggacacactggcccctttgccgcacccgggggccgccccttggcccatggctttcccgtaccagtacccgccacccccgcacccatacaacccgcacccgggcttcccggagctgggctacagctacggcgggggcagcgccagcagtcagcacagcgaaggcagtcggagcagtggctccaaccgtagcggcagcgatcggaggaaggagaaggacccgaaggccggggactccaagtccgggggcagcggcagcgaatcggaccacaccacacgcagcagcctgcgggggccgcgggagcgggcgcccagcgagcgctcagggccggcggccagcgagcacagccaccgcagccaccattccctggccagcagccttcgcagccaccacacacacccgagctacggtcctcccggagtgccccctctctacggcccccccatgctgatgatgcccccgccgcccgcggccatggggcccccaggagcccctccgggccgcgacctggcctcagtgcccccggaactgaccgccagcagacagtccttccgcatggccatgggaaaccccagtgagttctttgtggatgtgatgtgagcagggcccctcccccagctccattccgctcccaccccagccggctgcgttcctctctccatccgtccgtcttttttactttgtctggtacctgaaagggaaataaaaggaactaaatccaggtgcgctaactgctcgcagggtgctgcgagggtggggtgcacctaccgattggctctgcagccccctaacctgcctctggccccagttcgtttcctctgcccactaatccctgcgcaggacttcccaggaccccttttgtctctgggaccagacttgttggtgctaccccttactcccctctgcaacccccattttgggagttgaccccagcaatgaccttggtggcacgctcactccctcattctctcgtttcccctttagctccctttcaccatttattcagctacatcatccctctattaaccccaccccatcaggcacgtgtgcaaacctcttgactttaccccacattactgaaaccaaaatatatttgcttcatctgcccctactaaccatccccctgcctgctgcctcagtcctgcaacctaaagctgtagtcgcctccaatagccatccatgccatccctgcctgtgcctagatcagaggcccagagggccccctcagttgcctgagcagctggtggcttccagggagcatctctgctctacccctgccccatgcctgccctgcgtgctggttccttcagacccctaaccctactaaccagcaggctcatctcacctccaggcctgaaacatttcttttctttcttttttcctcccccaattttccctgggcctggagcagccaagaatttcgggctgtttgactttctgtgagcccccagcgaggggaggcccagcctccgaggagaccaggaaccctgcttcagcagcccctcagggcttcccaaggatgtccagcccccacacccacacgttaacataatgagtcactaggcttctggggagggcccaacttcacccatgcatgagagactctcctcctttccagagagaatcggatcgcaccacgtgtggcagcctgcggcggggggaggggggcctctttagctctctttatctttctctctcactcatgtatgcatacatgcacagagatgcatacacaggtgcctatgcaagttcatttaagcctcagggctggtccctgcccaaagggctggaccctcctaatcctctcctaggttgtggggctggtcccctgacacccttctccccttcctggtagaccttaaacctcgcacacatgtccccagcattttctcacctggataaagcccataagctgggtctcaggctgggctcagcaaaggactcgccttgcaaccgacaggccattcccacccccacacacaacctcccctgttttcacattcaccatggcatcccagagcaaggacacaggagcccacaggccagttgaggttgggcaaggagacttccaggacttccagacagagtaccaggttttatttttcaccttattctctactttaaacaaatcataactttctctttaagcctctgctataaattctcctggctctcctgggcttccatattttgggggctggggtgtcaaaagtgagatgaagttcttagctccaggttttggggtaaaccaaggtaggaacattttggcatttatttcaattaacaatacttccttggacgggtgcggtggctcacgtctgtaatcccagcactttgggaggctgagacaggtggatcacttgaggtcgggagttcgagaccagcctggccaacatagcaaaaccctgtctctactaaaaatacaaaaattagatgggtgttttggcacctgcctgtaatctcagctactcaggaggctgaggcacaagaatcgcttgaatccaggaagcaagcggaggttgcagtgagttgagatcgcactccagcctgggtgacagagtgagattctgtctcaaaagcaaactaacaaagaaaaacaatacttcctggggttttggtgtgcagagggctttgttggaagtgtgactcaatcttgcctgccttctgggagctctagaattgttcccaacccagtccatggcttctagccaccactacagggctgtttcatgtacttctctctctgactctgtcttgtccgactctcttgagaatttctcaacgattgctcatgcctgtcagtatcagtgcttccatcgttccatctttgattcacttctctttcctttctatttactcccaaaatggagtcattcatcctgatgtcctcaattgctgctgatatgctggtgattcccaaatacatagctccaacccccaacttcccccagactttagatctgtattggtattacctactggacatctctatggacagttccgtatagactcaactcatctgcccaaccaagtatgttcctcctgaattcctctcctggttacttcatcacaatctacataggctcaccagctagaaacatttatgagcttacattccttcttcccatatcttatcagcatatcatatccatttcactccaacactctgtcttgaatttggccctccctctcccctctctactttaattcattggagcatgggatttggagttaggtggttttgggtttgaattccagctctactatttttggttgtgtgatagagttatttaacctctctgagcctcagttccctcgtatgtaaaatgatgataataatacctacctcacagggttgttgtgaggatttaaattagatattgtacgaaaagtgcctagcacagtgcctggcacacagtagagtaggtgctcaataaatggtagctattattattatta

SEQ ID NO: 63676 - DNA, 5584 bp, Homo sapiens
atcgtctgtttcatcaagaggagtcgcggcggcaagtacccaggtgagatgtgcaagaggcgtgggcttgcagggtggggcacgtccactttcccgtgagtctccaggtctccagccagatccggggaatgtgttctctcagtgaagccgcggccaccggaagagtcgcggtcgccagtccagtcgggagagtggggagcggaagcgcggccgcggcggcggcgggcggcgctgggacccggtagcccccggagaacaagggagctggcgccgccagcagccgccgagctgggttgagccgctgggccgcgccgcgcgccgccgccgtctgggaggctcggcccggccgcccgagcaggccgcgcgcgggccgccgggcccgaggccagagccatgggcgagaccaagatcatctaccacttggatgggcaggagacgccgtaccttgtgaagctgcccctgcccgccgagcgcgtcaccttggcggactttaagggcgttttgcagcgacccagctataagttcttcttcaagtctatggacgacgatttcggagtggtgaaggaggagatctcggatgacaatgccaagctaccatgcttcaatggccgggtggtgtcctggctggtgtcagctgagggctcacacccagacccagcccccttctgtgctgataacccatcggagctgccaccacctatggagcgcacgggaggcatcggggactcccgacccccatccttccaccctcatgctggtgggggcagccaggagaacctggacaatgacacagagacggactctttggtgtctgcccagcgagagcggccacgccggagggatggcccagagcatgcaacccggctaaatggaactgcgaagggggaacggcggcgagaaccagggggttatgatagctcatccacccttatgagcagtgagctggagaccaccagcttctttgactcagatgaggatgactccaccagcaggtggggcttgagtttcatgggtattgtggggcaggtgaccctggaggagccctaaaccctgaggatgcggggcccctgggaggcttatgggctttgtgttggggacccaggccctgcagtgcctcccctcatgggggcagggctgggccagcctggtggggaacgactgtgggccccacaggttcagcagctccacagaacagagcagtgcctcacgcctgatgagaagacacaagcggcggcggcggaagcagaaggtttctcggattgagcggtcctcgtccttcagcagcatcacggactccaccatgtcactcaacatcatcacggtcactctcaacatggaaaaatataacttcttgggcatctccattgtgggccaaagcaacgagcgtggtgacggcggcatctacattggctctatcatgaagggtggggccgtggctgctgatggacgcatcgagccaggagatatgttgttacaggtaaacgagatcaactttgagaacatgagtaatgacgatgcagtccgggtactgcgggagattgtgcacaaaccggggcccatcaccctgactgtagccaagtgctgggacccaagtccacgtggttgcttcacattgcccaggagcgagcccatccggcccattgaccctgcggcctgggtctcccacactgcagccatgaccggcaccttccctgcatacggcatgagcccctccctgagcaccatcacctccaccagctcctccatcaccagttccatccctgacacagagcgcctagacgacttccacttgtccatccacagtgacatggctgccatcgtaaaagccatggcctcccctgaatcagggttggaggtccgtgaccgcatgtggctcaagattaccatccctaatgctttcatcggctcagatgtggtggactggctgtaccacaatgtggaaggcttcacggaccggagggaggcccgcaagtatgccagcaacctgctgaaagctggcttcatccgccataccgtcaacaagatcaccttctccgagcagtgctactacatcttcggtgacctctgcggcaacatggccaacctgtctctccacgatcacgatggctccagtggcgcctctgaccaggacacactggcccctttgccgcacccgggggccgccccttggcccatggctttcccgtaccagtacccgccacccccgcacccatacaacccgcacccgggcttcccggagctgggctacagctacggcgggggcagcgccagcagtcagcacagcgaaggcagtcggagcagtggctccaaccgtagcggcagcgatcggaggaaggagaaggacccgaaggccggggactccaagtccgggggcagcggcagcgaatcggaccacaccacacgcagcagcctgcgggggccgcgggagcgggcgcccagcgagcgctcagggccggcggccagcgagcacagccaccgcagccaccattccctggccagcagccttcgcagccaccacacacacccgagctacggtcctcccggagtgccccctctctacggcccccccatgctgatgatgcccccgccgcccgcggccatggggcccccaggagcccctccgggccgcgacctggcctcagtgcccccggaactgaccgccagcagacagtccttccgcatggccatgggaaaccccagtgagttctttgtggatgtgatgtgagcagggcccctcccccagctccattccgctcccaccccagccggctgcgttcctctctccatccgtccgtcttttttactttgtctggtacctgaaagggaaataaaaggaactaaatccaggtgcgctaactgctcgcagggtgctgcgagggtggggtgcacctaccgattggctctgcagccccctaacctgcctctggccccagttcgtttcctctgcccactaatccctgcgcaggacttcccaggaccccttttgtctctgggaccagacttgttggtgctaccccttactcccctctgcaacccccattttgggagttgaccccagcaatgaccttggtggcacgctcactccctcattctctcgtttcccctttagctccctttcaccatttattcagctacatcatccctctattaaccccaccccatcaggcacgtgtgcaaacctcttgactttaccccacattactgaaaccaaaatatatttgcttcatctgcccctactaaccatccccctgcctgctgcctcagtcctgcaacctaaagctgtagtcgcctccaatagccatccatgccatccctgcctgtgcctagatcagaggcccagagggccccctcagttgcctgagcagctggtggcttccagggagcatctctgctctacccctgccccatgcctgccctgcgtgctggttccttcagacccctaaccctactaaccagcaggctcatctcacctccaggcctgaaacatttcttttctttcttttttcctcccccaattttccctgggcctggagcagccaagaatttcgggctgtttgactttctgtgagcccccagcgaggggaggcccagcctccgaggagaccaggaaccctgcttcagcagcccctcagggcttcccaaggatgtccagcccccacacccacacgttaacataatgagtcactaggcttctggggagggcccaacttcacccatgcatgagagactctcctcctttccagagagaatcggatcgcaccacgtgtggcagcctgcggcggggggaggggggcctctttagctctctttatctttctctctcactcatgtatgcatacatgcacagagatgcatacacaggtgcctatgcaagttcatttaagcctcagggctggtccctgcccaaagggctggaccctcctaatcctctcctaggttgtggggctggtcccctgacacccttctccccttcctggtagaccttaaacctcgcacacatgtccccagcattttctcacctggataaagcccataagctgggtctcaggctgggctcagcaaaggactcgccttgcaaccgacaggccattcccacccccacacacaacctcccctgttttcacattcaccatggcatcccagagcaaggacacaggagcccacaggccagttgaggttgggcaaggagacttccaggacttccagacagagtaccaggttttatttttcaccttattctctactttaaacaaatcataactttctctttaagcctctgctataaattctcctggctctcctgggcttccatattttgggggctggggtgtcaaaagtgagatgaagttcttagctccaggttttggggtaaaccaaggtaggaacattttggcatttatttcaattaacaatacttccttggacgggtgcggtggctcacgtctgtaatcccagcactttgggaggctgagacaggtggatcacttgaggtcgggagttcgagaccagcctggccaacatagcaaaaccctgtctctactaaaaatacaaaaattagatgggtgttttggcacctgcctgtaatctcagctactcaggaggctgaggcacaagaatcgcttgaatccaggaagcaagcggaggttgcagtgagttgagatcgcactccagcctgggtgacagagtgagattctgtctcaaaagcaaactaacaaagaaaaacaatacttcctggggttttggtgtgcagagggctttgttggaagtgtgactcaatcttgcctgccttctgggagctctagaattgttcccaacccagtccatggcttctagccaccactacagggctgtttcatgtacttctctctctgactctgtcttgtccgactctcttgagaatttctcaacgattgctcatgcctgtcagtatcagtgcttccatcgttccatctttgattcacttctctttcctttctatttactcccaaaatggagtcattcatcctgatgtcctcaattgctgctgatatgctggtgattcccaaatacatagctccaacccccaacttcccccagactttagatctgtattggtattacctactggacatctctatggacagttccgtatagactcaactcatctgcccaaccaagtatgttcctcctgaattcctctcctggttacttcatcacaatctacataggctcaccagctagaaacatttatgagcttacattccttcttcccatatcttatcagcatatcatatccatttcactccaacactctgtcttgaatttggccctccctctcccctctctactttaattcattggagcatgggatttggagttaggtggttttgggtttgaattccagctctactatttttggttgtgtgatagagttatttaacctctctgagcctcagttccctcgtatgtaaaatgatgataataatacctacctcacagggttgttgtgaggatttaaattagatattgtacgaaaagtgcctagcacagtgcctggcacacagtagagtaggtgctcaataaatggtagctattattattatta

SEQ ID NO: 63677 - DNA, 4763 bp, Homo sapiens
tggtagcttggcattgtcatccgagatctcctccttcaccactccgaaatcgtcgtccatagacttgaagaagaacttatagctgggtcgctgcaaaacgcccttaaagtccgccaaggtgacgcgctcggcgggcaggggcagcttcacaaggtacggactctttggtgtctgcccagcgagagcggccacgccggagggatggcccagagcatgcaacccggctaaatggaactgcgaagggggaacggcggcgagaaccagggggttatgatagctcatccacccttatgagcagtgagctggagaccaccagcttctttgactcagatgaggatgactccaccagcaggttcagcagctccacagaacagagcagtgcctcacgcctgatgagaagacacaagcggcggcggcggaagcagaaggtttctcggattgagcggtcctcgtccttcagcagcatcacggactccaccatgtcactcaacatcatcacggtcactctcaacatggaaaaatataacttcttgggcatctccattgtgggccaaagcaacgagcgtggtgacggcggcatctacattggctctatcatgaagggtggggccgtggctgctgatggacgcatcgagccaggagatatgttgttacaggtaaacgagatcaactttgagaacatgagtaatgacgatgcagtccgggtactgcgggagattgtgcacaaaccggggcccatcaccctgactgtagccaagtgctgggacccaagtccacgtggttgcttcacattgcccaggagcgagcccatccggcccattgaccctgcggcctgggtctcccacactgcagccatgaccggcaccttccctgcatacggcatgagcccctccctgagcaccatcacctccaccagctcctccatcaccagttccatccctgacacagagcgcctagacgacttccacttgtccatccacagtgacatggctgccatcgtaaaagccatggcctcccctgaatcagggttggaggtccgtgaccgcatgtggctcaagattaccatccctaatgctttcatcggctcagatgtggtggactggctgtaccacaatgtggaaggcttcacggaccggagggaggcccgcaagtatgccagcaacctgctgaaagctggcttcatccgccataccgtcaacaagatcaccttctccgagcagtgctactacatcttcggtgacctctgcggcaacatggccaacctgtctctccacgatcacgatggctccagtggcgcctctgaccaggacacactggcccctttgccgcacccgggggccgccccttggcccatggctttcccgtaccagtacccgccacccccgcacccatacaacccgcacccgggcttcccggagctgggctacagctacggcgggggcagcgccagcagtcagcacagcgaaggcagtcggagcagtggctccaaccgtagcggcagcgatcggaggaaggagaaggacccgaaggccggggactccaagtccgggggcagcggcagcgaatcggaccacaccacacgcagcagcctgcgggggccgcgggagcgggcgcccagcgagcgctcagggccggcggccagcgagcacagccaccgcagccaccattccctggccagcagccttcgcagccaccacacacacccgagctacggtcctcccggagtgccccctctctacggcccccccatgctgatgatgcccccgccgcccgcggccatggggcccccaggagcccctccgggccgcgacctggcctcagtgcccccggaactgaccgccagcagacagtccttccgcatggccatgggaaaccccagtgagttctttgtggatgtgatgtgagcagggcccctcccccagctccattccgctcccaccccagccggctgcgttcctctctccatccgtccgtcttttttactttgtctggtacctgaaagggaaataaaaggaactaaatccaggtgcgctaactgctcgcagggtgctgcgagggtggggtgcacctaccgattggctctgcagccccctaacctgcctctggccccagttcgtttcctctgcccactaatccctgcgcaggacttcccaggaccccttttgtctctgggaccagacttgttggtgctaccccttactcccctctgcaacccccattttgggagttgaccccagcaatgaccttggtggcacgctcactccctcattctctcgtttcccctttagctccctttcaccatttattcagctacatcatccctctattaaccccaccccatcaggcacgtgtgcaaacctcttgactttaccccacattactgaaaccaaaatatatttgcttcatctgcccctactaaccatccccctgcctgctgcctcagtcctgcaacctaaagctgtagtcgcctccaatagccatccatgccatccctgcctgtgcctagatcagaggcccagagggccccctcagttgcctgagcagctggtggcttccagggagcatctctgctctacccctgccccatgcctgccctgcgtgctggttccttcagacccctaaccctactaaccagcaggctcatctcacctccaggcctgaaacatttcttttctttcttttttcctcccccaattttccctgggcctggagcagccaagaatttcgggctgtttgactttctgtgagcccccagcgaggggaggcccagcctccgaggagaccaggaaccctgcttcagcagcccctcagggcttcccaaggatgtccagcccccacacccacacgttaacataatgagtcactaggcttctggggagggcccaacttcacccatgcatgagagactctcctcctttccagagagaatcggatcgcaccacgtgtggcagcctgcggcggggggaggggggcctctttagctctctttatctttctctctcactcatgtatgcatacatgcacagagatgcatacacaggtgcctatgcaagttcatttaagcctcagggctggtccctgcccaaagggctggaccctcctaatcctctcctaggttgtggggctggtcccctgacacccttctccccttcctggtagaccttaaacctcgcacacatgtccccagcattttctcacctggataaagcccataagctgggtctcaggctgggctcagcaaaggactcgccttgcaaccgacaggccattcccacccccacacacaacctcccctgttttcacattcaccatggcatcccagagcaaggacacaggagcccacaggccagttgaggttgggcaaggagacttccaggacttccagacagagtaccaggttttatttttcaccttattctctactttaaacaaatcataactttctctttaagcctctgctataaattctcctggctctcctgggcttccatattttgggggctggggtgtcaaaagtgagatgaagttcttagctccaggttttggggtaaaccaaggtaggaacattttggcatttatttcaattaacaatacttccttggacgggtgcggtggctcacgtctgtaatcccagcactttgggaggctgagacaggtggatcacttgaggtcgggagttcgagaccagcctggccaacatagcaaaaccctgtctctactaaaaatacaaaaattagatgggtgttttggcacctgcctgtaatctcagctactcaggaggctgaggcacaagaatcgcttgaatccaggaagcaagcggaggttgcagtgagttgagatcgcactccagcctgggtgacagagtgagattctgtctcaaaagcaaactaacaaagaaaaacaatacttcctggggttttggtgtgcagagggctttgttggaagtgtgactcaatcttgcctgccttctgggagctctagaattgttcccaacccagtccatggcttctagccaccactacagggctgtttcatgtacttctctctctgactctgtcttgtccgactctcttgagaatttctcaacgattgctcatgcctgtcagtatcagtgcttccatcgttccatctttgattcacttctctttcctttctatttactcccaaaatggagtcattcatcctgatgtcctcaattgctgctgatatgctggtgattcccaaatacatagctccaacccccaacttcccccagactttagatctgtattggtattacctactggacatctctatggacagttccgtatagactcaactcatctgcccaaccaagtatgttcctcctgaattcctctcctggttacttcatcacaatctacataggctcaccagctagaaacatttatgagcttacattccttcttcccatatcttatcagcatatcatatccatttcactccaacactctgtcttgaatttggccctccctctcccctctctactttaattcattggagcatgggatttggagttaggtggttttgggtttgaattccagctctactatttttggttgtgtgatagagttatttaacctctctgagcctcagttccctcgtatgtaaaatgatgataataatacctacctcacagggttgttgtgaggatttaaattagatattgtacgaaaagtgcctagcacagtgcctggcacacagtagagtaggtgctcaataaatggtagctattattattatta

SEQ ID NO: 63678 - DNA, 4877 bp, Homo sapiens
cctcactttccacccagctacccaccttcttgccctacttcccgagctcaggatatgcctggccccagtgcagcccctggcttgcctctctccctccttcacccctgcactgggcactgtgtaaacccaactgcttccatcccctgcagcaacccggctaaatggaactgcgaagggggaacggcggcgagaaccagggggttatgatagctcatccacccttatgagcagtgagctggagaccaccagcttctttgactcagatgaggatgactccaccagcaggtggggcttgagtttcatgggtattgtggggcaggtgaccctggaggagccctaaaccctgaggatgcggggcccctgggaggcttatgggctttgtgttggggacccaggccctgcagtgcctcccctcatgggggcagggctgggccagcctggtggggaacgactgtgggccccacaggttcagcagctccacagaacagagcagtgcctcacgcctgatgagaagacacaagcggcggcggcggaagcagaaggtttctcggattgagcggtcctcgtccttcagcagcatcacggactccaccatgtcactcaacatcatcacggtcactctcaacatggaaaaatataacttcttgggcatctccattgtgggccaaagcaacgagcgtggtgacggcggcatctacattggctctatcatgaagggtggggccgtggctgctgatggacgcatcgagccaggagatatgttgttacaggtaaacgagatcaactttgagaacatgagtaatgacgatgcagtccgggtactgcgggagattgtgcacaaaccggggcccatcaccctgactgtagccaagtgctgggacccaagtccacgtggttgcttcacattgcccaggagcgagcccatccggcccattgaccctgcggcctgggtctcccacactgcagccatgaccggcaccttccctgcatacggcatgagcccctccctgagcaccatcacctccaccagctcctccatcaccagttccatccctgacacagagcgcctagacgacttccacttgtccatccacagtgacatggctgccatcgtaaaagccatggcctcccctgaatcagggttggaggtccgtgaccgcatgtggctcaagattaccatccctaatgctttcatcggctcagatgtggtggactggctgtaccacaatgtggaaggcttcacggaccggagggaggcccgcaagtatgccagcaacctgctgaaagctggcttcatccgccataccgtcaacaagatcaccttctccgagcagtgctactacatcttcggtgacctctgcggcaacatggccaacctgtctctccacgatcacgatggctccagtggcgcctctgaccaggacacactggcccctttgccgcacccgggggccgccccttggcccatggctttcccgtaccagtacccgccacccccgcacccatacaacccgcacccgggcttcccggagctgggctacagctacggcgggggcagcgccagcagtcagcacagcgaaggcagtcggagcagtggctccaaccgtagcggcagcgatcggaggaaggagaaggacccgaaggccggggactccaagtccgggggcagcggcagcgaatcggaccacaccacacgcagcagcctgcgggggccgcgggagcgggcgcccagcgagcgctcagggccggcggccagcgagcacagccaccgcagccaccattccctggccagcagccttcgcagccaccacacacacccgagctacggtcctcccggagtgccccctctctacggcccccccatgctgatgatgcccccgccgcccgcggccatggggcccccaggagcccctccgggccgcgacctggcctcagtgcccccggaactgaccgccagcagacagtccttccgcatggccatgggaaaccccagtgagttctttgtggatgtgatgtgagcagggcccctcccccagctccattccgctcccaccccagccggctgcgttcctctctccatccgtccgtcttttttactttgtctggtacctgaaagggaaataaaaggaactaaatccaggtgcgctaactgctcgcagggtgctgcgagggtggggtgcacctaccgattggctctgcagccccctaacctgcctctggccccagttcgtttcctctgcccactaatccctgcgcaggacttcccaggaccccttttgtctctgggaccagacttgttggtgctaccccttactcccctctgcaacccccattttgggagttgaccccagcaatgaccttggtggcacgctcactccctcattctctcgtttcccctttagctccctttcaccatttattcagctacatcatccctctattaaccccaccccatcaggcacgtgtgcaaacctcttgactttaccccacattactgaaaccaaaatatatttgcttcatctgcccctactaaccatccccctgcctgctgcctcagtcctgcaacctaaagctgtagtcgcctccaatagccatccatgccatccctgcctgtgcctagatcagaggcccagagggccccctcagttgcctgagcagctggtggcttccagggagcatctctgctctacccctgccccatgcctgccctgcgtgctggttccttcagacccctaaccctactaaccagcaggctcatctcacctccaggcctgaaacatttcttttctttcttttttcctcccccaattttccctgggcctggagcagccaagaatttcgggctgtttgactttctgtgagcccccagcgaggggaggcccagcctccgaggagaccaggaaccctgcttcagcagcccctcagggcttcccaaggatgtccagcccccacacccacacgttaacataatgagtcactaggcttctggggagggcccaacttcacccatgcatgagagactctcctcctttccagagagaatcggatcgcaccacgtgtggcagcctgcggcggggggaggggggcctctttagctctctttatctttctctctcactcatgtatgcatacatgcacagagatgcatacacaggtgcctatgcaagttcatttaagcctcagggctggtccctgcccaaagggctggaccctcctaatcctctcctaggttgtggggctggtcccctgacacccttctccccttcctggtagaccttaaacctcgcacacatgtccccagcattttctcacctggataaagcccataagctgggtctcaggctgggctcagcaaaggactcgccttgcaaccgacaggccattcccacccccacacacaacctcccctgttttcacattcaccatggcatcccagagcaaggacacaggagcccacaggccagttgaggttgggcaaggagacttccaggacttccagacagagtaccaggttttatttttcaccttattctctactttaaacaaatcataactttctctttaagcctctgctataaattctcctggctctcctgggcttccatattttgggggctggggtgtcaaaagtgagatgaagttcttagctccaggttttggggtaaaccaaggtaggaacattttggcatttatttcaattaacaatacttccttggacgggtgcggtggctcacgtctgtaatcccagcactttgggaggctgagacaggtggatcacttgaggtcgggagttcgagaccagcctggccaacatagcaaaaccctgtctctactaaaaatacaaaaattagatgggtgttttggcacctgcctgtaatctcagctactcaggaggctgaggcacaagaatcgcttgaatccaggaagcaagcggaggttgcagtgagttgagatcgcactccagcctgggtgacagagtgagattctgtctcaaaagcaaactaacaaagaaaaacaatacttcctggggttttggtgtgcagagggctttgttggaagtgtgactcaatcttgcctgccttctgggagctctagaattgttcccaacccagtccatggcttctagccaccactacagggctgtttcatgtacttctctctctgactctgtcttgtccgactctcttgagaatttctcaacgattgctcatgcctgtcagtatcagtgcttccatcgttccatctttgattcacttctctttcctttctatttactcccaaaatggagtcattcatcctgatgtcctcaattgctgctgatatgctggtgattcccaaatacatagctccaacccccaacttcccccagactttagatctgtattggtattacctactggacatctctatggacagttccgtatagactcaactcatctgcccaaccaagtatgttcctcctgaattcctctcctggttacttcatcacaatctacataggctcaccagctagaaacatttatgagcttacattccttcttcccatatcttatcagcatatcatatccatttcactccaacactctgtcttgaatttggccctccctctcccctctctactttaattcattggagcatgggatttggagttaggtggttttgggtttgaattccagctctactatttttggttgtgtgatagagttatttaacctctctgagcctcagttccctcgtatgtaaaatgatgataataatacctacctcacagggttgttgtgaggatttaaattagatattgtacgaaaagtgcctagcacagtgcctggcacacagtagagtaggtgctcaataaatggtagctattattattatta

SEQ ID NO: 63679 - DNA, 4919 bp, Homo sapiens
agcggagagtggggagcggaagccgccgccgtctgggaggctcggcccggccgcccgagcaggccgcgcgcgggccgccgggcccgaggccagagccatgggcgagaccaagatcatctaccacttggatgggcaggagacgccgtaccttgtgaagctgcccctgcccgccgagcgcgtcaccttggcggactttaagggcgttttgcagcgacccagctataagttcttcttcaagtctatggacgacgatttcggagtggtgaaggaggagatctcggatgacaatgccaagctaccatgcttcaatggccgggtggtgtcctggctggtgtcagctgagggctcacacccagacccagcccccttctgtgctgataacccatcggagctgccaccacctatggagcgcacgggaggcatcggggactcccgacccccatccttccaccctcatgctggtgggggcagccaggagaacctggacaatgacacagagacggactctttggtgtctgcccagcgagagcggccacgccggagggatggcccagagcatgcaacccggctaaatggaactgcgaagggggaacggcggcgagaaccagggggttatgatagctcatccacccttatgagcagtgagctggagaccaccagcttctttgactcagatgaggatgactccaccagcaggttcagcagctccacagaacagagcagtgcctcacgcctgatgagaagacacaagcggcggcggcggaagcagaaggtttctcggattgagcggtcctcgtccttcagcagcatcacggactccaccatgtcactcaacatcatcacggtcactctcaacatggaaaaatataacttcttgggcatctccattgtgggccaaagcaacgagcgtggtgacggcggcatctacattggctctatcatgaagggtggggccgtggctgctgatggacgcatcgagccaggagatatgttgttacaggtaaacgagatcaactttgagaacatgagtaatgacgatgcagtccgggtactgcgggagattgtgcacaaaccggggcccatcaccctgactgtagccaagtgctgggacccaagtccacgtggttgcttcacattgcccaggagcgagcccatccggcccattgaccctgcggcctgggtctcccacactgcagccatgaccggcaccttccctgcatacggcatgagcccctccctgagcaccatcacctccaccagctcctccatcaccagttccatccctgacacagagcgcctagacgacttccacttgtccatccacagtgacatggctgccatcgtaaaagccatggcctcccctgaatcagggttggaggtccgtgaccgcatgtggctcaagattaccatccctaatgctttcatcggctcagatgtggtggactggctgtaccacaatgtggaaggcttcacggaccggagggaggcccgcaagtatgccagcaacctgctgaaagctggcttcatccgccataccgtcaacaagatcaccttctccgagcagtgctactacatcttcggtgacctctgcggcaacatggccaacctgtctctccacgatcacgatggctccagtggcgcctctgaccaggacacactggcccctttgccgcacccgggggccgccccttggcccatggctttcccgtaccagtacccgccacccccgcacccatacaacccgcacccgggcttcccggagctgggctacagctacggcgggggcagcgccagcagtcagcacagcgaaggcagtcggagcagtggctccaaccgtagcggcagcgatcggaggaaggagaaggacccgaaggccggggactccaagtccgggggcagcggcagcgaatcggaccacaccacacgcagcagccatggggcccccaggagcccctccgggccgcgacctggcctcagtgcccccggaactgaccgccagcagacagtccttccgcatggccatgggaaaccccagtgagttctttgtggatgtgatgtgagcagggcccctcccccagctccattccgctcccaccccagccggctgcgttcctctctccatccgtccgtcttttttactttgtctggtacctgaaagggaaataaaaggaactaaatccaggtgcgctaactgctcgcagggtgctgcgagggtggggtgcacctaccgattggctctgcagccccctaacctgcctctggccccagttcgtttcctctgcccactaatccctgcgcaggacttcccaggaccccttttgtctctgggaccagacttgttggtgctaccccttactcccctctgcaacccccattttgggagttgaccccagcaatgaccttggtggcacgctcactccctcattctctcgtttcccctttagctccctttcaccatttattcagctacatcatccctctattaaccccaccccatcaggcacgtgtgcaaacctcttgactttaccccacattactgaaaccaaaatatatttgcttcatctgcccctactaaccatccccctgcctgctgcctcagtcctgcaacctaaagctgtagtcgcctccaatagccatccatgccatccctgcctgtgcctagatcagaggcccagagggccccctcagttgcctgagcagctggtggcttccagggagcatctctgctctacccctgccccatgcctgccctgcgtgctggttccttcagacccctaaccctactaaccagcaggctcatctcacctccaggcctgaaacatttcttttctttcttttttcctcccccaattttccctgggcctggagcagccaagaatttcgggctgtttgactttctgtgagcccccagcgaggggaggcccagcctccgaggagaccaggaaccctgcttcagcagcccctcagggcttcccaaggatgtccagcccccacacccacacgttaacataatgagtcactaggcttctggggagggcccaacttcacccatgcatgagagactctcctcctttccagagagaatcggatcgcaccacgtgtggcagcctgcggcggggggaggggggcctctttagctctctttatctttctctctcactcatgtatgcatacatgcacagagatgcatacacaggtgcctatgcaagttcatttaagcctcagggctggtccctgcccaaagggctggaccctcctaatcctctcctaggttgtggggctggtcccctgacacccttctccccttcctggtagaccttaaacctcgcacacatgtccccagcattttctcacctggataaagcccataagctgggtctcaggctgggctcagcaaaggactcgccttgcaaccgacaggccattcccacccccacacacaacctcccctgttttcacattcaccatggcatcccagagcaaggacacaggagcccacaggccagttgaggttgggcaaggagacttccaggacttccagacagagtaccaggttttatttttcaccttattctctactttaaacaaatcataactttctctttaagcctctgctataaattctcctggctctcctgggcttccatattttgggggctggggtgtcaaaagtgagatgaagttcttagctccaggttttggggtaaaccaaggtaggaacattttggcatttatttcaattaacaatacttccttggacgggtgcggtggctcacgtctgtaatcccagcactttgggaggctgagacaggtggatcacttgaggtcgggagttcgagaccagcctggccaacatagcaaaaccctgtctctactaaaaatacaaaaattagatgggtgttttggcacctgcctgtaatctcagctactcaggaggctgaggcacaagaatcgcttgaatccaggaagcaagcggaggttgcagtgagttgagatcgcactccagcctgggtgacagagtgagattctgtctcaaaagcaaactaacaaagaaaaacaatacttcctggggttttggtgtgcagagggctttgttggaagtgtgactcaatcttgcctgccttctgggagctctagaattgttcccaacccagtccatggcttctagccaccactacagggctgtttcatgtacttctctctctgactctgtcttgtccgactctcttgagaatttctcaacgattgctcatgcctgtcagtatcagtgcttccatcgttccatctttgattcacttctctttcctttctatttactcccaaaatggagtcattcatcctgatgtcctcaattgctgctgatatgctggtgattcccaaatacatagctccaacccccaacttcccccagactttagatctgtattggtattacctactggacatctctatggacagttccgtatagactcaactcatctgcccaaccaagtatgttcctcctgaattcctctcctggttacttcatcacaatctacataggctcaccagctagaaacatttatgagcttacattccttcttcccatatcttatcagcatatcatatccatttcactccaacactctgtcttgaatttggccctccctctcccctctctactttaattcattggagcatgggatttggagttaggtggttttgggtttgaattccagctctactatttttggttgtgtgatagagttatttaacctctctgagcctcagttccctcgtatgtaaaatgatgataataatacctacctcacagggttgttgtgaggatttaaattagatattgtacgaaaagtgcctagcacagtgcctggcacacagtagagtaggtgctcaataaatggtagctattattattatta

SEQ ID NO: 63680 - DNA, 4077 bp, Homo sapiens
tacatacatgagcactgtctctcctttcttctctcacccagaacccccatatctatcctgttgggcccagcagtgggtggggtgggtagcccatgactcctcatcctccctgcaggcgagcccatccggcccattgaccctgcggcctgggtctcccacactgcagccatgaccggcaccttccctgcatacggcatgagcccctccctgagcaccatcacctccaccagctcctccatcaccagttccatccctgacacagagcgcctagacgacttccacttgtccatccacagtgacatggctgccatcgtaaaagccatggcctcccctgaatcagggttggaggtccgtgaccgcatgtggctcaagattaccatccctaatgctttcatcggctcagatgtggtggactggctgtaccacaatgtggaaggcttcacggaccggagggaggcccgcaagtatgccagcaacctgctgaaagctggcttcatccgccataccgtcaacaagatcaccttctccgagcagtgctactacatcttcggtgacctctgcggcaacatggccaacctgtctctccacgatcacgatggctccagtggcgcctctgaccaggacacactggcccctttgccgcacccgggggccgccccttggcccatggctttcccgtaccagtacccgccacccccgcacccatacaacccgcacccgggcttcccggagctgggctacagctacggcgggggcagcgccagcagtcagcacagcgaaggcagtcggagcagtggctccaaccgtagcggcagcgatcggaggaaggagaaggacccgaaggccggggactccaagtccgggggcagcggcagcgaatcggaccacaccacacgcagcagcctgcgggggccgcgggagcgggcgcccagcgagcgctcagggccggcggccagcgagcacagccaccgcagccaccattccctggccagcagccttcgcagccaccacacacacccgagctacggtcctcccggagtgccccctctctacggcccccccatgctgatgatgcccccgccgcccgcggccatggggcccccaggagcccctccgggccgcgacctggcctcagtgcccccggaactgaccgccagcagacagtccttccgcatggccatgggaaaccccagtgagttctttgtggatgtgatgtgagcagggcccctcccccagctccattccgctcccaccccagccggctgcgttcctctctccatccgtccgtcttttttactttgtctggtacctgaaagggaaataaaaggaactaaatccaggtgcgctaactgctcgcagggtgctgcgagggtggggtgcacctaccgattggctctgcagccccctaacctgcctctggccccagttcgtttcctctgcccactaatccctgcgcaggacttcccaggaccccttttgtctctgggaccagacttgttggtgctaccccttactcccctctgcaacccccattttgggagttgaccccagcaatgaccttggtggcacgctcactccctcattctctcgtttcccctttagctccctttcaccatttattcagctacatcatccctctattaaccccaccccatcaggcacgtgtgcaaacctcttgactttaccccacattactgaaaccaaaatatatttgcttcatctgcccctactaaccatccccctgcctgctgcctcagtcctgcaacctaaagctgtagtcgcctccaatagccatccatgccatccctgcctgtgcctagatcagaggcccagagggccccctcagttgcctgagcagctggtggcttccagggagcatctctgctctacccctgccccatgcctgccctgcgtgctggttccttcagacccctaaccctactaaccagcaggctcatctcacctccaggcctgaaacatttcttttctttcttttttcctcccccaattttccctgggcctggagcagccaagaatttcgggctgtttgactttctgtgagcccccagcgaggggaggcccagcctccgaggagaccaggaaccctgcttcagcagcccctcagggcttcccaaggatgtccagcccccacacccacacgttaacataatgagtcactaggcttctggggagggcccaacttcacccatgcatgagagactctcctcctttccagagagaatcggatcgcaccacgtgtggcagcctgcggcggggggaggggggcctctttagctctctttatctttctctctcactcatgtatgcatacatgcacagagatgcatacacaggtgcctatgcaagttcatttaagcctcagggctggtccctgcccaaagggctggaccctcctaatcctctcctaggttgtggggctggtcccctgacacccttctccccttcctggtagaccttaaacctcgcacacatgtccccagcattttctcacctggataaagcccataagctgggtctcaggctgggctcagcaaaggactcgccttgcaaccgacaggccattcccacccccacacacaacctcccctgttttcacattcaccatggcatcccagagcaaggacacaggagcccacaggccagttgaggttgggcaaggagacttccaggacttccagacagagtaccaggttttatttttcaccttattctctactttaaacaaatcataactttctctttaagcctctgctataaattctcctggctctcctgggcttccatattttgggggctggggtgtcaaaagtgagatgaagttcttagctccaggttttggggtaaaccaaggtaggaacattttggcatttatttcaattaacaatacttccttggacgggtgcggtggctcacgtctgtaatcccagcactttgggaggctgagacaggtggatcacttgaggtcgggagttcgagaccagcctggccaacatagcaaaaccctgtctctactaaaaatacaaaaattagatgggtgttttggcacctgcctgtaatctcagctactcaggaggctgaggcacaagaatcgcttgaatccaggaagcaagcggaggttgcagtgagttgagatcgcactccagcctgggtgacagagtgagattctgtctcaaaagcaaactaacaaagaaaaacaatacttcctggggttttggtgtgcagagggctttgttggaagtgtgactcaatcttgcctgccttctgggagctctagaattgttcccaacccagtccatggcttctagccaccactacagggctgtttcatgtacttctctctctgactctgtcttgtccgactctcttgagaatttctcaacgattgctcatgcctgtcagtatcagtgcttccatcgttccatctttgattcacttctctttcctttctatttactcccaaaatggagtcattcatcctgatgtcctcaattgctgctgatatgctggtgattcccaaatacatagctccaacccccaacttcccccagactttagatctgtattggtattacctactggacatctctatggacagttccgtatagactcaactcatctgcccaaccaagtatgttcctcctgaattcctctcctggttacttcatcacaatctacataggctcaccagctagaaacatttatgagcttacattccttcttcccatatcttatcagcatatcatatccatttcactccaacactctgtcttgaatttggccctccctctcccctctctactttaattcattggagcatgggatttggagttaggtggttttgggtttgaattccagctctactatttttggttgtgtgatagagttatttaacctctctgagcctcagttccctcgtatgtaaaatgatgataataatacctacctcacagggttgttgtgaggatttaaattagatattgtacgaaaagtgcctagcacagtgcctggcacacagtagagtaggtgctcaataaatggtagctattattattatta

SEQ ID NO: 63681 - DNA, 2770 bp, Homo sapiens
ccacgcgtcgcggacgcgtggggctaaatccaggtgcgctaactgctcgcagggtgctgcgagggtggggtgcacctaccgattggctctgcagccccctaacctgcctctggccccagttcgtttcctctgcccactaatccctgcgcaggacttcccaggaccccttttgtctctgggaccagacttgttggtgctaccccttactcccctctgcaacccccattttgggagttgaccccagcaatgaccttggtggcacgctcactccctcattctctcgtttcccctttagctccctttcaccatttattcagctacatcatccctctattaaccccaccccatcaggcacgtgtgcaaacctcttgactttaccccacattactgaaaccaaaatatatttgcttcatctgcccctactaaccatccccctgcctgctgcctcagtcctgcaacctaaagctgtagtcgcctccaatagccatccatgccatccctgcctgtgcctagatcagaggcccagagggccccctcagttgcctgagcagctggtggcttccagggagcatctctgctctacccctgccccatgcctgccctgcgtgctggttccttcagacccctaaccctactaaccagcaggctcatctcacctccaggcctgaaacatttcttttctttcttttttcctcccccaattttccctgggcctggagcagccaagaatttcgggctgtttgactttctgtgagcccccagcgaggggaggcccagcctccgaggagaccaggaaccctgcttcagcagcccctcagggcttcccaaggatgtccagcccccacacccacacgttaacataatgagtcactaggcttctggggagggcccaacttcacccatgcatgagagactctcctcctttccagagagaatcggatcgcaccacgtgtggcagcctgcggcggggggaggggggcctctttagctctctttatctttctctctcactcatgtatgcatacatgcacagagatgcatacacaggtgcctatgcaagttcatttaagcctcagggctggtccctgcccaaagggctggaccctcctaatcctctcctaggttgtggggctggtcccctgacacccttctccccttcctggtagaccttaaacctcgcacacatgtccccagcattttctcacctggataaagcccataagctgggtctcaggctgggctcagcaaaggactcgccttgcaaccgacaggccattcccacccccacacacaacctcccctgttttcacattcaccatggcatcccagagcaaggacacaggagcccacaggccagttgaggttgggcaaggagacttccaggacttccagacagagtaccaggttttatttttcaccttattctctactttaaacaaatcataactttctctttaagcctctgctataaattctcctggctctcctgggcttccatattttgggggctggggtgtcaaaagtgagatgaagttcttagctccaggttttggggtaaaccaaggtaggaacattttggcatttatttcaattaacaatacttccttggacgggtgcggtggctcacgtctgtaatcccagcactttgggaggctgagacaggtggatcacttgaggtcgggagttcgagaccagcctggccaacatagcaaaaccctgtctctactaaaaatacaaaaattagatgggtgttttggcacctgcctgtaatctcagctactcaggaggctgaggcacaagaatcgcttgaatccaggaagcaagcggaggttgcagtgagttgagatcgcactccagcctgggtgacagagtgagattctgtctcaaaagcaaactaacaaagaaaaacaatacttcctggggttttggtgtgcagagggctttgttggaagtgtgactcaatcttgcctgccttctgggagctctagaattgttcccaacccagtccatggcttctagccaccactacagggctgtttcatgtacttctctctctgactctgtcttgtccgactctcttgagaatttctcaacgattgctcatgcctgtcagtatcagtgcttccatcgttccatctttgattcacttctctttcctttctatttactcccaaaatggagtcattcatcctgatgtcctcaattgctgctgatatgctggtgattcccaaatacatagctccaacccccaacttcccccagactttagatctgtattggtattacctactggacatctctatggacagttccgtatagactcaactcatctgcccaaccaagtatgttcctcctgaattcctctcctggttacttcatcacaatctacataggctcaccagctagaaacatttatgagcttacattccttcttcccatatcttatcagcatatcatatccatttcactccaacactctgtcttgaatttggccctccctctcccctctctactttaattcattggagcatgggatttggagttaggtggttttgggtttgaattccagctctactatttttggttgtgtgatagagttatttaacctctctgagcctcagttccctcgtatgtaaaatgatgataataatacctacctcacagggttgttgtgaggatttaaattagatattgtacgaaaagtgcctagcacagtgcctggcacacagtagagtaggtgctcaataaatggtagctattattattatta

SEQ ID NO: 63682 - DNA, 2516 bp, Homo sapiens
agcggagagtggggagcggaagccgccgccgtctgggaggctcggcccggccgcccgagcaggccgcgcgcgggccgccgggcccgaggccagagccatgggcgagaccaagatcatctaccacttggatgggcaggagacgccgtaccttgtgaagctgcccctgcccgccgagcgcgtcaccttggcggactttaagggcgttttgcagcgacccagctataagttcttcttcaagtctatggacgacgatttcggagtggtgaaggaggagatctcggatgacaatgccaagctaccatgcttcaatggccgggtggtgtcctggctggtgtcagctgagggctcacacccagacccagcccccttctgtgctgataacccatcggagctgccaccacctatggagcgcacgggaggcatcggggactcccgacccccatccttccaccctcatgctggtgggggcagccaggagaacctggacaatgacacagagacggactctttggtgtctgcccagcgagagcggccacgccggagggatggcccagagcatgcaacccggctaaatggaactgcgaagggggaacggcggcgagaaccagggggttatgatagctcatccacccttatgagcagtgagctggagaccaccagcttctttgactcagatgaggatgactccaccagcaggttcagcagctccacagaacagagcagtgcctcacgcctgatgagaagacacaagcggcggcggcggaagcagaaggtttctcggattgagcggtcctcgtccttcagcagcatcacggactccaccatgtcactcaacatcatcacggtcactctcaacatggaaaaatataacttcttgggcatctccattgtgggccaaagcaacgagcgtggtgacggcggcatctacattggctctatcatgaagggtggggccgtggctgctgatggacgcatcgagccaggagatatgttgttacaggtaaacgagatcaactttgagaacatgagtaatgacgatgcagtccgggtactgcgggagattgtgcacaaaccggggcccatcaccctgactgtagccaagtgctgggacccaagtccacgtggttgcttcacattgcccaggagcgagcccatccggcccattgaccctgcggcctgggtctcccacactgcagccatgaccggcaccttccctgcatacggcatgagcccctccctgagcaccatcacctccaccagctcctccatcaccagttccatccctgacacagagcgcctagacgacttccacttgtccatccacagtgacatggctgccatcgtaaaagccatggcctcccctgaatcagggttggaggtccgtgaccgcatgtggctcaagattaccatccctaatgctttcatcggctcagatgtggtggactggctgtaccacaatgtggaaggcttcacggaccggagggaggcccgcaagtatgccagcaacctgctgaaagctggcttcatccgccataccgtcaacaagatcaccttctccgagcagtgctactacatcttcggtgacctctgcggcaacatggccaacctgtctctccacgatcacgatggctccagtggcgcctctgaccaggacacactggcccctttgccgcacccgggggccgccccttggcccatggctttcccgtaccagtacccgccacccccgcacccatacaacccgcacccgggcttcccggagctgggctacagctacggcgggggcagcgccagcagtcagcacagcgaaggcagtcggagcagtggctccaaccgtagcggcagcgatcggaggaaggagaaggacccgaaggccggggactccaagtccgggggcagcggcagcgaatcggaccacaccacacgcagcagcctgcgggggccgcgggagcgggcgcccagcgagcgctcagggccggcggccagcgagcacagccaccgcagccaccattccctggccagcagccttcgcagccaccacacacacccgagctacggtcctcccggagtgccccctctctacggcccccccatgctgatgatgcccccgccgcccgcggccatggggcccccaggagcccctccgggccgcgacctggcctcagtgcccccggaactgaccgccagcagacagtccttccgcatggccatgggaaaccccagtgagttctttgtggatgtgatgtgagcagggcccctcccccagctccattccgctcccaccccagccggctgcgttcctctctccatccgtccgtcttttttactttgtctggtacctgaaagggaaataaaaggaagggccttcaagaccaaccagcccgggcctcctcgctctgcagactggggcaactgagacccagagagggcaggaggctgcccacaatcaaagagcaagggccggaccttgggctcctacctctggtccagggtgggctcgcattcctggggaattc

SEQ ID NO: 63683 - DNA, 1827 bp, Homo sapiens
ttagaggatccctgtgctcgtagggggggaggggggcctctttagctctctttatctttctctctcactcatgtatgcatacatgcacagagatgcatacacaggtgcctatgcaagttcatttaagcctcagggctggtccctgcccaaagggctggaccctcctaatcctctcctaggttgtggggctggtcccctgacacccttctccccttcctggtagaccttaaacctcgcacacatgtccccagcattttctcacctggataaagcccataagctgggtctcaggctgggctcagcaaaggactcgccttgcaaccgacaggccattcccacccccacacacaacctcccctgttttcacattcaccatggcatcccagagcaaggacacaggagcccacaggccagttgaggttgggcaaggagacttccaggacttccagacagagtaccaggttttatttttcaccttattctctactttaaacaaatcataactttctctttaagcctctgctataaattctcctggctctcctgggcttccatattttgggggctggggtgtcaaaagtgagatgaagttcttagctccaggttttggggtaaaccaaggtaggaacattttggcatttatttcaattaacaatacttccttggacgggtgcggtggctcacgtctgtaatcccagcactttgggaggctgagacaggtggatcacttgaggtcgggagttcgagaccagcctggccaacatagcaaaaccctgtctctactaaaaatacaaaaattagatgggtgttttggcacctgcctgtaatctcagctactcaggaggctgaggcacaagaatcgcttgaatccaggaagcaagcggaggttgcagtgagttgagatcgcactccagcctgggtgacagagtgagattctgtctcaaaagcaaactaacaaagaaaaacaatacttcctggggttttggtgtgcagagggctttgttggaagtgtgactcaatcttgcctgccttctgggagctctagaattgttcccaacccagtccatggcttctagccaccactacagggctgtttcatgtacttctctctctgactctgtcttgtccgactctcttgagaatttctcaacgattgctcatgcctgtcagtatcagtgcttccatcgttccatctttgattcacttctctttcctttctatttactcccaaaatggagtcattcatcctgatgtcctcaattgctgctgatatgctggtgattcccaaatacatagctccaacccccaacttcccccagactttagatctgtattggtattacctactggacatctctatggacagttccgtatagactcaactcatctgcccaaccaagtatgttcctcctgaattcctctcctggttacttcatcacaatctacataggctcaccagctagaaacatttatgagcttacattccttcttcccatatcttatcagcatatcatatccatttcactccaacactctgtcttgaatttggccctccctctcccctctctactttaattcattggagcatgggatttggagttaggtggttttgggtttgaattccagctctactatttttggttgtgtgatagagttatttaacctctctgagcctcagttccctcgtatgtaaaatgatgataataatacctacctcacagggttgttgtgaggatttaaattagatattgtacgaaaagtgcctagcacagtgcctggcacacagtagagtaggtgctcaataaatggtagctattattattatta

SEQ ID NO: 63684 - DNA, 855 bp, Homo sapiens
tgaggtcgtctagaggatccctcgcagatggcggaagtgtgactcaatcttgcctgccttctgggagctctagaattgttcccaacccagtccatggcttctagccaccactacagggctgtttcatgtacttctctctctgactctgtcttgtccgactctcttgagaatttctcaacgattgctcatgcctgtcagtatcagtgcttccatcgttccatctttgattcacttctctttcctttctatttactcccaaaatggagtcattcatcctgatgtcctcaattgctgctgatatgctggtgattcccaaatacatagctccaacccccaacttcccccagactttagatctgtattggtattacctactggacatctctatggacagttccgtatagactcaactcatctgcccaaccaagtatgttcctcctgaattcctctcctggttacttcatcacaatctacataggctcaccagctagaaacatttatgagcttacattccttcttcccatatcttatcagcatatcatatccatttcactccaacactctgtcttgaatttggccctccctctcccctctctactttaattcattggagcatgggatttggagttaggtggttttgggtttgaattccagctctactatttttggttgtgtgatagagttatttaacctctctgagcctcagttccctcgtatgtaaaatgatgataataatacctacctcacagggttgttgtgaggatttaaattagatattgtacgaaaagtgcctagcacagtgcctggcacacagtagagtaggtgctcaataaatggtagctattattattatta

SEQ ID NO: 63685 - DNA, 1589 bp, Homo sapiens
agcggagagtggggagcggaagccgccgccgtctgggaggctcggcccggccgcccgagcaggccgcgcgcgggccgccgggcccgaggccagagccatgggcgagaccaagatcatctaccacttggatgggcaggagacgccgtaccttgtgaagctgcccctgcccgccgagcgcgtcaccttggcggactttaagggcgttttgcagcgacccagctataagttcttcttcaagtctatggacgacgatttcggagtggtgaaggaggagatctcggatgacaatgccaagctaccatgcttcaatggccgggtggtgtcctggctggtgtcagctgagggctcacacccagacccagcccccttctgtgctgataacccatcggagctgccaccacctatggagcgcacgggaggcatcggggactcccgacccccatccttccaccctcatgctggtgggggcagccaggagaacctggacaatgacacagagacggactctttggtgtctgcccagcgagagcggccacgccggagggatggcccagagcatgcaacccggctaaatggaactgcgaagggggaacggcggcgagaaccagggggttatgatagctcatccacccttatgagcagtgagctggagaccaccagcttctttgactcagatgaggatgactccaccagcaggttcagcagctccacagaacagagcagtgcctcacgcctgatgagaagacacaagcggcggcggcggaagcagaaggtttctcggattgagcggtcctcgtccttcagcagcatcacggactccaccatgtcactcaacatcatcacggtcactctcaacatggaaaaatataacttcttgggcatctccattgtgggccaaagcaacgagcgtggtgacggcggcatctacattggctctatcatgaagggtggggccgtggctgctgatggacgcatcgagccaggagatatgttgttacaggtaaacgagatcaactttgagaacatgagtaatgacgatgcagtccgggtactgcgggagattgtgcacaaaccggggcccatcaccctgactgtagccaagtgctgggacccaagtccacgtggttgcttcacattgcccaggagcgagcccatccggcccattgaccctgcggcctgggtctcccacactgcagccatgaccggcaccttccctgcatacggcatgagcccctccctgagcaccatcacctccaccagctcctccatcaccagttccatccctgacacagagcgcctagacgacttccacttgtccatccacagtgacatggctgccatcgtaaaagccatggcctcccctggatggagccccaacccgggcgttgctggggagcttgctgcaaagtcacagcaagaggcttagagggaagtgtttgccttcagtaccctggcacaggtccccatctatcagctgccatttacgtgcactgcccgtgcttcccgggtgcactgaaaggggccatgaatgtagagctaaacccgtccctgatggagccccaaaggggatctctagatcgacacagcac

SEQ ID NO: 63686 - DNA, 1279 bp, Homo sapiens
agcggagagtggggagcggaagccgccgccgtctgggaggctcggcccggccgcccgagcaggccgcgcgcgggccgccgggcccgaggccagagccatgggcgagaccaagatcatctaccacttggatgggcaggagacgccgtaccttgtgaagctgcccctgcccgccgagcgcgtcaccttggcggactttaagggcgttttgcagcgacccagctataagttcttcttcaagtctatggacgacgatttcggagtggtgaaggaggagatctcggatgacaatgccaagctaccatgcttcaatggccgggtggtgtcctggctggtgtcagctgagggctcacacccagacccagcccccttctgtgctgataacccatcggagctgccaccacctatggagcgcacgggaggcatcggggactcccgacccccatccttccaccctcatgctggtgggggcagccaggagaacctggacaatgacacagagacggactctttggtgtctgcccagcgagagcggccacgccggagggatggcccagagcatgcaacccggctaaatggaactgcgaagggggaacggcggcgagaaccagggggttatgatagctcatccacccttatgagcagtgagctggagaccaccagcttctttgactcagatgaggatgactccaccagcaggttcagcagctccacagaacagagcagtgcctcacgcctgatgagaagacacaagcggcggcggcggaagcagaaggtttctcggattgagcggtcctcgtccttcagcagcatcacggactccaccatgtcactcaacatcatcacggtcactctcaacatggaaaaatataacttcttgggcatctccattgtgggccaaagcaacgagcgtggtgacggcggcatctacattggctctatcatgaagggtggggccgtggctgctgatggacgcatcgagccaggagatatgttgttacaggtaaacgagatcaactttgagaacatgagtaatgacgatgcagtccgggtactgcgggagattgtgcacaaaccggggcccatcaccctgactgtagccaagtgctgggacccaagtccacgtggttgcttcacattgcccaggagcgagcccatccggcccattgaccctgcggcctgggtctcccacactgcagccatgaccggcaccttccctgcatacggcatgagcccctccctgagcaccaagcgccgtcccaaagcaagaagatcctctaga

SEQ ID NO: 63687 - DNA, 1270 bp, Homo sapiens
agcggagagtggggagcggaagccgccgccgtctgggaggctcggcccggccgcccgagcaggccgcgcgcgggccgccgggcccgaggccagagccatgggcgagaccaagatcatctaccacttggatgggcaggagacgccgtaccttgtgaagctgcccctgcccgccgagcgcgtcaccttggcggactttaagggcgttttgcagcgacccagctataagttcttcttcaagtctatggacgacgatttcggagtggtgaaggaggagatctcggatgacaatgccaagctaccatgcttcaatggccgggtggtgtcctggctggtgtcagctgagggctcacacccagacccagcccccttctgtgctgataacccatcggagctgccaccacctatggagcgcacgggaggcatcggggactcccgacccccatccttccaccctcatgctggtgggggcagccaggagaacctggacaatgacacagagacggactctttggtgtctgcccagcgagagcggccacgccggagggatggcccagagcatgcaacccggctaaatggaactgcgaagggggaacggcggcgagaaccagggggttatgatagctcatccacccttatgagcagtgagctggagaccaccagcttctttgactcagatgaggatgactccaccagcaggttcagcagctccacagaacagagcagtgcctcacgcctgatgagaagacacaagcggcggcggcggaagcagaaggtttctcggattgagcggtcctcgtccttcagcagcatcacggactccaccatgtcactcaacatcatcacggtcactctcaacatggaaaaatataacttcttgggcatctccattgtgggccaaagcaacgagcgtggtgacggcggcatctacattggctctatcatgaagggtggggccgtggctgctgatggacgcatcgagccaggagatatgttgttacaggtaaacgagatcaactttgagaacatgagtaatgacgatgcagtccgggtactgcgggagattgtgcacaaaccggggcccatcaccctgactgtagccaagtgctgggacccaagtccacgtggttgcttcacattgcccaggagcgagcccatccggcccaacacggtgcgttggcgttgggccaacgcaccgtgttggccaacgcaccgtgttgggccaacgcaccgtggggttggtgtaaaataggcggacagtgtagacgaacgg

SEQ ID NO: 63688 - DNA, 1182 bp, Homo sapiens
agcggagagtggggagcggaagccgccgccgtctgggaggctcggcccggccgcccgagcaggccgcgcgcgggccgccgggcccgaggccagagccatgggcgagaccaagatcatctaccacttggatgggcaggagacgccgtaccttgtgaagctgcccctgcccgccgagcgcgtcaccttggcggactttaagggcgttttgcagcgacccagctataagttcttcttcaagtctatggacgacgatttcggagtggtgaaggaggagatctcggatgacaatgccaagctaccatgcttcaatggccgggtggtgtcctggctggtgtcagctgagggctcacacccagacccagcccccttctgtgctgataacccatcggagctgccaccacctatggagcgcacgggaggcatcggggactcccgacccccatccttccaccctcatgctggtgggggcagccaggagaacctggacaatgacacagagacggactctttggtgtctgcccagcgagagcggccacgccggagggatggcccagagcatgcaacccggctaaatggaactgcgaagggggaacggcggcgagaaccagggggttatgatagctcatccacccttatgagcagtgagctggagaccaccagcttctttgactcagatgaggatgactccaccagcaggttcagcagctccacagaacagagcagtgcctcacgcctgatgagaagacacaagcggcggcggcggaagcagaaggtttctcggattgagcggtcctcgtccttcagcagcatcacggactccaccatgtcactcaacatcatcacggtcactctcaacatggaaaaatataacttcttgggcatctccattgtgggccaaagcaacgagcgtggtgacggcggcatctacattggctctatcatgaagggtggggccgtggctgctgatggacgcatcgagccaggagatatgttgttacaggtaaacgagatcaactttgagaacatgagtaatgacgatgcagtccgggtactgcgggagattgtgcacaaaccggggcccatcaccctgactgtagccaagtgctgggacccaagtccacgtggttgcttcacattgcccaggagcgagcccacccgacctcaattaaggtccttaatcag

SEQ ID NO: 63689 - DNA, 508 bp, Homo sapiens
tcagacacttgcctcaggtttccttctgccatctgctcatctctgccttagacctctgagccttgttctttgtccccattccacttcaccaccccatgccttccaacaaccccgtcaatagcaggaagtggcagaggggccactgttcatctcagccaccctcgcacagccctgtcttttctccctcgatatttcctgcttccttcctcttaggccttcatgccttgctggaagtgaactatccccttctccttgatgctcctgtaacatactactcactcagtttctccctttcagctggtgtcagctgagggctcacacccagacccagcccccttctgtgctgataacccatcggagctgccaccacctatggagcgcacgggaggcatcggggactcccgacccccatccttccagtgagtgtgacctgagggtggggagggccgcatcagttcagcccagggctgggggagggagcccccagcctgccccctcccccatcaag

SEQ ID NO: 63690 - DNA, 5403 bp, Homo sapiens
atcgtctgtttcatcaagaggagtcgcggcggcaagtacccaggtgagatgtgcaagaggcgtgggcttgcagggtggggcacgtccactttcccgtgagtctccaggtctccagccagatccggggaatgtgttctctcagtgaagccgcggccaccggaagagtcgcggtcgccagtccagtcgggagagtggggagcggaagcgcggccgcggcggcggcgggcggcgctgggacccggtagcccccggagaacaagggagctggcgccgccagcagccgccgagctgggttgagccgctgggccgcgccgcgcgccgccgccgtctgggaggctcggcccggccgcccgagcaggccgcgcgcgggccgccgggcccgaggccagagccatgggcgagaccaagatcatctaccacttggatgggcaggagacgccgtaccttgtgaagctgcccctgcccgccgagcgcgtcaccttggcggactttaagggcgttttgcagcgacccagctataagttcttcttcaagtctatggacgacgatttcggagtggtgaaggaggagatctcggatgacaatgccaagctaccatgcttcaatggccgggtggtgtcctggctggtgtcagctgagggctcacacccagacccagcccccttctgtgctgataacccatcggagctgccaccacctatggagcgcacgggaggcatcggggactcccgacccccatccttccaccctcatgctggtgggggcagccaggagaacctggacaatgacacagagacggactctttggtgtctgcccagcgagagcggccacgccggagggatggcccagagcatgcaacccggctaaatggaactgcgaagggggaacggcggcgagaaccagggggttatgatagctcatccacccttatgagcagtgagctggagaccaccagcttctttgactcagatgaggatgactccaccagcaggttcagcagctccacagaacagagcagtgcctcacgcctgatgagaagacacaagcggcggcggcggaagcagaaggtttctcggattgagcggtcctcgtccttcagcagcatcacggactccaccatgtcactcaacatcatcacggtcactctcaacatggaaaaatataacttcttgggcatctccattgtgggccaaagcaacgagcgtggtgacggcggcatctacattggctctatcatgaagggtggggccgtggctgctgatggacgcatcgagccaggagatatgttgttacaggtaaacgagatcaactttgagaacatgagtaatgacgatgcagtccgggtactgcgggagattgtgcacaaaccggggcccatcaccctgactgtagccaagtgctgggacccaagtccacgtggttgcttcacattgcccaggagcgagcccatccggcccattgaccctgcggcctgggtctcccacactgcagccatgaccggcaccttccctgcatacggcatgagcccctccctgagcaccatcacctccaccagctcctccatcaccagttccatccctgacacagagcgcctagacgacttccacttgtccatccacagtgacatggctgccatcgtaaaagccatggcctcccctgaatcagggttggaggtccgtgaccgcatgtggctcaagattaccatccctaatgctttcatcggctcagatgtggtggactggctgtaccacaatgtggaaggcttcacggaccggagggaggcccgcaagtatgccagcaacctgctgaaagctggcttcatccgccataccgtcaacaagatcaccttctccgagcagtgctactacatcttcggtgacctctgcggcaacatggccaacctgtctctccacgatcacgatggctccagtggcgcctctgaccaggacacactggcccctttgccgcacccgggggccgccccttggcccatggctttcccgtaccagtacccgccacccccgcacccatacaacccgcacccgggcttcccggagctgggctacagctacggcgggggcagcgccagcagtcagcacagcgaaggcagtcggagcagtggctccaaccgtagcggcagcgatcggaggaaggagaaggacccgaaggccggggactccaagtccgggggcagcggcagcgaatcggaccacaccacacgcagcagcctgcgggggccgcgggagcgggcgcccagcgagcgctcagggccggcggccagcgagcacagccaccgcagccaccattccctggccagcagccttcgcagccaccacacacacccgagctacggtcctcccggagtgccccctctctacggcccccccatgctgatgatgcccccgccgcccgcggccatggggcccccaggagcccctccgggccgcgacctggcctcagtgcccccggaactgaccgccagcagacagtccttccgcatggccatgggaaaccccagtgagttctttgtggatgtgatgtgagcagggcccctcccccagctccattccgctcccaccccagccggctgcgttcctctctccatccgtccgtcttttttactttgtctggtacctgaaagggaaataaaaggaactaaatccaggtgcgctaactgctcgcagggtgctgcgagggtggggtgcacctaccgattggctctgcagccccctaacctgcctctggccccagttcgtttcctctgcccactaatccctgcgcaggacttcccaggaccccttttgtctctgggaccagacttgttggtgctaccccttactcccctctgcaacccccattttgggagttgaccccagcaatgaccttggtggcacgctcactccctcattctctcgtttcccctttagctccctttcaccatttattcagctacatcatccctctattaaccccaccccatcaggcacgtgtgcaaacctcttgactttaccccacattactgaaaccaaaatatatttgcttcatctgcccctactaaccatccccctgcctgctgcctcagtcctgcaacctaaagctgtagtcgcctccaatagccatccatgccatccctgcctgtgcctagatcagaggcccagagggccccctcagttgcctgagcagctggtggcttccagggagcatctctgctctacccctgccccatgcctgccctgcgtgctggttccttcagacccctaaccctactaaccagcaggctcatctcacctccaggcctgaaacatttcttttctttcttttttcctcccccaattttccctgggcctggagcagccaagaatttcgggctgtttgactttctgtgagcccccagcgaggggaggcccagcctccgaggagaccaggaaccctgcttcagcagcccctcagggcttcccaaggatgtccagcccccacacccacacgttaacataatgagtcactaggcttctggggagggcccaacttcacccatgcatgagagactctcctcctttccagagagaatcggatcgcaccacgtgtggcagcctgcggcggggggaggggggcctctttagctctctttatctttctctctcactcatgtatgcatacatgcacagagatgcatacacaggtgcctatgcaagttcatttaagcctcagggctggtccctgcccaaagggctggaccctcctaatcctctcctaggttgtggggctggtcccctgacacccttctccccttcctggtagaccttaaacctcgcacacatgtccccagcattttctcacctggataaagcccataagctgggtctcaggctgggctcagcaaaggactcgccttgcaaccgacaggccattcccacccccacacacaacctcccctgttttcacattcaccatggcatcccagagcaaggacacaggagcccacaggccagttgaggttgggcaaggagacttccaggacttccagacagagtaccaggttttatttttcaccttattctctactttaaacaaatcataactttctctttaagcctctgctataaattctcctggctctcctgggcttccatattttgggggctggggtgtcaaaagtgagatgaagttcttagctccaggttttggggtaaaccaaggtaggaacattttggcatttatttcaattaacaatacttccttggacgggtgcggtggctcacgtctgtaatcccagcactttgggaggctgagacaggtggatcacttgaggtcgggagttcgagaccagcctggccaacatagcaaaaccctgtctctactaaaaatacaaaaattagatgggtgttttggcacctgcctgtaatctcagctactcaggaggctgaggcacaagaatcgcttgaatccaggaagcaagcggaggttgcagtgagttgagatcgcactccagcctgggtgacagagtgagattctgtctcaaaagcaaactaacaaagaaaaacaatacttcctggggttttggtgtgcagagggctttgttggaagtgtgactcaatcttgcctgccttctgggagctctagaattgttcccaacccagtccatggcttctagccaccactacagggctgtttcatgtacttctctctctgactctgtcttgtccgactctcttgagaatttctcaacgattgctcatgcctgtcagtatcagtgcttccatcgttccatctttgattcacttctctttcctttctatttactcccaaaatggagtcattcatcctgatgtcctcaattgctgctgatatgctggtgattcccaaatacatagctccaacccccaacttcccccagactttagatctgtattggtattacctactggacatctctatggacagttccgtatagactcaactcatctgcccaaccaagtatgttcctcctgaattcctctcctggttacttcatcacaatctacataggctcaccagctagaaacatttatgagcttacattccttcttcccatatcttatcagcatatcatatccatttcactccaacactctgtcttgaatttggccctccctctcccctctctactttaattcattggagcatgggatttggagttaggtggttttgggtttgaattccagctctactatttttggttgtgtgatagagttatttaacctctctgagcctcagttccctcgtatgtaaaatgatgataataatacctacctcacagggttgttgtgaggatttaaattagatattgtacgaaaagtgcctagcacagtgcctggcacacagtagagtaggtgctcaataaatggtagctattattattatta

SEQ ID NO: 63691 - DNA, 5180 bp, Homo sapiens
  misc_feature (5112)..(5112): n is a, c, g, or t
atcgtctgtttcatcaagaggagtcgcggcggcaagtacccaggtgagatgtgcaagaggcgtgggcttgcagggtggggcacgtccactttcccgtgagtctccaggtctccagccagatccggggaatgtgttctctcagtgaagccgcggccaccggaagagtcgcggtcgccagtccagtcgggagagtggggagcggaagcgcggccgcggcggcggcgggcggcgctgggacccggtagcccccggagaacaagggagctggcgccgccagcagccgccgagctgggttgagccgctgggccgcgccgcgcgccgccgccgtctgggaggctcggcccggccgcccgagcaggccgcgcgcgggccgccgggcccgaggccagagccatgggcgagaccaagatcatctaccacttggatgggcaggagacgccgtaccttgtgaagctgcccctgcccgccgagcgcgtcaccttggcggactttaagggcgttttgcagcgacccagctataagttcttcttcaagtctatggacgacgatttcggagtggtgaaggaggagatctcggatgacaatgccaagctaccatgcttcaatggccgggtggtgtcctggctggtgtcagctgagggctcacacccagacccagcccccttctgtgctgataacccatcggagctgccaccacctatggagcgcacgggaggcatcggggactcccgacccccatccttccaccctcatgctggtgggggcagccaggagaacctggacaatgacacagagacggactctttggtgtctgcccagcgagagcggccacgccggagggatggcccagagcatgcaacccggctaaatggaactgcgaagggggaacggcggcgagaaccagggggttatgatagctcatccacccttatgagcagtgagctggagaccaccagcttctttgactcagatgaggatgactccaccagcaggttcagcagctccacagaacagagcagtgcctcacgcctgatgagaagacacaagcggcggcggcggaagcagaaggtttctcggattgagcggtcctcgtccttcagcagcatcacggactccaccatgtcactcaacatcatcacggtcactctcaacatggaaaaatataacttcttgggcatctccattgtgggccaaagcaacgagcgtggtgacggcggcatctacattggctctatcatgaagggtggggccgtggctgctgatggacgcatcgagccaggagatatgttgttacaggtaaacgagatcaactttgagaacatgagtaatgacgatgcagtccgggtactgcgggagattgtgcacaaaccggggcccatcaccctgactgtagccaagtgctgggacccaagtccacgtggttgcttcacattgcccaggagcgagcccatccggcccattgaccctgcggcctgggtctcccacactgcagccatgaccggcaccttccctgcatacggcatgagcccctccctgagcaccatcacctccaccagctcctccatcaccagttccatccctgacacagagcgcctagacgacttccacttgtccatccacagtgacatggctgccatcgtaaaagccatggcctcccctgaatcagggttggaggtccgtgaccgcatgtggctcaagattaccatccctaatgctttcatcggctcagatgtggtggactggctgtaccacaatgtggaaggcttcacggaccggagggaggcccgcaagtatgccagcaacctgctgaaagctggcttcatccgccataccgtcaacaagatcaccttctccgagcagtgctactacatcttcggtgacctctgcggcaacatggccaacctgtctctccacgatcacgatggctccagtggcgcctctgaccaggacacactggcccctttgccgcacccgggggccgccccttggcccatggctttcccgtaccagtacccgccacccccgcacccatacaacccgcacccgggcttcccggagctgggctacagctacggcgggggcagcgccagcagtcagcacagcgaaggcagtcggagcagtggctccaaccgtagcggcagcgatcggaggaaggagaaggacccgaaggccggggactccaagtccgggggcagcggcagcgaatcggaccacaccacacgcagcagcctgcgggggccgcgggagcgggcgcccagcgagcgctcagggccggcggccagcgagcacagccaccgcagccaccattccctggccagcagccttcgcagccaccacacacacccgagctacggtcctcccggagtgccccctctctacggcccccccatgctgatgatgcccccgccgcccgcggccatggggcccccaggagcccctccgggccgcgacctggcctcagtgcccccggaactgaccgccagcagacagtccttccgcatggccatgggaaaccccagtgagttctttgtggatgtgatgtgagcagggcccctcccccagctccattccgctcccaccccagccggctgcgttcctctctccatccgtccgtcttttttactttgtctggtacctgaaagggaaataaaaggaactaaatccaggtgcgctaactgctcgcagggtgctgcgagggtggggtgcacctaccgattggctctgcagccccctaacctgcctctggccccagttcgtttcctctgcccactaatccctgcgcaggacttcccaggaccccttttgtctctgggaccagacttgttggtgctaccccttactcccctctgcaacccccattttgggagttgaccccagcaatgaccttggtggcacgctcactccctcattctctcgtttcccctttagctccctttcaccatttattcagctacatcatccctctattaaccccaccccatcaggcacgtgtgcaaacctcttgactttaccccacattactgaaaccaaaatatatttgcttcatctgcccctactaaccatccccctgcctgctgcctcagtcctgcaacctaaagctgtagtcgcctccaatagccatccatgccatccctgcctgtgcctagatcagaggcccagagggccccctcagttgcctgagcagctggtggcttccagggagcatctctgctctacccctgccccatgcctgccctgcgtgctggttccttcagacccctaaccctactaaccagcaggctcatctcacctccaggcctgaaacatttcttttctttcttttttcctcccccaattttccctgggcctggagcagccaagaatttcgggctgtttgactttctgtgagcccccagcgaggggaggcccagcctccgaggagaccaggaaccctgcttcagcagcccctcagggcttcccaaggatgtccagcccccacacccacacgttaacataatgagtcactaggcttctggggagggcccaacttcacccatgcatgagagactctcctcctttccagagagaatcggatcgcaccacgtgtggcagcctgcggcggggggaggggggcctctttagctctctttatctttctctctcactcatgtatgcatacatgcacagagatgcatacacaggtgcctatgcaagttcatttaagcctcagggctggtccctgcccaaagggctggaccctcctaatcctctcctaggttgtggggctggtcccctgacacccttctccccttcctggtagaccttaaacctcgcacacatgtccccagcattttctcacctggataaagcccataagctgggtctcaggctgggctcagcaaaggactcgccttgcaaccgacaggccattcccacccccacacacaacctcccctgttttcacattcaccatggcatcccagagcaaggacacaggagcccacaggccagttgaggttgggcaaggagacttccaggacttccagacagagtaccaggttttatttttcaccttattctctactttaaacaaatcataactttctctttaagcctctgctataaattctcctggctctcctgggcttccatattttgggggctggggtgtcaaaagtgagatgaagttcttagctccaggttttggggtaaaccaaggtaggaacattttggcatttatttcaattaacaatacttccttggacgggtgcggtggctcacgtctgtaatcccagcactttgggaggctgagacaggtggatcacttgaggtcgggagttcgagaccagcctggccaacatagcaaaaccctgtctctactaaaaatacaaaaattagatgggtgttttggcacctgcctgtaatctcagctactcaggaggctgaggcacaagaatcgcttgaatccaggaagcaagcggaggttgcagtgagttgagatcgcactccagcctgggtgacagagtgagattctgtctcaaaagcaaactaacaaagaaaaacaatacttcctggggttttggtgtgcagagggctttgttggaagtgtgactcaatcttgcctgccttctgggagctctagaattgttcccaacccagtccatggcttctagccaccactacagggctgtttcatgtacttctctctctgactctgtcttgtccgactctcttgagaatttctcaacgattgctcatgcctgtcagtatcagtgcttccatcgttccatctttgattcacttctctttcctttctatttactcccaaaatggagtcattcatcctgatgtcctcaattgctgctgatatgctggtgattcccaaatacatagctccaacccccaacttcccccagactttagatctgtattggtattacctactggacatctctatggacagttccgtatagactcaactcatctgcccaaccaagtatgttcctcctgaattcctctcctggttacttcatcacaatctacataggctcaccagctagaaacatttatgagcttacattccttcttcccatatcttatcagcatatcatatccatttcactccttcacccnagctatagcttgggtgaaggagtgacattggctgacatcacagttgtctgcaccctgttgtggctcta

SEQ ID NO: 63692 - DNA, 4826 bp, Homo sapiens
atcgtctgtttcatcaagaggagtcgcggcggcaagtacccaggtgagatgtgcaagaggcgtgggcttgcagggtggggcacgtccactttcccgtgagtctccaggtctccagccagatccggggaatgtgttctctcagtgaagccgcggccaccggaagagtcgcggtcgccagtccagtcgggagagtggggagcggaagcgcggccgcggcggcggcgggcggcgctgggacccggtagcccccggagaacaagggagctggcgccgccagcagccgccgagctgggttgagccgctgggccgcgccgcgcgccgccgccgtctgggaggctcggcccggccgcccgagcaggccgcgcgcgggccgccgggcccgaggccagagccatgggcgagaccaagatcatctaccacttggatgggcaggagacgccgtaccttgtgaagctgcccctgcccgccgagcgcgtcaccttggcggactttaagggcgttttgcagcgacccagctataagttcttcttcaagtctatggacgacgatttcggagtggtgaaggaggagatctcggatgacaatgccaagctaccatgcttcaatggccgggtggtgtcctggctggtgtcagctgagggctcacacccagacccagcccccttctgtgctgataacccatcggagctgccaccacctatggagcgcacgggaggcatcggggactcccgacccccatccttccaccctcatgctggtgggggcagccaggagaacctggacaatgacacagagacggactctttggtgtctgcccagcgagagcggccacgccggagggatggcccagagcatgcaacccggctaaatggaactgcgaagggggaacggcggcgagaaccagggggttatgatagctcatccacccttatgagcagtgagctggagaccaccagcttctttgactcagatgaggatgactccaccagcaggttcagcagctccacagaacagagcagtgcctcacgcctgatgagaagacacaagcggcggcggcggaagcagaaggtttctcggattgagcggtcctcgtccttcagcagcatcacggactccaccatgtcactcaacatcatcacggtcactctcaacatggaaaaatataacttcttgggcatctccattgtgggccaaagcaacgagcgtggtgacggcggcatctacattggctctatcatgaagggtggggccgtggctgctgatggacgcatcgagccaggagatatgttgttacaggtaaacgagatcaactttgagaacatgagtaatgacgatgcagtccgggtactgcgggagattgtgcacaaaccggggcccatcaccctgactgtagccaagtgctgggacccaagtccacgtggttgcttcacattgcccaggagcgagcccatccggcccattgaccctgcggcctgggtctcccacactgcagccatgaccggcaccttccctgcatacggcatgagcccctccctgagcaccatcacctccaccagctcctccatcaccagttccatccctgacacagagcgcctagacgacttccacttgtccatccacagtgacatggctgccatcgtaaaagccatggcctcccctgaatcagggttggaggtccgtgaccgcatgtggctcaagattaccatccctaatgctttcatcggctcagatgtggtggactggctgtaccacaatgtggaaggcttcacggaccggagggaggcccgcaagtatgccagcaacctgctgaaagctggcttcatccgccataccgtcaacaagatcaccttctccgagcagtgctactacatcttcggtgacctctgcggcaacatggccaacctgtctctccacgatcacgatggctccagtggcgcctctgaccaggacacactggcccctttgccgcacccgggggccgccccttggcccatggctttcccgtaccagtacccgccacccccgcacccatacaacccgcacccgggcttcccggagctgggctacagctacggcgggggcagcgccagcagtcagcacagcgaaggcagtcggagcagtggctccaaccgtagcggcagcgatcggaggaaggagaaggacccgaaggccggggactccaagtccgggggcagcggcagcgaatcggaccacaccacacgcagcagcctgcgggggccgcgggagcgggcgcccagcgagcgctcagggccggcggccagcgagcacagccaccgcagccaccattccctggccagcagccttcgcagccaccacacacacccgagctacggtcctcccggagtgccccctctctacggcccccccatgctgatgatgcccccgccgcccgcggccatggggcccccaggagcccctccgggccgcgacctggcctcagtgcccccggaactgaccgccagcagacagtccttccgcatggccatgggaaaccccagtgagttctttgtggatgtgatgtgagcagggcccctcccccagctccattccgctcccaccccagccggctgcgttcctctctccatccgtccgtcttttttactttgtctggtacctgaaagggaaataaaaggaactaaatccaggtgcgctaactgctcgcagggtgctgcgagggtggggtgcacctaccgattggctctgcagccccctaacctgcctctggccccagttcgtttcctctgcccactaatccctgcgcaggacttcccaggaccccttttgtctctgggaccagacttgttggtgctaccccttactcccctctgcaacccccattttgggagttgaccccagcaatgaccttggtggcacgctcactccctcattctctcgtttcccctttagctccctttcaccatttattcagctacatcatccctctattaaccccaccccatcaggcacgtgtgcaaacctcttgactttaccccacattactgaaaccaaaatatatttgcttcatctgcccctactaaccatccccctgcctgctgcctcagtcctgcaacctaaagctgtagtcgcctccaatagccatccatgccatccctgcctgtgcctagatcagaggcccagagggccccctcagttgcctgagcagctggtggcttccagggagcatctctgctctacccctgccccatgcctgccctgcgtgctggttccttcagacccctaaccctactaaccagcaggctcatctcacctccaggcctgaaacatttcttttctttcttttttcctcccccaattttccctgggcctggagcagccaagaatttcgggctgtttgactttctgtgagcccccagcgaggggaggcccagcctccgaggagaccaggaaccctgcttcagcagcccctcagggcttcccaaggatgtccagcccccacacccacacgttaacataatgagtcactaggcttctggggagggcccaacttcacccatgcatgagagactctcctcctttccagagagaatcggatcgcaccacgtgtggcagcctgcggcggggggaggggggcctctttagctctctttatctttctctctcactcatgtatgcatacatgcacagagatgcatacacaggtgcctatgcaagttcatttaagcctcagggctggtccctgcccaaagggctggaccctcctaatcctctcctaggttgtggggctggtcccctgacacccttctccccttcctggtagaccttaaacctcgcacacatgtccccagcattttctcacctggataaagcccataagctgggtctcaggctgggctcagcaaaggactcgccttgcaaccgacaggccattcccacccccacacacaacctcccctgttttcacattcaccatggcatcccagagcaaggacacaggagcccacaggccagttgaggttgggcaaggagacttccaggacttccagacagagtaccaggttttatttttcaccttattctctactttaaacaaatcataactttctctttaagcctctgctataaattctcctggctctcctgggcttccatattttgggggctggggtgtcaaaagtgagatgaagttcttagctccaggttttggggtaaaccaaggtaggaacattttggcatttatttcaattaacaatacttccttggacgggtgcggtggctcacgtctgtaatcccagcactttgggaggctgagacaggtggatcacttgaggtcgggagttcgagaccagcctggccaacatagcaaaaccctgtctctactaaaaatacaaaaattagatgggtgttttggcacctgcctgtaatctcagctactcaggaggctgaggcacaagaatcgcttgaatccaggaagcaagcggaggttgcagtgagttgagatcgcactccagcctgggtgacagagtgagattctgtctcaaaagcaaactaacaaagaaaaacaatacttcctggggttttggtgtgcagagggctttgttggaagtgtgactcaatcttgcctgccttctgggagctctagaattgttcccaacccagtccatggcttctagccaccactacagggctgtttcatgtacttctctctctgactctgtcttgtccgactctcttgagaatttctcaacgattgctcatgcctgtcagtatcagtgcttccatcgttccattgagaaatcagctttcagtcttactatcaatcttttcatgctatcatgtctttctct

SEQ ID NO: 63693 - DNA, 4913 bp, Homo sapiens
ttgcgttataggtgttctcacagatttcccgacgctgtcatccttatgctacgactttgggtagtttctgcctccgttagcgtgatccggggtcagccaggagaacctggacaatgacacagagacggactctttggtgtctgcccagcgagagcggccacgccggagggatggcccagagcatgcaacccggctaaatggaactgcgaagggggaacggcggcgagaaccagggggttatgatagctcatccacccttatgagcagtgagctggagaccaccagcttctttgactcagatgaggatgactccaccagcaggtggggcttgagtttcatgggtattgtggggcaggtgaccctggaggagccctaaaccctgaggatgcggggcccctgggaggcttatgggctttgtgttggggacccaggccctgcagtgcctcccctcatgggggcagggctgggccagcctggtggggaacgactgtgggccccacaggttcagcagctccacagaacagagcagtgcctcacgcctgatgagaagacacaagcggcggcggcggaagcagaaggtttctcggattgagcggtcctcgtccttcagcagcatcacggactccaccatgtcactcaacatcatcacggtcactctcaacatggaaaaatataacttcttgggcatctccattgtgggccaaagcaacgagcgtggtgacggcggcatctacattggctctatcatgaagggtggggccgtggctgctgatggacgcatcgagccaggagatatgttgttacaggtaaacgagatcaactttgagaacatgagtaatgacgatgcagtccgggtactgcgggagattgtgcacaaaccggggcccatcaccctgactgtagccaagtgctgggacccaagtccacgtggttgcttcacattgcccaggagcgagcccatccggcccattgaccctgcggcctgggtctcccacactgcagccatgaccggcaccttccctgcatacggcatgagcccctccctgagcaccatcacctccaccagctcctccatcaccagttccatccctgacacagagcgcctagacgacttccacttgtccatccacagtgacatggctgccatcgtaaaagccatggcctcccctgaatcagggttggaggtccgtgaccgcatgtggctcaagattaccatccctaatgctttcatcggctcagatgtggtggactggctgtaccacaatgtggaaggcttcacggaccggagggaggcccgcaagtatgccagcaacctgctgaaagctggcttcatccgccataccgtcaacaagatcaccttctccgagcagtgctactacatcttcggtgacctctgcggcaacatggccaacctgtctctccacgatcacgatggctccagtggcgcctctgaccaggacacactggcccctttgccgcacccgggggccgccccttggcccatggctttcccgtaccagtacccgccacccccgcacccatacaacccgcacccgggcttcccggagctgggctacagctacggcgggggcagcgccagcagtcagcacagcgaaggcagtcggagcagtggctccaaccgtagcggcagcgatcggaggaaggagaaggacccgaaggccggggactccaagtccgggggcagcggcagcgaatcggaccacaccacacgcagcagcctgcgggggccgcgggagcgggcgcccagcgagcgctcagggccggcggccagcgagcacagccaccgcagccaccattccctggccagcagccttcgcagccaccacacacacccgagctacggtcctcccggagtgccccctctctacggcccccccatgctgatgatgcccccgccgcccgcggccatggggcccccaggagcccctccgggccgcgacctggcctcagtgcccccggaactgaccgccagcagacagtccttccgcatggccatgggaaaccccagtgagttctttgtggatgtgatgtgagcagggcccctcccccagctccattccgctcccaccccagccggctgcgttcctctctccatccgtccgtcttttttactttgtctggtacctgaaagggaaataaaaggaactaaatccaggtgcgctaactgctcgcagggtgctgcgagggtggggtgcacctaccgattggctctgcagccccctaacctgcctctggccccagttcgtttcctctgcccactaatccctgcgcaggacttcccaggaccccttttgtctctgggaccagacttgttggtgctaccccttactcccctctgcaacccccattttgggagttgaccccagcaatgaccttggtggcacgctcactccctcattctctcgtttcccctttagctccctttcaccatttattcagctacatcatccctctattaaccccaccccatcaggcacgtgtgcaaacctcttgactttaccccacattactgaaaccaaaatatatttgcttcatctgcccctactaaccatccccctgcctgctgcctcagtcctgcaacctaaagctgtagtcgcctccaatagccatccatgccatccctgcctgtgcctagatcagaggcccagagggccccctcagttgcctgagcagctggtggcttccagggagcatctctgctctacccctgccccatgcctgccctgcgtgctggttccttcagacccctaaccctactaaccagcaggctcatctcacctccaggcctgaaacatttcttttctttcttttttcctcccccaattttccctgggcctggagcagccaagaatttcgggctgtttgactttctgtgagcccccagcgaggggaggcccagcctccgaggagaccaggaaccctgcttcagcagcccctcagggcttcccaaggatgtccagcccccacacccacacgttaacataatgagtcactaggcttctggggagggcccaacttcacccatgcatgagagactctcctcctttccagagagaatcggatcgcaccacgtgtggcagcctgcggcggggggaggggggcctctttagctctctttatctttctctctcactcatgtatgcatacatgcacagagatgcatacacaggtgcctatgcaagttcatttaagcctcagggctggtccctgcccaaagggctggaccctcctaatcctctcctaggttgtggggctggtcccctgacacccttctccccttcctggtagaccttaaacctcgcacacatgtccccagcattttctcacctggataaagcccataagctgggtctcaggctgggctcagcaaaggactcgccttgcaaccgacaggccattcccacccccacacacaacctcccctgttttcacattcaccatggcatcccagagcaaggacacaggagcccacaggccagttgaggttgggcaaggagacttccaggacttccagacagagtaccaggttttatttttcaccttattctctactttaaacaaatcataactttctctttaagcctctgctataaattctcctggctctcctgggcttccatattttgggggctggggtgtcaaaagtgagatgaagttcttagctccaggttttggggtaaaccaaggtaggaacattttggcatttatttcaattaacaatacttccttggacgggtgcggtggctcacgtctgtaatcccagcactttgggaggctgagacaggtggatcacttgaggtcgggagttcgagaccagcctggccaacatagcaaaaccctgtctctactaaaaatacaaaaattagatgggtgttttggcacctgcctgtaatctcagctactcaggaggctgaggcacaagaatcgcttgaatccaggaagcaagcggaggttgcagtgagttgagatcgcactccagcctgggtgacagagtgagattctgtctcaaaagcaaactaacaaagaaaaacaatacttcctggggttttggtgtgcagagggctttgttggaagtgtgactcaatcttgcctgccttctgggagctctagaattgttcccaacccagtccatggcttctagccaccactacagggctgtttcatgtacttctctctctgactctgtcttgtccgactctcttgagaatttctcaacgattgctcatgcctgtcagtatcagtgcttccatcgttccatctttgattcacttctctttcctttctatttactcccaaaatggagtcattcatcctgatgtcctcaattgctgctgatatgctggtgattcccaaatacatagctccaacccccaacttcccccagactttagatctgtattggtattacctactggacatctctatggacagttccgtatagactcaactcatctgcccaaccaagtatgttcctcctgaattcctctcctggttacttcatcacaatctacataggctcaccagctagaaacatttatgagcttacattccttcttcccatatcttatcagcatatcatatccatttcactccaacactctgtcttgaatttggccctccctctcccctctctactttaattcattggagcatgggatttggagttaggtggttttgggtttgaattccagctctactatttttggttgtgtgatagagttatttaacctctctgagcctcagttccctcgtatgtaaaatgatgataataatacctacctcacagggttgttgtgaggatttaaattagatattgtacgaaaagtgcctagcacagtgcctggcacacagtagagtaggtgctcaataaatggtagctattattattatta

SEQ ID NO: 63694 - DNA, 4522 bp, Homo sapiens
tcagaggatcccgtggctcatcaggggttatgatagctcatccacccttatgagcagtgagctggagaccaccagcttctttgactcagatgaggatgactccaccagcaggttcagcagctccacagaacagagcagtgcctcacgcctgatgagaagacacaagcggcggcggcggaagcagaaggtttctcggattgagcggtcctcgtccttcagcagcatcacggactccaccatgtcactcaacatcatcacggtcactctcaacatggaaaaatataacttcttgggcatctccattgtgggccaaagcaacgagcgtggtgacggcggcatctacattggctctatcatgaagggtggggccgtggctgctgatggacgcatcgagccaggagatatgttgttacaggtaaacgagatcaactttgagaacatgagtaatgacgatgcagtccgggtactgcgggagattgtgcacaaaccggggcccatcaccctgactgtagccaagtgctgggacccaagtccacgtggttgcttcacattgcccaggagcgagcccatccggcccattgaccctgcggcctgggtctcccacactgcagccatgaccggcaccttccctgcatacggcatgagcccctccctgagcaccatcacctccaccagctcctccatcaccagttccatccctgacacagagcgcctagacgacttccacttgtccatccacagtgacatggctgccatcgtaaaagccatggcctcccctgaatcagggttggaggtccgtgaccgcatgtggctcaagattaccatccctaatgctttcatcggctcagatgtggtggactggctgtaccacaatgtggaaggcttcacggaccggagggaggcccgcaagtatgccagcaacctgctgaaagctggcttcatccgccataccgtcaacaagatcaccttctccgagcagtgctactacatcttcggtgacctctgcggcaacatggccaacctgtctctccacgatcacgatggctccagtggcgcctctgaccaggacacactggcccctttgccgcacccgggggccgccccttggcccatggctttcccgtaccagtacccgccacccccgcacccatacaacccgcacccgggcttcccggagctgggctacagctacggcgggggcagcgccagcagtcagcacagcgaaggcagtcggagcagtggctccaaccgtagcggcagcgatcggaggaaggagaaggacccgaaggccggggactccaagtccgggggcagcggcagcgaatcggaccacaccacacgcagcagcctgcgggggccgcgggagcgggcgcccagcgagcgctcagggccggcggccagcgagcacagccaccgcagccaccattccctggccagcagccttcgcagccaccacacacacccgagctacggtcctcccggagtgccccctctctacggcccccccatgctgatgatgcccccgccgcccgcggccatggggcccccaggagcccctccgggccgcgacctggcctcagtgcccccggaactgaccgccagcagacagtccttccgcatggccatgggaaaccccagtgagttctttgtggatgtgatgtgagcagggcccctcccccagctccattccgctcccaccccagccggctgcgttcctctctccatccgtccgtcttttttactttgtctggtacctgaaagggaaataaaaggaactaaatccaggtgcgctaactgctcgcagggtgctgcgagggtggggtgcacctaccgattggctctgcagccccctaacctgcctctggccccagttcgtttcctctgcccactaatccctgcgcaggacttcccaggaccccttttgtctctgggaccagacttgttggtgctaccccttactcccctctgcaacccccattttgggagttgaccccagcaatgaccttggtggcacgctcactccctcattctctcgtttcccctttagctccctttcaccatttattcagctacatcatccctctattaaccccaccccatcaggcacgtgtgcaaacctcttgactttaccccacattactgaaaccaaaatatatttgcttcatctgcccctactaaccatccccctgcctgctgcctcagtcctgcaacctaaagctgtagtcgcctccaatagccatccatgccatccctgcctgtgcctagatcagaggcccagagggccccctcagttgcctgagcagctggtggcttccagggagcatctctgctctacccctgccccatgcctgccctgcgtgctggttccttcagacccctaaccctactaaccagcaggctcatctcacctccaggcctgaaacatttcttttctttcttttttcctcccccaattttccctgggcctggagcagccaagaatttcgggctgtttgactttctgtgagcccccagcgaggggaggcccagcctccgaggagaccaggaaccctgcttcagcagcccctcagggcttcccaaggatgtccagcccccacacccacacgttaacataatgagtcactaggcttctggggagggcccaacttcacccatgcatgagagactctcctcctttccagagagaatcggatcgcaccacgtgtggcagcctgcggcggggggaggggggcctctttagctctctttatctttctctctcactcatgtatgcatacatgcacagagatgcatacacaggtgcctatgcaagttcatttaagcctcagggctggtccctgcccaaagggctggaccctcctaatcctctcctaggttgtggggctggtcccctgacacccttctccccttcctggtagaccttaaacctcgcacacatgtccccagcattttctcacctggataaagcccataagctgggtctcaggctgggctcagcaaaggactcgccttgcaaccgacaggccattcccacccccacacacaacctcccctgttttcacattcaccatggcatcccagagcaaggacacaggagcccacaggccagttgaggttgggcaaggagacttccaggacttccagacagagtaccaggttttatttttcaccttattctctactttaaacaaatcataactttctctttaagcctctgctataaattctcctggctctcctgggcttccatattttgggggctggggtgtcaaaagtgagatgaagttcttagctccaggttttggggtaaaccaaggtaggaacattttggcatttatttcaattaacaatacttccttggacgggtgcggtggctcacgtctgtaatcccagcactttgggaggctgagacaggtggatcacttgaggtcgggagttcgagaccagcctggccaacatagcaaaaccctgtctctactaaaaatacaaaaattagatgggtgttttggcacctgcctgtaatctcagctactcaggaggctgaggcacaagaatcgcttgaatccaggaagcaagcggaggttgcagtgagttgagatcgcactccagcctgggtgacagagtgagattctgtctcaaaagcaaactaacaaagaaaaacaatacttcctggggttttggtgtgcagagggctttgttggaagtgtgactcaatcttgcctgccttctgggagctctagaattgttcccaacccagtccatggcttctagccaccactacagggctgtttcatgtacttctctctctgactctgtcttgtccgactctcttgagaatttctcaacgattgctcatgcctgtcagtatcagtgcttccatcgttccatctttgattcacttctctttcctttctatttactcccaaaatggagtcattcatcctgatgtcctcaattgctgctgatatgctggtgattcccaaatacatagctccaacccccaacttcccccagactttagatctgtattggtattacctactggacatctctatggacagttccgtatagactcaactcatctgcccaaccaagtatgttcctcctgaattcctctcctggttacttcatcacaatctacataggctcaccagctagaaacatttatgagcttacattccttcttcccatatcttatcagcatatcatatccatttcactccaacactctgtcttgaatttggccctccctctcccctctctactttaattcattggagcatgggatttggagttaggtggttttgggtttgaattccagctctactatttttggttgtgtgatagagttatttaacctctctgagcctcagttccctcgtatgtaaaatgatgataataatacctacctcacagggttgttgtgaggatttaaattagatattgtacgaaaagtgcctagcacagtgcctggcacacagtagagtaggtgctcaataaatggtagctattattattatta

SEQ ID NO: 63695 - DNA, 3813 bp, Homo sapiens
  misc_feature (112)..(112): n is a, c, g, or t
  misc_feature (114)..(114): n is a, c, g, or t
  misc_feature (117)..(117): n is a, c, g, or t
agctgactggcaaccatctgcctttccacttccagttctcgggtgagtcgctgaaactgaagctcctgctccttcacggatgctagaatagtggtggctgtggtctcgggtncnatncctaatgctttcatcggctcagatgtggtggactggctgtaccacaatgtggaaggcttcacggaccggagggaggcccgcaagtatgccagcaacctgctgaaagctggcttcatccgccataccgtcaacaagatcaccttctccgagcagtgctactacatcttcggtgacctctgcggcaacatggccaacctgtctctccacgatcacgatggctccagtggcgcctctgaccaggacacactggcccctttgccgcacccgggggccgccccttggcccatggctttcccgtaccagtacccgccacccccgcacccatacaacccgcacccgggcttcccggagctgggctacagctacggcgggggcagcgccagcagtcagcacagcgaaggcagtcggagcagtggctccaaccgtagcggcagcgatcggaggaaggagaaggacccgaaggccggggactccaagtccgggggcagcggcagcgaatcggaccacaccacacgcagcagcctgcgggggccgcgggagcgggcgcccagcgagcgctcagggccggcggccagcgagcacagccaccgcagccaccattccctggccagcagccttcgcagccaccacacacacccgagctacggtcctcccggagtgccccctctctacggcccccccatgctgatgatgcccccgccgcccgcggccatggggcccccaggagcccctccgggccgcgacctggcctcagtgcccccggaactgaccgccagcagacagtccttccgcatggccatgggaaaccccagtgagttctttgtggatgtgatgtgagcagggcccctcccccagctccattccgctcccaccccagccggctgcgttcctctctccatccgtccgtcttttttactttgtctggtacctgaaagggaaataaaaggaactaaatccaggtgcgctaactgctcgcagggtgctgcgagggtggggtgcacctaccgattggctctgcagccccctaacctgcctctggccccagttcgtttcctctgcccactaatccctgcgcaggacttcccaggaccccttttgtctctgggaccagacttgttggtgctaccccttactcccctctgcaacccccattttgggagttgaccccagcaatgaccttggtggcacgctcactccctcattctctcgtttcccctttagctccctttcaccatttattcagctacatcatccctctattaaccccaccccatcaggcacgtgtgcaaacctcttgactttaccccacattactgaaaccaaaatatatttgcttcatctgcccctactaaccatccccctgcctgctgcctcagtcctgcaacctaaagctgtagtcgcctccaatagccatccatgccatccctgcctgtgcctagatcagaggcccagagggccccctcagttgcctgagcagctggtggcttccagggagcatctctgctctacccctgccccatgcctgccctgcgtgctggttccttcagacccctaaccctactaaccagcaggctcatctcacctccaggcctgaaacatttcttttctttcttttttcctcccccaattttccctgggcctggagcagccaagaatttcgggctgtttgactttctgtgagcccccagcgaggggaggcccagcctccgaggagaccaggaaccctgcttcagcagcccctcagggcttcccaaggatgtccagcccccacacccacacgttaacataatgagtcactaggcttctggggagggcccaacttcacccatgcatgagagactctcctcctttccagagagaatcggatcgcaccacgtgtggcagcctgcggcggggggaggggggcctctttagctctctttatctttctctctcactcatgtatgcatacatgcacagagatgcatacacaggtgcctatgcaagttcatttaagcctcagggctggtccctgcccaaagggctggaccctcctaatcctctcctaggttgtggggctggtcccctgacacccttctccccttcctggtagaccttaaacctcgcacacatgtccccagcattttctcacctggataaagcccataagctgggtctcaggctgggctcagcaaaggactcgccttgcaaccgacaggccattcccacccccacacacaacctcccctgttttcacattcaccatggcatcccagagcaaggacacaggagcccacaggccagttgaggttgggcaaggagacttccaggacttccagacagagtaccaggttttatttttcaccttattctctactttaaacaaatcataactttctctttaagcctctgctataaattctcctggctctcctgggcttccatattttgggggctggggtgtcaaaagtgagatgaagttcttagctccaggttttggggtaaaccaaggtaggaacattttggcatttatttcaattaacaatacttccttggacgggtgcggtggctcacgtctgtaatcccagcactttgggaggctgagacaggtggatcacttgaggtcgggagttcgagaccagcctggccaacatagcaaaaccctgtctctactaaaaatacaaaaattagatgggtgttttggcacctgcctgtaatctcagctactcaggaggctgaggcacaagaatcgcttgaatccaggaagcaagcggaggttgcagtgagttgagatcgcactccagcctgggtgacagagtgagattctgtctcaaaagcaaactaacaaagaaaaacaatacttcctggggttttggtgtgcagagggctttgttggaagtgtgactcaatcttgcctgccttctgggagctctagaattgttcccaacccagtccatggcttctagccaccactacagggctgtttcatgtacttctctctctgactctgtcttgtccgactctcttgagaatttctcaacgattgctcatgcctgtcagtatcagtgcttccatcgttccatctttgattcacttctctttcctttctatttactcccaaaatggagtcattcatcctgatgtcctcaattgctgctgatatgctggtgattcccaaatacatagctccaacccccaacttcccccagactttagatctgtattggtattacctactggacatctctatggacagttccgtatagactcaactcatctgcccaaccaagtatgttcctcctgaattcctctcctggttacttcatcacaatctacataggctcaccagctagaaacatttatgagcttacattccttcttcccatatcttatcagcatatcatatccatttcactccaacactctgtcttgaatttggccctccctctcccctctctactttaattcattggagcatgggatttggagttaggtggttttgggtttgaattccagctctactatttttggttgtgtgatagagttatttaacctctctgagcctcagttccctcgtatgtaaaatgatgataataatacctacctcacagggttgttgtgaggatttaaattagatattgtacgaaaagtgcctagcacagtgcctggcacacagtagagtaggtgctcaataaatggtagctattattattatta

SEQ ID NO: 63696 - DNA, 4114 bp, Homo sapiens
agcggagagtggggagcggaagccgccgccgtctgggaggctcggcccggccgcccgagcaggccgcgcgcgggccgccgggcccgaggccagagccatgggcgagaccaagatcatctaccacttggatgggcaggagacgccgtaccttgtgaagctgcccctgcccgccgagcgcgtcaccttggcggactttaagggcgttttgcagcgacccagctataagttcttcttcaagtctatggacgacgatttcggagtggtgaaggaggagatctcggatgacaatgccaagctaccatgcttcaatggccgggtggtgtcctggctggtgtcagctgagggctcacacccagacccagcccccttctgtgctgataacccatcggagctgccaccacctatggagcgcacgggaggcatcggggactcccgacccccatccttccaccctcatgctggtgggggcagccaggagaacctggacaatgacacagagacggactctttggtgtctgcccagcgagagcggccacgccggagggatggcccagagcatgcaacccggctaaatggaactgcgaagggggaacggcggcgagaaccagggggttatgatagctcatccacccttatgagcagtgagctggagaccaccagcttctttgactcagatgaggatgactccaccagcaggttcagcagctccacagaacagagcagtgcctcacgcctgatgagaagacacaagcggcggcggcggaagcagaaggtttctcggattgagcggtcctcgtccttcagcagcatcacggactccaccatgtcactcaacatcatcacggtcactctcaacatggaaaaatataacttcttgggcatctccattgtgggccaaagcaacgagcgtggtgacggcggcatctacattggctctatcatgaagggtggggccgtggctgctgatggacgcatcgagccaggagatatgttgttacaggtaaacgagatcaactttgagaacatgagtaatgacgatgcagtccgggtactgcgggagattgtgcacaaaccggggcccatcaccctgactgtagccaagtgctgggacccaagtccacgtggttgcttcacattgcccaggagcgagcccatccggcccattgaccctgcggcctgggtctcccacactgcagccatgaccggcaccttccctgcatacggcatgagcccctccctgagcaccatcacctccaccagctcctccatcaccagttccatccctgacacagagcccggctgcgttcctctctccatccgtccgtcttttttactttgtctggtacctgaaagggaaataaaaggaactaaatccaggtgcgctaactgctcgcagggtgctgcgagggtggggtgcacctaccgattggctctgcagccccctaacctgcctctggccccagttcgtttcctctgcccactaatccctgcgcaggacttcccaggaccccttttgtctctgggaccagacttgttggtgctaccccttactcccctctgcaacccccattttgggagttgaccccagcaatgaccttggtggcacgctcactccctcattctctcgtttcccctttagctccctttcaccatttattcagctacatcatccctctattaaccccaccccatcaggcacgtgtgcaaacctcttgactttaccccacattactgaaaccaaaatatatttgcttcatctgcccctactaaccatccccctgcctgctgcctcagtcctgcaacctaaagctgtagtcgcctccaatagccatccatgccatccctgcctgtgcctagatcagaggcccagagggccccctcagttgcctgagcagctggtggcttccagggagcatctctgctctacccctgccccatgcctgccctgcgtgctggttccttcagacccctaaccctactaaccagcaggctcatctcacctccaggcctgaaacatttcttttctttcttttttcctcccccaattttccctgggcctggagcagccaagaatttcgggctgtttgactttctgtgagcccccagcgaggggaggcccagcctccgaggagaccaggaaccctgcttcagcagcccctcagggcttcccaaggatgtccagcccccacacccacacgttaacataatgagtcactaggcttctggggagggcccaacttcacccatgcatgagagactctcctcctttccagagagaatcggatcgcaccacgtgtggcagcctgcggcggggggaggggggcctctttagctctctttatctttctctctcactcatgtatgcatacatgcacagagatgcatacacaggtgcctatgcaagttcatttaagcctcagggctggtccctgcccaaagggctggaccctcctaatcctctcctaggttgtggggctggtcccctgacacccttctccccttcctggtagaccttaaacctcgcacacatgtccccagcattttctcacctggataaagcccataagctgggtctcaggctgggctcagcaaaggactcgccttgcaaccgacaggccattcccacccccacacacaacctcccctgttttcacattcaccatggcatcccagagcaaggacacaggagcccacaggccagttgaggttgggcaaggagacttccaggacttccagacagagtaccaggttttatttttcaccttattctctactttaaacaaatcataactttctctttaagcctctgctataaattctcctggctctcctgggcttccatattttgggggctggggtgtcaaaagtgagatgaagttcttagctccaggttttggggtaaaccaaggtaggaacattttggcatttatttcaattaacaatacttccttggacgggtgcggtggctcacgtctgtaatcccagcactttgggaggctgagacaggtggatcacttgaggtcgggagttcgagaccagcctggccaacatagcaaaaccctgtctctactaaaaatacaaaaattagatgggtgttttggcacctgcctgtaatctcagctactcaggaggctgaggcacaagaatcgcttgaatccaggaagcaagcggaggttgcagtgagttgagatcgcactccagcctgggtgacagagtgagattctgtctcaaaagcaaactaacaaagaaaaacaatacttcctggggttttggtgtgcagagggctttgttggaagtgtgactcaatcttgcctgccttctgggagctctagaattgttcccaacccagtccatggcttctagccaccactacagggctgtttcatgtacttctctctctgactctgtcttgtccgactctcttgagaatttctcaacgattgctcatgcctgtcagtatcagtgcttccatcgttccatctttgattcacttctctttcctttctatttactcccaaaatggagtcattcatcctgatgtcctcaattgctgctgatatgctggtgattcccaaatacatagctccaacccccaacttcccccagactttagatctgtattggtattacctactggacatctctatggacagttccgtatagactcaactcatctgcccaaccaagtatgttcctcctgaattcctctcctggttacttcatcacaatctacataggctcaccagctagaaacatttatgagcttacattccttcttcccatatcttatcagcatatcatatccatttcactccaacactctgtcttgaatttggccctccctctcccctctctactttaattcattggagcatgggatttggagttaggtggttttgggtttgaattccagctctactatttttggttgtgtgatagagttatttaacctctctgagcctcagttccctcgtatgtaaaatgatgataataatacctacctcacagggttgttgtgaggatttaaattagatattgtacgaaaagtgcctagcacagtgcctggcacacagtagagtaggtgctcaataaatggtagctattattattatta

SEQ ID NO: 63697 - DNA, 1917 bp, Homo sapiens
  misc_feature (37)..(38): n is a, c, g, or t
  misc_feature (42)..(42): n is a, c, g, or t
  misc_feature (47)..(48): n is a, c, g, or t
aaaactccgctatgctccacgcgtagggagctctccnnatangtcgnnctgcaggcgcgcgaattcactagtgattgtgagctgagatcgcaccacgtgtggcagcctgcggcggggggaggggggcctctttagctctctttatctttctctctcactcatgtatgcatacatgcacagagatgcatacacaggtgcctatgcaagttcatttaagcctcagggctggtccctgcccaaagggctggaccctcctaatcctctcctaggttgtggggctggtcccctgacacccttctccccttcctggtagaccttaaacctcgcacacatgtccccagcattttctcacctggataaagcccataagctgggtctcaggctgggctcagcaaaggactcgccttgcaaccgacaggccattcccacccccacacacaacctcccctgttttcacattcaccatggcatcccagagcaaggacacaggagcccacaggccagttgaggttgggcaaggagacttccaggacttccagacagagtaccaggttttatttttcaccttattctctactttaaacaaatcataactttctctttaagcctctgctataaattctcctggctctcctgggcttccatattttgggggctggggtgtcaaaagtgagatgaagttcttagctccaggttttggggtaaaccaaggtaggaacattttggcatttatttcaattaacaatacttccttggacgggtgcggtggctcacgtctgtaatcccagcactttgggaggctgagacaggtggatcacttgaggtcgggagttcgagaccagcctggccaacatagcaaaaccctgtctctactaaaaatacaaaaattagatgggtgttttggcacctgcctgtaatctcagctactcaggaggctgaggcacaagaatcgcttgaatccaggaagcaagcggaggttgcagtgagttgagatcgcactccagcctgggtgacagagtgagattctgtctcaaaagcaaactaacaaagaaaaacaatacttcctggggttttggtgtgcagagggctttgttggaagtgtgactcaatcttgcctgccttctgggagctctagaattgttcccaacccagtccatggcttctagccaccactacagggctgtttcatgtacttctctctctgactctgtcttgtccgactctcttgagaatttctcaacgattgctcatgcctgtcagtatcagtgcttccatcgttccatctttgattcacttctctttcctttctatttactcccaaaatggagtcattcatcctgatgtcctcaattgctgctgatatgctggtgattcccaaatacatagctccaacccccaacttcccccagactttagatctgtattggtattacctactggacatctctatggacagttccgtatagactcaactcatctgcccaaccaagtatgttcctcctgaattcctctcctggttacttcatcacaatctacataggctcaccagctagaaacatttatgagcttacattccttcttcccatatcttatcagcatatcatatccatttcactccaacactctgtcttgaatttggccctccctctcccctctctactttaattcattggagcatgggatttggagttaggtggttttgggtttgaattccagctctactatttttggttgtgtgatagagttatttaacctctctgagcctcagttccctcgtatgtaaaatgatgataataatacctacctcacagggttgttgtgaggatttaaattagatattgtacgaaaagtgcctagcacagtgcctggcacacagtagagtaggtgctcaataaatggtagctattattattatta

SEQ ID NO: 63698 - DNA, 1280 bp, Homo sapiens
agcggagagtggggagcggaagccgccgccgtctgggaggctcggcccggccgcccgagcaggccgcgcgcgggccgccgggcccgaggccagagccatgggcgagaccaagatcatctaccacttggatgggcaggagacgccgtaccttgtgaagctgcccctgcccgccgagcgcgtcaccttggcggactttaagggcgttttgcagcgacccagctataagttcttcttcaagtctatggacgacgatttcggagtggtgaaggaggagatctcggatgacaatgccaagctaccatgcttcaatggccgggtggtgtcctggctggtgtcagctgagggctcacacccagacccagcccccttctgtgctgataacccatcggagctgccaccacctatggagcgcacgggaggcatcggggactcccgacccccatccttccaccctcatgctggtgggggcagccaggagaacctggacaatgacacagagacggactctttggtgtctgcccagcgagagcggccacgccggagggatggcccagagcatgcaacccggctaaatggaactgcgaagggggaacggcggcgagaaccagggggttatgatagctcatccacccttatgagcagtgagctggagaccaccagcttctttgactcagatgaggatgactccaccagcaggttcagcagctccacagaacagagcagtgcctcacgcctgatgagaagacacaagcggcggcggcggaagcagaaggtttctcggattgagcggtcctcgtccttcagcagcatcacggactccaccatgtcactcaacatcatcacggtcactctcaacatggaaaaatataacttcttgggcatctccattgtgggccaaagcaacgagcgtggtgacggcggcatctacattggctctatcatgaagggtggggccgtggctgctgatggacgcatcgagccaggagatatgttgttacaggtaaacgagatcaactttgagaacatgagtaatgacgatgcagtccgggtactgcgggagattgtgcacaaaccggggcccatcaccctgactgtagccaagtgctgggacccaagtccacgtggttgcttcacattgcccaggagcgagcccatccggcccattgaccctgcggcctgggtctcccacactgcagccatgaccggcaccttccctgcatacggcatgagcccctccctgagcaccattgagcctgtgtctccatcttgagcctgtgtct

SEQ ID NO: 63699 - DNA, 1252 bp, Homo sapiens
  misc_feature (1209)..(1209): n is a, c, g, or t
  misc_feature (1252)..(1252): n is a, c, g, or t
agcggagagtggggagcggaagccgccgccgtctgggaggctcggcccggccgcccgagcaggccgcgcgcgggccgccgggcccgaggccagagccatgggcgagaccaagatcatctaccacttggatgggcaggagacgccgtaccttgtgaagctgcccctgcccgccgagcgcgtcaccttggcggactttaagggcgttttgcagcgacccagctataagttcttcttcaagtctatggacgacgatttcggagtggtgaaggaggagatctcggatgacaatgccaagctaccatgcttcaatggccgggtggtgtcctggctggtgtcagctgagggctcacacccagacccagcccccttctgtgctgataacccatcggagctgccaccacctatggagcgcacgggaggcatcggggactcccgacccccatccttccaccctcatgctggtgggggcagccaggagaacctggacaatgacacagagacggactctttggtgtctgcccagcgagagcggccacgccggagggatggcccagagcatgcaacccggctaaatggaactgcgaagggggaacggcggcgagaaccagggggttatgatagctcatccacccttatgagcagtgagctggagaccaccagcttctttgactcagatgaggatgactccaccagcaggttcagcagctccacagaacagagcagtgcctcacgcctgatgagaagacacaagcggcggcggcggaagcagaaggtttctcggattgagcggtcctcgtccttcagcagcatcacggactccaccatgtcactcaacatcatcacggtcactctcaacatggaaaaatataacttcttgggcatctccattgtgggccaaagcaacgagcgtggtgacggcggcatctacattggctctatcatgaagggtggggccgtggctgctgatggacgcatcgagccaggagatatgttgttacaggtaaacgagatcaactttgagaacatgagtaatgacgatgcagtccgggtactgcgggagattgtgcacaaaccggggcccatcaccctgactgtagccaagtgctgggacccaagtccacgtggttgcttcacattgcccaggaaccgaagcccatttccgggccatttgaccccttgggggcctgggggctttccacaacttggaancccttgaaccgggaaccctttcccttggattaccgggatggan

SEQ ID NO: 63700 - DNA, 1257 bp, Homo sapiens
agcggagagtggggagcggaagccgccgccgtctgggaggctcggcccggccgcccgagcaggccgcgcgcgggccgccgggcccgaggccagagccatgggcgagaccaagatcatctaccacttggatgggcaggagacgccgtaccttgtgaagctgcccctgcccgccgagcgcgtcaccttggcggactttaagggcgttttgcagcgacccagctataagttcttcttcaagtctatggacgacgatttcggagtggtgaaggaggagatctcggatgacaatgccaagctaccatgcttcaatggccgggtggtgtcctggctggtgtcagctgagggctcacacccagacccagcccccttctgtgctgataacccatcggagctgccaccacctatggagcgcacgggaggcatcggggactcccgacccccatccttccaccctcatgctggtgggggcagccaggagaacctggacaatgacacagagacggactctttggtgtctgcccagcgagagcggccacgccggagggatggcccagagcatgcaacccggctaaatggaactgcgaagggggaacggcggcgagaaccagggggttatgatagctcatccacccttatgagcagtgagctggagaccaccagcttctttgactcagatgaggatgactccaccagcaggttcagcagctccacagaacagagcagtgcctcacgcctgatgagaagacacaagcggcggcggcggaagcagaaggtttctcggattgagcggtcctcgtccttcagcagcatcacggactccaccatgtcactcaacatcatcacggtcactctcaacatggaaaaatataacttcttgggcatctccattgtgggccaaagcaacgagcgtggtgacggcggcatctacattggctctatcatgaagggtggggccgtggctgctgatggacgcatcgagccaggagatatgttgttacaggtaaacgagatcaactttgagaacatgagtaatgacgatgcagtccgggtactgcgggagattgtgcacaaaccggggtatggatggaatggggcactgggcaaggggcttggtctggcctatacgcatcctgccttcactaggacacccttgttttcaggcccatcaccctgactgtagccaagtgctgggacccaagtccacgtggttgcttcacattgcccaggagtaagtggatgggagactcagtcctaaag

SEQ ID NO: 63701 - DNA, 480 bp, Homo sapiens
aaaaaggattctatattctcaagcttgcggggaaatttggcacagcctagcacctaacagttattttttctgctcctccaaacgtccgccatcaaggaggcaccagcgtctcttattcccttctttgtgttcttgagttctcatcatttagctctcacttagaagtgagaacctgtggtatttggttttctgttcctgcgttagtttgctagggatgatagcctccacttccatccgcgttcctgcaaaacacatgatctcattctctctctctttttttttttttttttttttccctgagacagagattcgctcttgttacccaggctggagtgcaatggtgcgatcttggctcaccacaacctctccctcttgggttcaagtgattctcctgcctcagcctccgacatgtgtcaccacgcccggctaatttttgtattttcagtagagatggggtttctccatgttggtcagactggt

SEQ ID NO: 63702 - DNA, 190 bp, Homo sapiens
cgtagaatatcacaccaaaaaatgttaatacctgtactctaccactgtatatgtaactattgacatgtattctttcagtttccttcctatacatttatataataagagaattgggattatagttcacacattcataacttgattcacttaatgtgtcttgagtatttactattaaatattgatgtacatc

SEQ ID NO: 63703 - DNA, 324 bp, Homo sapiens
tggctctcttattcattcaccactgtgctgtgtaacacaatttccctgcaacaataaacttcaactttgcaatttgtcaccagtgcaatggctcatgtagttataaagtgaacgtggtgaccaatttggggcgtaatattgttctgcagtcaaagtatcctaatttgaagaaattttatgtatcgtgattttacaccaactggccaaagtcagatagtctgattaaatagatttggttttggctaactatatgtagttaattctacacactttaaatattttggtttgcaggtattttttgaaggcttaagtatttggtttctg

SEQ ID NO: 63704 - DNA, 335 bp, Homo sapiens
aacactgtaatgggagcaccagctaatgcaatgagcaaaggaaataaaaggtatgcacatagattaggaagaaagaaagaaaactttctttgttcattgataacatgatcaactatgcagctatcagaaagaatgaacagaaaaactcctgcaaccaatatgtgattatagcaaggtggccaggatatgcaaggttaacatacaaaactcattcacacccaggcacagtggcttatgccagtaaaccccagcactttgggatgtgagatcactgcagcccaggagttcaagacaagcctggccaacatgccaggaccttgtctctacaacaaatt

SEQ ID NO: 63705 - DNA, 790 bp, Homo sapiens
catttaactgactaaagttaagtcatctattgtattgacaaggagagatagcccaagattaaataaaaaccagattagacagcagaagttacagtgtagccttttgatgataccctaaaagtagagaaatgcacacaagttttgtggaagatgggaataacatactggattttctataattctatattattaactttaaaaaaaataaatctgctactttttgaaaattaaaaaacaaaccaaaaaaagcctccaatttttaatggtgatttccagcagtgatgaaagcgctggttaaagggagactcaaacaccacggatgggaaatgtcgcaccatttcgggaggtcatcttggcgaaaccgaatcaaaagtcttgaagcacatatatcaatttcacatccaggaatttataataaggaaataatcaaggatataaacaaaagtaagaatgttttccacagctttttatatcatgggagcaaaaaaaaaaattgcgaagcaacgtaaccatccagtgagagcaaggcagttggttaaataagctctgaacctgtcagaagatgcctcacagacagttgttaacttcattttggaaaagtactcagtgacataggaaaagtctactatgtatcctaaagagacaaaagcaggttacaaaattatgcacaattatggtcttaattttgttaaatatacatggtccaatcacagaaaataaaatagaaatcaagatcttggagtttaataatgcatggtgaattatagggggtttccttctgtatgttctt

SEQ ID NO: 63706 - DNA, 385 bp, Homo sapiens
tctaattgtggtctctggtgctcgtaatactttaattcaaaagaaatgttttgatggcctacactggagtgtgttaagccaccagattccggtgctttcgtgggggtgatatcagggcaaggctcatttaaacacttcagtatttgtctccaaagcatgaggataattgcccaggcatccaagatgacaagtttgcatttaaaaaagtaacagggattctgtaacagtatctgttactacagtgcctatcaggacttagccaccctcccaataacaacaggtcaggattcagttggttggtaacgtatctgtaattactttttgctttagaacagacccccttttcaccctcaatattgacttttttggagagtgctagagcatt

SEQ ID NO: 63707 - DNA, 7705 bp, Homo sapiens
cgcctcgcggcctctcccagcttctcctgggccggcgccatgaggcctgggcccgctctcctccttctgggcgtgggcctgagcctgagcgtcggccgcctcccgctgccgccggttcctcgcggggcacaagccgccgtctccggggcgcccggtggcctcctcaggggcgccccgggcctcggggtgcgcggcggccgcgccctcctcagtctgcggcccagcgcggtgcgggcgggcggcgctgtcctgagcggccgcggcagcctctgcttcccccatggcgggaccgggcggcgctggtactgcctcgacttgcgcgtcctgctcagcgcccaacgcctgccctggccggccgcgcccgcgctcgcgctcgtcgacctgcagctctccgcgcgcggcggccgcctctccctgacgtggtccgtgcggctgccgcgctcgcccgggcgcctggcctgggccttccgcctgcggctgctcggacccggcgccgcccgcccggcctcccccgcggcccgcgtctccccgcgctccgccgcgccaggcccgcggccccagcagggcttcgtggcccgcaccgagtgccccacagacggccccgcgcgcgtgatgttgcaggccgtcaactcgtccagccacagagccgtcgagtcgtccgtgtcctgtcagataaacgcctgcgtcatccagcgcgtgaggatcaacacggaccagaagggcgcccccgtgcgcctgagcatgcaggcggaggccaccatcaacgcctcggtgcagctggactgcccggccgcgcgcgccatcgcccagtactggcaggtgttctccgtgcccgccgtgggtcaggcgcccgactggacgcagcccttggatctgccccagctcgagatcaggaacagccccttgttcattcacatccccaataattcgttacagtggggagtgtatgtgtttaatttcacggtgtccatcaccacagggaaccccaagatgcccgaggtgaaagactcggacgccgtctatgtctggatcgtcaggagttccctgcaggcggtgatgcttggcgatgccaacataacagctaatttcacagagcagctgattctggacgggtccacgtcctcggacccagatgcggacagcccgttacagggactccagttcttttggtactgtaccacagatcccagaaactacggtggggatcgaataatcctggggagcaaggaagtctgtcaccccgagcaggccaatctgaaatggccctgggcctcgggccctgtactgacacttttgccagaaacacttaaaggcgaccacgtgtatttcttcagaatggtgattcggaaggactctaggacagcgttttctgataagagggtccacgtgctccaaggaccaaaagccatagcacacatcacatgtatcgaaaattgtgagagaaacttcattgtctctgatagattttctttgttcctaaattgcacaaattgtgcaagccgtgatttctataaatggtcaattttgtcttcttcaggtggtgagatgctatttgattggatgggggaaactgtaacaggaaggaatggtgcttatctgtctataaaagcttttgcttttcggcattttttggaagctgagttttcgatttctctgtatctagcatgttggagtggagtgacctcggtcttcaggcattcttttattattaaccatggccctcagatcggagaatgcaaaattaatccagctaaaggaattgcacttattactaaatttgttgtccagtgtagtaattttagggataagcacgtccctcttacatataaaataattgtttctgatttgcacagtgttggtgaaatcagttcagtaaaagagaacaccctggggaccatcctgtacttggggcctcagtccacagtacccccttcctttctccctgttggtatgttggctagtcaatatggcttgaagatatatgcccaggtctatgattctctaggagctttttctcaggtgactttgcatgccaccgcacaggctcccactgacaaaaattcatcaaagacagtgttgaatcagttactcagtttcaccgtgggaccaagttcattgctgtctactttgattcaaaagaaggattttttacctgcaggttacttactgtatatagtagcttccgttttgaataacatgaaaactgaattacctctccgagatgacagagtcaatctccgaaaacacctcatcgatcagtctttccttcttcctgtaagcactttggtagaaattggccaggtagtcatgactattaccaaattaacccagaaaccctctgaattcacttgggatgctcagaaacgtgccaccatgagggtatggcaagcaaatcaagccctacaagagtatcagcaaaaagataaacgctttcgatctgaacaaatagaaatcgtgagtactggaatactaatgagtttgtctaatattcttaaaatgacttctcctcaccaagtagttaaagatcctttctatgtaatagaatctctatcagacacaatactggctaataaagtgccagggaacaaaaccacctcaatgagaacccccaatttcaacatgtatgtcaagaaagttgaaaagtggggtatcaaccagctcttcagaaatgagaaacactgcagaaattgtttttatccaacactcaatgtgagcagtgttcctggtctgtctgcaaatggtcccatttctacaatgttttgtgatttcacaaatgacctctttccttggttaaatgatcaggaaaacacttcggtggaggtgtctggattcagaatgacaggagttgcagataacggtagtgtgctagagatcacacctgatgtagcggaagtgtaccttgtcaggaaaaacttgacctttgcagcttttaatctcacagtgggacccaacagcgaggttgatgggtccttgaagaagacgacaggtgggtttagctttcaagtggacagcacagtgcttagggaggttctggtccacatagtaacagaagtgatggtgctgttcacagtgttggtgtacacaggcagtcagatcactcccacagcgctggtcgccaccttcctggtgcctcatgacatccctccatttgccagccagagtgccctgtttgacccagcctgcacagtgaagaaggcccgtgtagtctgcctccctgtgtccctgctgcaactcatagctcagcacagccactctccccactgtactgtatccatagttctgcaggcacctcgttttgtcatgaagctcaatgacaagctagtgagaatttctattttcagcgtccagtgcttggacatgtatgggatccagagtgaatggagagagggttattgcattcttggtgagaagaccagctggtatgaggtgcactgcatctgcaagaatgtagtaagggctaggcggcagctgggcacaatcggactcacgggcattcacctgcatacccactatgtgatggccaaggtgattgtgatccctaatcctgtggatctacggttaaacatcatcaagagccttcaccaaaaccccgtgaccctcttcactgtgcttttcattattctcttatacgtgggcctagctttttgggctttatacagggatgaaatggaccagcatcttcgggggcatgtgatagttctaccagataatgatccttatgataatttatgctacttggtgactatttttacaggaagtcgttgggggtctgggaccagggccaatgtctttgtgcaacttagaggaactgtgagtaccagcgacgtgcattgtttaagccatccacatttcacaactctctaccgaggtagcatcaacactttcctcctaacgacaaaaagtgacttgggggacatccattccatccgtgtgtggcacaacaacgagggtcgatcgcctagctggtatttaagtagaatcaaagtggaaaatctgtttagcaggcacatttggctgttcatatgccagaaatggctttctgttgataccactttggacagaacatttcacgttacccatccagatgagcgtctgactagaaaagactttttctttatagatgtgagtagtaatctccggaaaaaccacatgtggttctctatttttgctagtgttgttgctaaaacattcaataggctccagagattgtcctgttgtttagcaatgttgcttagctctcttctttgtaacattatgttctttaatctaaatagacaagaacaaactgagtcaagagagaggaaatacatgagatcaatgatgataggaattgaaagtgtcttaattacaatccctgtgcaattattaataacttttttgttcacctgttcccagaggaaacctcaagcggatctaaaggaggtatctcctcaaaagcatcctctaatgtcagaagcaagtgagcactgggaagaatacttgagaaagtggcatgcttacgaaactgctaaggtgcaccccagggaggttgcaaaacctgcatctaaaggaaagcccaggcttccaaaggcttctcctaaggcaacctccaaacccaagcacaggcataggaaagcacaaatcaagaccccggagaccctcgggccaaatacaaattccaataacaacatagaagatgatcaggatgtccattccgaacagcacccttcccaaaaggatctccagcagcttaagaaaaagccccggatcgtcctaccttggtggtgtgtttatgttgcatggtttttggtttttgctacttctagcatatcctcattcttcattgtattttatggactgacttacggctatgacaagtcaatagaatggctctttgcatctttttgttcattctgtcagtcagttcttctggtgcagccatctaaaattatactcctgtcaggcttcagaacgaataaacccaagtattgcaaaaacctttcatggtcaaccaagtataaatatactgagatcaggttggatggaatgcgtatgcatccagaagaaatgcagaggatacatgaccagatcgtccgaatccgaggcacgaggatgtaccaaccccttacagaagatgaaatcagaatattcaaaagaaagaagaggatcaagagaagagcactcctgtttctgagttacattctaactcactttatctttctagcccttctgttgatccttatcgtcttactacgtcacactgactgcttttactataaccagtttattcgtgatcggttctctatggatcttgctactgtgactaagctggaagacatctatagatggctaaacagcgtgctgttgcctttgttacacaatgacctgaatccaacatttcttcctgaaagctcgtctaaaatccttggccttccattgatgaggcaagtgagagcaaaatctagtgaaaaaatgtgtctacctgccgaaaagtttgtgcaaaacagcatcagaagagaaattcattgtcaccccaaatatggcattgacccagaagacacaaaaaactattctggcttttggaatgaagttgataagcaggctatagatgagagtaccaatggatttacttataagcctcaaggaacgcaatggctatattattcctatggactactacacacctatggatctggaggatatgcactctatttttttccagaacagcagcggtttaattccacactgaggctcaaagaacttcaagaaagcaattggctggatgagaagacatgggctgtggttttggaattaacaacttttaatccagatataaatctgttctgtagcatttcggtcatatttgaagtctctcagttaggagttgtcaacacaagcatatctctgcactctttttcacttgctgattttgacagaaaagcttcagcagaaatctacttgtatgtggccattctcatttttttcttagcctacgttgttgatgagggttgtatcattatgcaagaaagagcctcctatgtgagaagtgtgtataatttgctcaactttgctttaaagtgcatatttactgtgttgattgtgctctttctcaggaaacatttcctggccactggcataattcggttttacttgtcgaacccagaagacttcattccctttcatgcagtttctcaggtagatcacattatgaggataattttgggtttcctgttatttctgacaattttgaagaccctcaggtattccagattcttctacgatgtgcgcctggctcagagggccatccaggctgccctccctggcatctgccacatggcatttgttgtgtccgtgtatttcttcgtatacatggcttttggttacctggtgtttggtcagcatgaatggaactacagtaacttgattcattccactcagacagtattttcctattgtgtctcagctttccagaacactgaattttccaataacaggattctgggggtcctgttcctctcatctttcatgctggtgatgatctgcgtcttgatcaacttatttcaggctgtaattctgtctgcatatgaggaaatgaagcagcccgtgtatgaggagccatcggatgaagtggaagcaatgacctatttgtgccgtaagctgagaaccatgttcagctttctgacctcgcaatctaaggccaaagatgagcctgagttctttattgacatgctgtatgggcagccagagaagaacagccaccgttatctggggctgaagaccagaaacatcaacgggaagaaaatggtttaccttgttgtttgatgaatgatggtttcatgagtcacaagcaagcgttcccccaactgctgagtctgtgggattaaggggattagggagtgtcagtggcctagtcatgctttctactcatgtccttcacaaggcacatcccctacatttggaagaatccccaatcttgtcctctgctcttgggagtgtaaaagttgggagtgtagtgtagcatctggggagacagcaggatcacagtgtgggattcctggactgatttccctttagaggggagttatgtgactccccgtacaagggcaaccctgtttctttggtgcctgcagtttagagaaggcagagccactggttttgagaaccagatttgagagagggacctggccagggtggagcattgtctgggtgtttctgcgcttgacccatgctggaagctaatggcctgttgctcctgacagagccccaaactcctcggcctcactgggaggcccctttgtagaccagggctcccctcctcttgttccccctgggcttagggcctcgtggggagttccaggacttgcttcatgcttgagaatgcagatgtggtgcttctcatttattcttaaagctactggtagttaaagtaaaattcagtaacattttctgaccaagagacatgttttgttaaacaacaaaaaggtacatatgggttcacattgaaatatgtctatatgctgaatatagcaacatatgcatctaagatttgggcatttggttattaatagcgtgctggactattcaggaataaggaaaatgtggtttatcacttaagagaaacaagggctggtagctgtactattttcactcagaagcatgttcatttatgtagatgccactttaagctttatcagaattaaatgtgagatttcttctttgagccttg

SEQ ID NO: 63708 - DNA, 444 bp, Homo sapiens
gatactgggttggttttaagctgttccaggtgagggccagatgttccttacatgaatggaacttctcttcttgctccacccatgggccctgagcctatccactccctcccctgacaactgatttcagtgtgtggaaggcaggggtgcagtcaacactgaaagaaatcaccttctaggaattcagtgattaaggcctaaagaactcaagagaagatgtggttggatgatatattgttgtaaacatacatataaaactctgatcggcgaaattttattcacatttttctgcatactctaagcaaaacttgccattggtgtcatcactaaagaagcacaggaacaaactttgagttatgaagccagtatttgtacgtagagtgaagaattgtgcagcatcatgagtaatgatgtaaccagcattaaataaatggcattatcaacaca

SEQ ID NO: 63709 - DNA, 578 bp, Homo sapiens
ggctcgctctagagtatccccacctcctaccccacgtatggaagatgaggatttagttgttatatacacccttctcccaatgtatatacttctgtctcctatcctcttaatttaacttttttttaccctttttggtcaaactaatatgtatgtaatctttactaaattttggtaaatattgaatgcagatgtggctgacattgttggtttcctgctcaatagctattccctcttcttgcttgctgccagattccctcattttttaaatggcaaggtgctaaaccccaggatatagactgtggcagctcttaagtcagtcatagtttccccagtgtttggtctggtgggcatctgaaccagttctggacaaatgagatgtaaaggaagtctgctgatggcttctgagattttcccctccaacggagaaagtcccaggaggaaagccctgtttgactccatgttctcctttcctgcttggaactctattttatgagggtgtgggtccatctcagcctttttggagggcttgtgggcaagttacttaatgtttcgttctccaggctgtctatttgcgtgag

SEQ ID NO: 63710 - DNA, 599 bp, Homo sapiens
gtgtgagcccctatgcccagcctatttcttagtttgggatattaattcattttctgctatggaagatgaggatttagttgttatatacacccttctcccaatgtatatacttctgtctcctatcctcttaatttaacttttttttaccctttttggtcaaactaatatgtatgtaatctttactaaattttggtaaatattgaatgcagatgtggctgacattgttggtttcctgctcaatagctattccctcttcttgcttgctgccagattccctcattttttaaatggcaaggtgctaaaccccaggatatagactgtggcagctcttaagtcagtcatagtttccccagtgtttggtctggtgggcatctgaaccagttctggacaaatgagatgtaaaggaagtctgctgatggcttctgagattttcccctccaacggagaaagtcccaggaggaaagccctgtttgactccatgttctcctttcctgcttggaactctattttatgagggtgtgggtccatctcagcctttttggagggcttgtgggcaagttacttaatgtttcgttctccaggctgtctatttgcgtgag

SEQ ID NO: 63711 - DNA, 307 bp, Homo sapiens
gtgtgagcccctatgcccagcctatttcttagtttgggatattaattcattttctgctatggaagatgaggatttagttgttatatacacccttctcccaatgtatatacttctgtctcctatcctcttaatttaacttttttttaccctttttggtcaaactaatatgtatgtaatctttactaaattttgggaattagttgcggcccttccgtgttttggcactgcatgattctgggggtcgatttccttacgtttgttttccgctagctgattaatttttcccagttctctttcctttttgtga

SEQ ID NO: 63712 - DNA, 500 bp, Homo sapiens
gtggcttcattcttgaagtcagtgagaccaagaacccaccaatttcggacacactaggctctgacaagcaactctgcaaagcagaagtgatgcttgaaaccacagcagccattttggggccacgaggcaataagcacaaggataaaaagccaagaaccaaagatggagaatcaagggtgtaatgaacctagatgatatgatatgacagagtcctgaactgctagacttcttactaggagtcccagtgtctcctgaggaaatccctttcccattcagccggcagctgcagcaggtgggatgggccagaccagccctctggggatgctgatcccagggagcatccaggccggaaggtccaaacgggttctatgtcgatgtggctcagagccagtagtgtagggtacaggagaaaccttcatcacctcatcttctcagggccctactgcaagccagcatctccccttcttcctctctgcttcaagatccatggaggtatattc

SEQ ID NO: 63713 - DNA, 508 bp, Homo sapiens
tttgtcattttatttcaagcactgaagaagtatgacagaaagaatattatggggaaaatatttagaccaatcctggctataaaatttcctttagttttatgcctggcctttgcaaagctcagtgaaatgttgaaaggaataaattaatcatgtttctgtgacttttgattgacacttgttccttttcccccctaagtggtagaagaagttatttgttatttttctaaaaggcacaattttgaagccttaactacttcattaagtcaactgttgcctataacatctcttagcactcgtcaaaacgtatttaaatcaattttccaatggatgagaacatgtcttctgtggataaattatattatgtcatttaacaacattgagcattttgatatgtgttcactgaattaaaaaacctgaatttcattattgttgacttttcccctctttagttactagtaatcacatcctttctaggattaaaaatatttcatagtatttttgtgtagat

SEQ ID NO: 63714 - DNA, 471 bp, Homo sapiens
gcaccagtctgagtgtggaagagacggcgctggaacccatggacacggcgtatccccgcgaggacacccgggcccccacgcccagcaaggccggtgcccacacagccctcacactgggggccccgcaccccccgcctcgagaccacttgatctggtcggtgttcagcaccctctacctgaatctgtgttgcctcggcttcctggcgctggcctactccatcaaggcccgagatcagaaggtggttggtgacctggaagcggcccggcgttttggctccaaagccaagtgctacaacatcctggccgcgatgtggacgctggtgccgccactgctgctcctggggctggtggtgactggtgccctgcacctggcccggctggccaaggactctgccgccttcttcagcaccaagtttgatgacgcggactatgactgacaggctgggtcctgatctggggcactagccccag

SEQ ID NO: 63715 - DNA, 328 bp, Homo sapiens
gtttcactctgtcacccaggctggcctcagcctcctgaatagctgagactataggcgcgcaccaccacaccaggctaattttttctatttttgtagagacagagttttgctatgttgcttaagctgctcttgaactcctgagcacaagcaatcaccttcgccggcttcccaaagtgctaggattacagacgtgagccaccgcacctggcctggtgctaacatttttttccttgtcatcaaaacacatttatcatttggtccaggtgactgaacatatagctaagttaagaagtttcatttaatccaaaaatacatttgtaaaacttgt

SEQ ID NO: 63716 - DNA, 538 bp, Homo sapiens
agaaactcagtgccaagggcaaacagctgtttggtgcagtggggaggggctggaatagttcagttctctgatctctcttccccaggcccaacttcatcctccttccacagtccacggcctcccgggtctcatctcagggtccagtcagggtcttctcttgcaccagggccatccctcttttcttcttctctcgccccagtcaccttgagtctaagcctccctttaaatctccccaaaggaaccttccctttctcttggcacctggtgattgactctcagggtaaagtaagcagtgctgatgtgtatgaagggcactctgcagaaataaattgtgcagaggatgaatgagagcttggagtagaaatgctggccctggcaaaagacataagaactctggaggctgtgcccactgctctgtgagtgatggacccatccagtctgagttactaccacatgccagattatcattttgaatagttccacgtggctgcaggaggcacaggcaggagttcaccagagccactttcataatcaccca

SEQ ID NO: 63717 - DNA, 490 bp, Homo sapiens
gaaatgaaactgaattatgtttaataaaatacagtgagatgagaatgtaaaaaacacacatctttctcataggatattaaagaaacacaattttatttaaaacaataacgatacaacacacatgtattaattaacttaattattgcaacagtcccatgagttagaggctgttaacatactcattttatagatgagaaaacagaggcatggagaagttaagtaaattgcctaaggttccacagccaggattataaactttgcggtctgaatgtaaagcctgaggtagtaaccgctactctagccttcaagtgcaacttactccctaagaaagtggaatgaggcgtggtagcgggcgcctgtagtcccagctactccagaggctgaggccggagaatggcgtgaacccgggaggcggagcttgcagtgagccgagatcgcgccactgcactccagtctgggcgacagagtgagactccgtctcaaaaaaaaa

SEQ ID NO: 63718 - DNA, 491 bp, Homo sapiens
gtttttcaaagggggaaaaacaggaaaattttaccttataattttcctcaaagacttatagtttcaaaggaatttatactagaaaataacatggctatacatttttatatgtattgtattttcattagcaaggtttataaccagaacagatttttattattaaaaatatttaatttctgagcttgttgagcagagtgtagatagtatactatctacagatagttctataggtagatagttttagtcattctagtgttgaaattcgaaaacagatgtcttctgtctaatactttcactactattttatgacttccctaagattttgtgcttgttttatatttcttagttattcatttgggttaaaattttatttttcaagtattttgaaatcattgtttacatgcaaatatgtatttttcataagaaaagttagctgtctgtatcgcataccaaaactatatagcataaaacttgaaccacatttttccaaa

SEQ ID NO: 63719 - DNA, 476 bp, Homo sapiens
gacagacatggtgcattctgtggtcactttccaagagcccgtggtgggttgtcctgtttctgttggtgggaaacaagttaaacacaatttgctatttgcctttcacccctcagttcatcatgagatcattagtcggctgagtgactgctgtcccccaggggctgggagagagggggtcttgagggagttactggtgatactgcatgcctgtgggttgggggatcatatcctatttttatcagatggaatatgctggaccagaaaaaagaaccactgggaactgtgttcttccaactttggtttcagatccctctagttaatgccatccatgaaaacaattaacttctctatatttcaggatccaggcaggaccttgtaggaatcttatttaattatgtgctatattaatgttatattgattatgttattgcctgtaaatccagttgcttaataaagctgcagtcattttgcaataa

SEQ ID NO: 63720 - DNA, 529 bp, Homo sapiens
ctagacatgtatgtttagtgttcctgagatagcatgttactattaacctgtctgattatacgatttgtatgtaaaaactaattcattttagagaataactgaagcttagcttttgaaatacattatactgtgttcaggtcatgataaacgtcctctggagcatggctaccccacctaacatacgtagcatagtctcctgaaaagctcaacatgacttactgggtggctatagaccaaggcaaagaatatcttatacttttctaaattatatatattattgattataccataccttttggaatttaagaaaactgctaactagtattataaaggagttgctaattacaatattaatatcattatgttcacccaggaattttcctaagctctaaagtcaattctagtaaatcccaggaagtaaaaaatcccatatttgattggggctctttgttgctgtattgcctgactctgcctcagagttttgtcaacacagttgtccaggaagtcatggacactaaagttgaattta

SEQ ID NO: 63721 - DNA, 446 bp, Homo sapiens
ggactcggcctatccgtcagcacgcaggctccaccctcgctgaactcacagaggacaatttaggcaggaaccgcacactgctatgacatatccaccccaccgtgctttctcgaggagtgatgtcccataccccctgctgagcagccctgtacagtggccactttccctggtagtaggtgacacatctacaaggtggccccagcagccttcagccctagagtctgactgccctggtccaagccatccctgccttgctggcctcctggggcccatgcaccctgttgacattcccctctccactgccctccactcaaagcaccaaagaagacttactcaatgtgtccttatggtgcagagtcccagcaagcagaggtctttgtatctgttgaataaaaaaattcctcatgatgcgtagtaacatcagtgaggaagactgcaccaaggcg

SEQ ID NO: 63722 - DNA, 493 bp, Homo sapiens
caggcaccatccagcccacaacccctccgcacccctaatcagtgtgacatgatgagacacaatcacagcttcaaatcacatccttgctgaactcacagaggacaatttaggcaggaaccgcacactgctatgacatatccaccccaccgtgctttctcgaggagtgatgtcccataccccctgctgagcagccctgtacagtggccactttccctggtagtaggtgacacatctacaaggtggccccagcagccttcagccctagagtctgactgccctggtccaagccatccctgccttgctggcctcctggggcccatgcaccctgttgacattcccctctccactgccctccactcaaagcaccaaagaagacttactcaatgtgtccttatggtgcagagtcccagcaagcagaggtctttgtatctgttgaataaaaaaattcctcatgatgcgtagtaacatcagtgaggaagactgcaccaaggcg

SEQ ID NO: 63723 - DNA, 269 bp, Homo sapiens
ctctttgaaacccatagcccctctccttacaaatggttaaggatatggatggagaaagcagataccttttctatagcctaaccggatattaataagtcatctacgtactggagcagacatatacattttggggtataaacttgttctaacacttgttctagaatttgaccaaagagattaggggaatctgtgaagcccgggggtagagctgtctatcgatactgttgctgtcatccagaatggggatcttcccattcgaaagcaaaaat

SEQ ID NO: 63724 - DNA, 271 bp, Homo sapiens
gaattttgaaattctaagcttcccatcaagaaggttgggaggtagagggttcattcctatgtctgaaaagtcctggaactctgaagccaatgtaataaattgaatgcacttctaggttgataacaccccgggtcttgtcaaaaagaaacacaaatccttctggaacttagggcattcttatcatcatccatttagtagtaaaacaaaattatgatcagccaaatatgaggaattagaatttgtcaaaaatgagaaaaggatgtgagaaagt

SEQ ID NO: 63725 - DNA, 340 bp, Homo sapiens
tggccggggggtgcagtgctatagcagaaaggatgtagatttggagtcagactaagtttgcatcctgacttcatcctttcataacttaggcaggttgtttaatacctttaagcctcagtttcctgatttgtcaaatgtagacagtatctgctgtgccgtgtcattgtaaggactggatctttgttatgagacagcatgttgaagcctatcccccagtcacagtgatagaagttcttagttaaagacgagaatctgtttactggcctcgagacattgcactgcacctgggaagggcaggtagtccgtgtgctggtccttccagctttccagggcggaagtg

SEQ ID NO: 63726 - DNA, 1446 bp, Homo sapiens
  misc_feature (248)..(248): n is a, c, g, or t
  misc_feature (906)..(906): n is a, c, g, or t
  misc_feature (1215)..(1215): n is a, c, g, or t
  misc_feature (1223)..(1223): n is a, c, g, or t
  misc_feature (1242)..(1242): n is a, c, g, or t
  misc_feature (1325)..(1325): n is a, c, g, or t
  misc_feature (1424)..(1424): n is a, c, g, or t
  misc_feature (1426)..(1426): n is a, c, g, or t
  misc_feature (1436)..(1436): n is a, c, g, or t
atccagcaccacctgcagaagctggagggccgccgcctggactttgactaaaagaagcggcagggcaagatccccgatgaggagctgcgtcaggcgctggagaagtttgaggactccaaggaggtagcagaaaccagcatgcacaacctcctggagaccaacattgagcaggtgagtcaactccgggccctggcggaggcgcagctgaactaccactggcaggccatgcagatcctggacgagctggnagagaagctcaagcgcaggatgcgggaagcttcctcacgccccaagcgggagtataagcccaagttctgggagccctttgacctcggagagcctgagcagtccaatgggggcttcccctgcaccacagtccccaagattgcagcttcatcccctttccgatcttccgacaagtccatctggactcctagcaggagcatgccgcccctagaccagccaagctgcaaggtgctgtatgacttccagcctgagaaccatggggagctgggcttccatgagggtgacgtcttcacgctgatcaaccagatcaacgagaactggtaccagggcatgctggacagccagttgggcttcttcctgctcagctacatggacgtgctcatgcctctgcccagtgactcactggtgcccccgccccgcccctccatccacactgggtggcacccccgccaggtctcctgccttccatgggctcctgctgccaaggcggtgtccaagcctgccggcgccacccaggcccgggcccttgaggtactccctcagcagggagccacacttgggtgggaggcttatctgggtgggtggggacgcttgtttaaactagcgctgacccaacggtgacggctcccttcctcactccatggcgccggcctcctcccngctccccaactcctcacccagctggcccagacggggcaacactaaggtgctctcagaaacactaatgttcctccagggcagcccccacctccgtcctgacccatgggggcccagcccacagcctaccctcgagttccacggccttaacaggcttggatcgagtgtccctgtggggtggctcagagacaggaccctggttttaaatccctcccagcctgctcctggcgatgaaccctagccccactccagggccacagtaccccagcctcacacatgcactccttctccccaaggccagggcagagggcntcactgtntccctggcctgctgtcagnttgcaaccaggagacagaggccagctgggatgccccaccttcccccccatactgctcccctcaaccaggacagagaacatggnctcctctagggccctgcctcccaagccttaccctcacacaccaagtaccttttcagctttttaactgcccccagccaggcccacggaagcctgtgtcantntggcacaagntgccaccacc

SEQ ID NO: 63727 - DNA, 445 bp, Homo sapiens
ttctgtttgtccagaatgcccagcatttcctcatgcccctaacctagctagttcgtactcatccttcaagtccccattgggagtcagccttctgacttccctctgagactgggttaggtctcccgataaacactcagagccctgccactttccttcacagcaaataccacaattatgactgcacagttattttcatgcttattttcaatgggaaaatgaattaaagcagtatcctaacaaggtcacaactggaaggccaggcgtggtggctcatgcctataatcctggcactttgggaggccaaggcaggcagagcacttgaggtcatgagttcgagaccagcctagccaacatggtgaaaccctgtctctactaaaaatacaaaaaattagccgggtgtgatggtgcatgcctgtagtcccagcaggctgtgggagaatcactt

SEQ ID NO: 63728 - DNA, 465 bp, Homo sapiens
cgcgtcaaggtctccagcctgccctacagtgtggatgcgctcgtgtcggacaagaagccgcccaaggaggcatccccagtgccggccaaaagcgcctcttccggggccaccctgcggctactgctgctgccggggcacggcgctcgggaagcgcacagccccgggccgctgatcaagcccttcgagaccgcctcggtcaagtgggaaaactccctaagacggagcggcgtggatgcaggaaccctgctgataattcgccgccgccaagacacgtgagccctaccacctgcaccctgagaaaacacaagaccaatccgaagccgcgcacagcctttaccacgtcccagctcctcgctctggagggcaagttgctccagaaacagtacctctccattgcagagggtgcggacttctccagctctccgaacctcacggagactcaggtcaaaatcttgttccagaacc

SEQ ID NO: 63729 - DNA, 730 bp, Homo sapiens
tcagggaagaaggaacgcaagacggtggaagcatgccaacctattaaaccgcaagtcagagatcaaaccatgtacttgaatctctcaagttcccggcttaaccctcttccaagtatcctcatttgaaaatggaaaaagaaaagaaatggaggcattgtgtgatatttgcctaaatataactaaagagatccatttatttttagtgtttgattaaaaaccctcaaaggaaaagagaaattttgatctttgagaagagctgtttcatcacagggtgaagttgtttcctgagccctttgatctgaaatgaccttgcgacctggaaccagcagacagcctgagggaggcagtgcatgttctgagccagggcctcaggaggcctgcagctgccattctgcttctgttggaacatgacctccttgagaacactcccaggcctgactgcagggtggggagaccacacagagcagagccgagccaccgggatgaggcccctagatcacccagctcccagctgaccacagatcatgagtgatcccgtttctccctaggtcaagggtgatgttttgctcagagaaaactgaagtttggattgttccagtcctgcatcacatcctgtttcaggctgccctaaaacaaaaccagaaacaaccatcaccacaaaacaccataccttcaatagtcttctcagtgttcagaataaaggctctggttttcccttgggctcaatttt

SEQ ID NO: 63730 - DNA, 406 bp, Homo sapiens
gttgaacatgagaacataatcattcatattttatccatttgcatgtattcaataccatcctttcgctgttcttgtctctgcagcctttttctttaaagaatgaatgtttccatgttttatatccacagaatttctggtttttcctgttggagcccaaggagcaagggcagaatgaggaacatgatgtttcttaccgacagttactcatgacgtctccatccaggactgaggggggcatccttctccatctaggactgggggcatccttctccatccagtattgggggtcatcctcctccatccaggacctgaggggtgtccttttctgcgcttccttggatggcagtctttcccttcatgtttatagtgatttaccattaaatcactgtgccgttttttcctaaaa

SEQ ID NO: 63731 - DNA, 1256 bp, Homo sapiens
tacacaatggtgaagacacattggtgaagtacaaaaatataaattggatctagaagaaagggcaatgcaggcaatagaaaaattagtagaaatccctttaaaggttagtttgtaaaatcaggtaagtttatttataatttgctttcatttatttcactgcaaattatatttggatatgtatatatattgtgcttcctctgcctgtcttacagcaatttgccttgcagagttctaggaaaaaggtggcatgtgtttttactttcaaaatatttaaatttccatcattataacaaaatcaatttttcagagtaatgattctcactgtggagtcatttgattattaagacccgttggcataagattacatcctctgactataaaaatcctggaagaaaacctaggaaatattcgtctggacattgcacttggcaatgaatttatgggcgctttggaatcctgcagatataataatgataattaaacaaaacactcagagaaactgccaaccctaggatgaagtatattgttactgtgctttgggattaaaataagtaactacagtttatagaacttttatactgatacacagacactaaaaagggaaagggtttagatgagaagctctgctgtgcaatcaagaatctcagccactcatttctgtaggggctgcaggagctccctgtaaagagaggttatggagtctgtagcttcaggtaaccactgatccacttccagtcactatccatgagtttttatttccaaatacatgaaatcatatgaaagtggatgaccgggccaccctccaccactgccctgtaagaccatgggacacacaggccaccagttcttttcatgtggtcatcccctgttagatgggagaaaatacacctgcctcatttttgtaccttctgtgtgaacattccacggcagagcttcactaaatgtgtgatgaagaattgaatgaatgaatgaatatgagagaaaatgaataaatggttcagatcctgggctggaaggctgtgtatgaggatggtgggtagaggagggtctgtttttcttgcctttaagtcactaattgtcactttggggcaggagcacaggctttgaatgcagaccgactggactttaattctggctttactagttgtgattgtgtgaccttgtgcaagttacttaaaccctctgtgcctgtttctttatctgtaaaatggagataataagatgtcaaaggactgtggtaagaattaaatgcttta

SEQ ID NO: 63732 - DNA, 1057 bp, Homo sapiens
tacacaatggtgaagacacattggtgaagtacaaaaatataaattggatctagaagaaagggcaatgcaggcaatagaaaaattagtagaaatccctttaaaggttagtttgtaaaatcaggtaagtttatttataatttgctttcatttatttcactgcaaattatatttggatatgtatatatattgtgcttcctctgcctgtcttacagcaatttgccttgcagagttctaggaaaaaggtggcatgtgtttttactttcaaaatatttaaatttccatcattataacaaaatcaatttttcagagtaatgattctcactgtggagtcatttgattattaagacccgttggcataagattacatcctctgactataaaaatcctggaagaaaacctaggaaatattcgtctggacattgcacttggcaatgaatttatgggcgctttggaatcctgcagatataataatgataattaaacaaaacactcagagaaactgccaaccctaggatgaagtatattgttactgtgctttgggattaaaataagtaactacagtttatagaacttttatactgatacacagacactaaaaagggaaagggtttagatgagaagctctgctgtgcaatcaagaatctcagccactcatttctgtaggggctgcaggagctccctgtaaagagaggttatggagtctgtagcttcaggtaaccactgatccacttccagtcactatccatgagtttttatttccaaatacatgaaatcatatgaatttctggtttttcctgttggagcccaaggagcaagggcagaatgaggaacatgatgtttcttaccgacagttactcatgacgtctccatccaggactgaggggggcatccttctccatctaggactgggggcatccttctccatccagtattgggggtcatcctcctccatccaggacctgaggggtgtccttttctgcgcttccttggatggcagtctttcccttcatgtttatagtgatttaccattaaatcactgtgccgttttttcctaaaa

SEQ ID NO: 63733 - DNA, 288 bp, Homo sapiens
cagaagcattatcctgtcatcagaagatggacctttccctggaatgccttttccctatcatgtctgtgtggtaaatacctattcatccttaacaacccagctgaggtcttacctcatcaggatttgatcccccaaaaagatttgtccctctctgggctatctttataacttgtacatacttctatttgtggactatgttataataatgtggctatatgtctgtgatctcagcgtgagctctttgaggacagagtttctgtctgaatcctcagggttctgtttcaccat

SEQ ID NO: 63734 - DNA, 5834 bp, Homo sapiens
gcactgagtcccgggaccccgggagagcggtcagtgtgtggtcgctgcgtttcctctgcctgcgccgggcatcacttgcgcgccgcagaaagtccgtctggcagcctggatatcctctcctaccggcacccgcagacgcccctgcagccgccggtcggcgcccgggctccctagccctgtgcgctcaactgtcctgcgctgcggggtgccgcgagttccacctccgcgcctccttctctagacaggcgctgggagaaagaaccggctcccgagttctgggcatttcgcccggctcgaggtgcaggatgcagagcaaggtgctgctggccgtcgccctgtggctctgcgtggagacccgggccgcctctgtgggtttgcctagtgtttctcttgatctgcccaggctcagcatacaaaaagacatacttacaattaaggctaatacaactcttcaaattacttgcaggggacagagggacttggactggctttggcccaataatcagagtggcagtgagcaaagggtggaggtgactgagtgcagcgatggcctcttctgtaagacactcacaattccaaaagtgatcggaaatgacactggagcctacaagtgcttctaccgggaaactgacttggcctcggtcatttatgtctatgttcaagattacagatctccatttattgcttctgttagtgaccaacatggagtcgtgtacattactgagaacaaaaacaaaactgtggtgattccatgtctcgggtccatttcaaatctcaacgtgtcactttgtgcaagatacccagaaaagagatttgttcctgatggtaacagaatttcctgggacagcaagaagggctttactattcccagctacatgatcagctatgctggcatggtcttctgtgaagcaaaaattaatgatgaaagttaccagtctattatgtacatagttgtcgttgtagggtataggatttatgatgtggttctgagtccgtctcatggaattgaactatctgttggagaaaagcttgtcttaaattgtacagcaagaactgaactaaatgtggggattgacttcaactgggaatacccttcttcgaagcatcagcataagaaacttgtaaaccgagacctaaaaacccagtctgggagtgagatgaagaaatttttgagcaccttaactatagatggtgtaacccggagtgaccaaggattgtacacctgtgcagcatccagtgggctgatgaccaagaagaacagcacatttgtcagggtccatgaaaaaccttttgttgcttttggaagtggcatggaatctctggtggaagccacggtgggggagcgtgtcagaatccctgcgaagtaccttggttacccacccccagaaataaaatggtataaaaatggaataccccttgagtccaatcacacaattaaagcggggcatgtactgacgattatggaagtgagtgaaagagacacaggaaattacactgtcatccttaccaatcccatttcaaaggagaagcagagccatgtggtctctctggttgtgtatgtcccaccccagattggtgagaaatctctaatctctcctgtggattcctaccagtacggcaccactcaaacgctgacatgtacggtctatgccattcctcccccgcatcacatccactggtattggcagttggaggaagagtgcgccaacgagcccagccaagctgtctcagtgacaaacccatacccttgtgaagaatggagaagtgtggaggacttccagggaggaaataaaattgaagttaataaaaatcaatttgctctaattgaaggaaaaaacaaaactgtaagtacccttgttatccaagcggcaaatgtgtcagctttgtacaaatgtgaagcggtcaacaaagtcgggagaggagagagggtgatctccttccacgtgaccaggggtcctgaaattactttgcaacctgacatgcagcccactgagcaggagagcgtgtctttgtggtgcactgcagacagatctacgtttgagaacctcacatggtacaagcttggcccacagcctctgccaatccatgtgggagagttgcccacacctgtttgcaagaacttggatactctttggaaattgaatgccaccatgttctctaatagcacaaatgacattttgatcatggagcttaagaatgcatccttgcaggaccaaggagactatgtctgccttgctcaagacaggaagaccaagaaaagacattgcgtggtcaggcagctcacagtcctagagcgtgtggcacccacgatcacaggaaacctggagaatcagacgacaagtattggggaaagcatcgaagtctcatgcacggcatctgggaatccccctccacagatcatgtggtttaaagataatgagacccttgtagaagactcaggcattgtattgaaggatgggaaccggaacctcactatccgcagagtgaggaaggaggacgaaggcctctacacctgccaggcatgcagtgttcttggctgtgcaaaagtggaggcatttttcataatagaaggtgcccaggaaaagacgaacttggaaatcattattctagtaggcacggcggtgattgccatgttcttctggctacttcttgtcatcatcctacggaccgttaagcgggccaatggaggggaactgaagacaggctacttgtccatcgtcatggatccagatgaactcccattggatgaacattgtgaacgactgccttatgatgccagcaaatgggaattccccagagaccggctgaagctaggtaagcctcttggccgtggtgcctttggccaagtgattgaagcagatgcctttggaattgacaagacagcaacttgcaggacagtagcagtcaaaatgttgaaagaaggagcaacacacagtgagcatcgagctctcatgtctgaactcaagatcctcattcatattggtcaccatctcaatgtggtcaaccttctaggtgcctgtaccaagccaggagggccactcatggtgattgtggaattctgcaaatttggaaacctgtccacttacctgaggagcaagagaaatgaatttgtcccctacaagaccaaaggggcacgattccgtcaagggaaagactacgttggagcaatccctgtggatctgaaacggcgcttggacagcatcaccagtagccagagctcagccagctctggatttgtggaggagaagtccctcagtgatgtagaagaagaggaagctcctgaagatctgtataaggacttcctgaccttggagcatctcatctgttacagcttccaagtggctaagggcatggagttcttggcatcgcgaaagtgtatccacagggacctggcggcacgaaatatcctcttatcggagaagaacgtggttaaaatctgtgactttggcttggcccgggatatttataaagatccagattatgtcagaaaaggagatgctcgcctccctttgaaatggatggccccagaaacaatttttgacagagtgtacacaatccagagtgacgtctggtcttttggtgttttgctgtgggaaatattttccttaggtgcttctccatatcctggggtaaagattgatgaagaattttgtaggcgattgaaagaaggaactagaatgagggcccctgattatactacaccagaaatgtaccagaccatgctggactgctggcacggggagcccagtcagagacccacgttttcagagttggtggaacatttgggaaatctcttgcaagctaatgctcagcaggatggcaaagactacattgttcttccgatatcagagactttgagcatggaagaggattctggactctctctgcctacctcacctgtttcctgtatggaggaggaggaagtatgtgaccccaaattccattatgacaacacagcaggaatcagtcagtatctgcagaacagtaagcgaaagagccggcctgtgagtgtaaaaacatttgaagatatcccgttagaagaaccagaagtaaaagtaatcccagatgacaaccagacggacagtggtatggttcttgcctcagaagagctgaaaactttggaagacagaaccaaattatctccatcttttggtggaatggtgcccagcaaaagcagggagtctgtggcatctgaaggctcaaaccagacaagcggctaccagtccggatatcactccgatgacacagacaccaccgtgtactccagtgaggaagcagaacttttaaagctgatagagattggagtgcaaaccggtagcacagcccagattctccagcctgactcggggaccacactgagctctcctcctgtttaaaaggaagcatccacaccccaactcccggacatcacatgagaggtgctgctcagattttcaagtgttgttctttccaccagcaggaagtagccgcatttgattttcatttcgacaacagaaaaaggacctcggactgcagggagccagtcttctaggcatatcctggaagaggcttgtgacccaagaatgtgtctgtgtcttctcccagtgttgacctgatcctcttttttcattcatttaaaaagcatttatcatgcccctgctgcgggtctcaccatgggtttagaacaaagacgttcaagaaatggccccatcctcaaagaagtagcagtacctggggagctgacacttctgtaaaactagaagataaaccaggcaacgtaagtgttcgaggtgttgaagatgggaaggatttgcagggctgagtctatccaagaggctttgtttaggacgtgggtcccaagccaagccttaagtgtggaattcggattgatagaaaggaagactaacgttaccttgctttggagagtactggagcctgcaaatgcattgtgtttgctctggtggaggtgggcatggggtctgttctgaaatgtaaagggttcagacggggtttctggttttagaaggttgcgtgttcttcgagttgggctaaagtagagttcgttgtgctgtttctgactcctaatgagagttccttccagaccgttagctgtctccttgccaagccccaggaagaaaatgatgcagctctggctccttgtctcccaggctgatcctttattcagaataccacaaagaaaggacattcagctcaaggctccctgccgtgttgaagagttctgactgcacaaaccagcttctggtttcttctggaatgaataccctcatatctgtcctgatgtgatatgtctgagactgaatgcgggaggttcaatgtgaagctgtgtgtggtgtcaaagtttcaggaaggattttacccttttgttcttccccctgtccccaacccactctcaccccgcaacccatcagtattttagttatttggcctctactccagtaaacctgattgggtttgttcactctctgaatgattattagccagacttcaaaattattttatagcccaaattataacatctattgtattatttagacttttaacatatagagctatttctactgatttttgcccttgttctgtcctttttttcaaaaaagaaaatgtgttttttgtttggtaccatagtgtgaaatgctgggaacaatgactataagacatgctatggcacatatatttatagtctgtttatgtagaaacaaatgtaatatattaaagccttatatataatgaactttgtactattcacattttgtatcagtattatgtagcataacaaaggtcataatgctttcagcaattgatgtcattttattaaagaacattgaaaaacttga

SEQ ID NO: 63735 - DNA, 1799 bp, Homo sapiens
agtaaatccggaaagtcgtagtagtccagagtgacaaccagacggacagtggtatggttcttgcctcagaagagctgaaaactttggaagacagaaccaaattatctccatcttttggtggaatggtgcccagcaaaagcagggagtctgtggcatctgaaggctcaaaccagacaagcggctaccagtccggatatcactccgatgacacagacaccaccgtgtactccagtgaggaagcagaacttttaaagctgatagagattggagtgcaaaccggtagcacagcccagattctccagcctgactcggggaccacactgagctctcctcctgtttaaaaggaagcatccacaccccaactcccggacatcacatgagaggtgctgctcagattttcaagtgttgttctttccaccagcaggaagtagccgcatttgattttcatttcgacaacagaaaaaggacctcggactgcagggagccagtcttctaggcatatcctggaagaggcttgtgacccaagaatgtgtctgtgtcttctcccagtgttgacctgatcctcttttttcattcatttaaaaagcatttatcatgcccctgctgcgggtctcaccatgggtttagaacaaagacgttcaagaaatggccccatcctcaaagaagtagcagtacctggggagctgacacttctgtaaaactagaagataaaccaggcaacgtaagtgttcgaggtgttgaagatgggaaggatttgcagggctgagtctatccaagaggctttgtttaggacgtgggtcccaagccaagccttaagtgtggaattcggattgatagaaaggaagactaacgttaccttgctttggagagtactggagcctgcaaatgcattgtgtttgctctggtggaggtgggcatggggtctgttctgaaatgtaaagggttcagacggggtttctggttttagaaggttgcgtgttcttcgagttgggctaaagtagagttcgttgtgctgtttctgactcctaatgagagttccttccagaccgttagctgtctccttgccaagccccaggaagaaaatgatgcagctctggctccttgtctcccaggctgatcctttattcagaataccacaaagaaaggacattcagctcaaggctccctgccgtgttgaagagttctgactgcacaaaccagcttctggtttcttctggaatgaataccctcatatctgtcctgatgtgatatgtctgagactgaatgcgggaggttcaatgtgaagctgtgtgtggtgtcaaagtttcaggaaggattttacccttttgttcttccccctgtccccaacccactctcaccccgcaacccatcagtattttagttatttggcctctactccagtaaacctgattgggtttgttcactctctgaatgattattagccagacttcaaaattattttatagcccaaattataacatctattgtattatttagacttttaacatatagagctatttctactgatttttgcccttgttctgtcctttttttcaaaaaagaaaatgtgttttttgtttggtaccatagtgtgaaatgctgggaacaatgactataagacatgctatggcacatatatttatagtctgtttatgtagaaacaaatgtaatatattaaagccttatatataatgaactttgtactattcacattttgtatcagtattatgtagcataacaaaggtcataatgctttcagcaattgatgtcattttattaaagaacattgaaaaacttga

SEQ ID NO: 63736 - DNA, 258 bp, Homo sapiens
attcttcaaagctgactgacaattcaaaagttgtttttcccatcttcagtcccaccccagattggtgagaaatctctaatctctcctgtggattcctaccagtacggcaccactcaaacgctgacatgtacggtctatgccattcctcccccgcatcacatccactggtattggcagttggaggaagagtgcgccaacgagcccaggtgagtaaggccacatgctctttgctttcctgccatcttgcatttcttacag

SEQ ID NO: 63737 - DNA, 477 bp, Homo sapiens
ttcagagcattgcttgctatcaattatttcaattatgactattttatggaaacttcagcaatttgctaaagctggccctactggcctagggctactgaccactgaaagtttactacttttctgtccactgggttacaacatctttgagatctgtgaaggtagtgctttgtaaacctctgttggccattttcctgggagctaccaagtattggtgaggcctgcagggaaaaacaatgtggcatgttttaaagttgcattactttaaaaaataaatctgtgcaaagttataggcttatttgctctctcatgttctgttttttcaatttacttgctctagggtataggatttatgatgtggttctgagtccgtctcatggaattgaactatctgttggagaaaagcttgtcttaaattgtacagcaagaactgaactaaatgtggggattgacttcaactgggaatacccttcttcgaag

SEQ ID NO: 63738 - DNA, 5666 bp, Homo sapiens
gcactgagtcccgggaccccgggagagcggtcagtgtgtggtcgctgcgtttcctctgcctgcgccgggcatcacttgcgcgccgcagaaagtccgtctggcagcctggatatcctctcctaccggcacccgcagacgcccctgcagccgccggtcggcgcccgggctccctagccctgtgcgctcaactgtcctgcgctgcggggtgccgcgagttccacctccgcgcctccttctctagacaggcgctgggagaaagaaccggctcccgagttctgggcatttcgcccggctcgaggtgcaggatgcagagcaaggtgctgctggccgtcgccctgtggctctgcgtggagacccgggccgcctctgtgggtttgcctagtgtttctcttgatctgcccaggctcagcatacaaaaagacatacttacaattaaggctaatacaactcttcaaattacttgcaggggacagagggacttggactggctttggcccaataatcagagtggcagtgagcaaagggtggaggtgactgagtgcagcgatggcctcttctgtaagacactcacaattccaaaagtgatcggaaatgacactggagcctacaagtgcttctaccgggaaactgacttggcctcggtcatttatgtctatgttcaagattacagatctccatttattgcttctgttagtgaccaacatggagtcgtgtacattactgagaacaaaaacaaaactgtggtgattccatgtctcgggtccatttcaaatctcaacgtgtcactttgtgcaagatacccagaaaagagatttgttcctgatggtaacagaatttcctgggacagcaagaagggctttactattcccagctacatgatcagctatgctggcatggtcttctgtgaagcaaaaattaatgatgaaagttaccagtctattatgtacatagttgtcgttgtagggtataggatttatgatgtggttctgagtccgtctcatggaattgaactatctgttggagaaaagcttgtcttaaattgtacagcaagaactgaactaaatgtggggattgacttcaactgggaatacccttcttcgaagcatcagcataagaaacttgtaaaccgagacctaaaaacccagtctgggagtgagatgaagaaatttttgagcaccttaactatagatggtgtaacccggagtgaccaaggattgtacacctgtgcagcatccagtgggctgatgaccaagaagaacagcacatttgtcagggtccatgaaaaaccttttgttgcttttggaagtggcatggaatctctggtggaagccacggtgggggagcgtgtcagaatccctgcgaagtaccttggttacccacccccagaaataaaatggtataaaaatggaataccccttgagtccaatcacacaattaaagcggggcatgtactgacgattatggaagtgagtgaaagagacacaggaaattacactgtcatccttaccaatcccatttcaaaggagaagcagagccatgtggtctctctggttgtgtatgtcccaccccagattggtgagaaatctctaatctctcctgtggattcctaccagtacggcaccactcaaacgctgacatgtacggtctatgccattcctcccccgcatcacatccactggtattggcagttggaggaagagtgcgccaacgagcccagccaagctgtctcagtgacaaacccatacccttgtgaagaatggagaagtgtggaggacttccagggaggaaataaaattgaagttaataaaaatcaatttgctctaattgaaggaaaaaacaaaactgtaagtacccttgttatccaagcggcaaatgtgtcagctttgtacaaatgtgaagcggtcaacaaagtcgggagaggagagagggtgatctccttccacgtgaccaggggtcctgaaattactttgcaacctgacatgcagcccactgagcaggagagcgtgtctttgtggtgcactgcagacagatctacgtttgagaacctcacatggtacaagcttggcccacagcctctgccaatccatgtgggagagttgcccacacctgtttgcaagaacttggatactctttggaaattgaatgccaccatgttctctaatagcacaaatgacattttgatcatggagcttaagaatgcatccttgcaggaccaaggagactatgtctgccttgctcaagacaggaagaccaagaaaagacattgcgtggtcaggcagctcacagtcctagagcgtgtggcacccacgatcacaggaaacctggagaatcagacgacaagtattggggaaagcatcgaagtctcatgcacggcatctgggaatccccctccacagatcatgtggtttaaagataatgagacccttgtagaagactcaggcattgtattgaaggatgggaaccggaacctcactatccgcagagtgaggaaggaggacgaaggcctctacacctgccaggcatgcagtgttcttggctgtgcaaaagtggaggcatttttcataatagaaggtgcccaggaaaagacgaacttggaaatcattattctagtaggcacggcggtgattgccatgttcttctggctacttcttgtcatcatcctacggaccgttaagcgggccaatggaggggaactgaagacaggctacttgtccatcgtcatggatccagatgaactcccattggatgaacattgtgaacgactgccttatgatgccagcaaatgggaattccccagagaccggctgaagctaggtaagcctcttggccgtggtgcctttggccaagtgattgaagcagatgcctttggaattgacaagacagcaacttgcaggacagtagcagtcaaaatgttgaaagaaggagcaacacacagtgagcatcgagctctcatgtctgaactcaagatcctcattcatattggtcaccatctcaatgtggtcaaccttctaggtgcctgtaccaagccaggagggccactcatggtgattgtggaattctgcaaatttggaaacctgtccacttacctgaggagcaagagaaatgaatttgtcccctacaagaccaaaggggcacgattccgtcaagggaaagactacgttggagcaatccctgtggatctgaaacggcgcttggacagcatcaccagtagccagagctcagccagctctggatttgtggaggagaagtccctcagtgatgtagaagaagaggaagctcctgaagatctgtataaggacttcctgaccttggagcatctcatctgttacagcttccaagtggctaagggcatggagttcttggcatcgcgaaagtgtatccacagggacctggcggcacgaaatatcctcttatcggagaagaacgtggttaaaatctgtgactttggcttggcccgggatatttataaagatccagattatgtcagaaaaggagatgctcgcctccctttgaaatggatggccccagaaacaatttttgacagagtgtacacaatccagagtgacgtctggtcttttggtgttttgctgtgggaaatattttccttaggtgcttctccatatcctggggtaaagattgatgaagaattttgtaggcgattgaaagaaggaactagaatgagggcccctgattatactacaccagaaatgtaccagaccatgctggactgctggcacggggagcccagtcagagacccacgttttcagagttggtggaacatttgggaaatctcttgcaagctaatgctcagcaggatggcaaagactacattgttcttccgatatcagagactttgagcatggaagaggattctggactctctctgcctacctcacctgtttcctgtatggaggaggaggaagtatgtgaccccaaattccattatgacaacacagcaggaatcagtcagtatctgcagaacagtaagcgaaagagccggcctgtgagtgtaaaaacatttgaagatatcccgttagaagaaccagaagtaaaagtaatcccagatgacaaccagacggacagtggtatggttcttgcctcagaagagctgaaaactttggaagacagaaccaaattatctccatcttttggtggaatggtgcccagcaaaagcagggagtctgtggcatctgaaggctcaaaccagacaagcggctaccagtccggatatcactccgatgacacagacaccaccgtgtactccagtgaggaagcagaacttttaaagctgatagagattggagtgcaaaccggtagcacagcccagattctccagcctgactcggggaccacactgagctctcctcctgtttaaaaggaagcatccacaccccaactcccggacatcacatgagaggtgctgctcagattttcaagtgttgttctttccaccagcaggaagtagccgcatttgattttcatttcgacaacagaacaaagacgttcaagaaatggccccatcctcaaagaagtagcagtacctggggagctgacacttctgtaaaactagaagataaaccaggcaacgtaagtgttcgaggtgttgaagatgggaaggatttgcagggctgagtctatccaagaggctttgtttaggacgtgggtcccaagccaagccttaagtgtggaattcggattgatagaaaggaagactaacgttaccttgctttggagagtactggagcctgcaaatgcattgtgtttgctctggtggaggtgggcatggggtctgttctgaaatgtaaagggttcagacggggtttctggttttagaaggttgcgtgttcttcgagttgggctaaagtagagttcgttgtgctgtttctgactcctaatgagagttccttccagaccgttagctgtctccttgccaagccccaggaagaaaatgatgcagctctggctccttgtctcccaggctgatcctttattcagaataccacaaagaaaggacattcagctcaaggctccctgccgtgttgaagagttctgactgcacaaaccagcttctggtttcttctggaatgaataccctcatatctgtcctgatgtgatatgtctgagactgaatgcgggaggttcaatgtgaagctgtgtgtggtgtcaaagtttcaggaaggattttacccttttgttcttccccctgtccccaacccactctcaccccgcaacccatcagtattttagttatttggcctctactccagtaaacctgattgggtttgttcactctctgaatgattattagccagacttcaaaattattttatagcccaaattataacatctattgtattatttagacttttaacatatagagctatttctactgatttttgcccttgttctgtcctttttttcaaaaaagaaaatgtgttttttgtttggtaccatagtgtgaaatgctgggaacaatgactataagacatgctatggcacatatatttatagtctgtttatgtagaaacaaatgtaatatattaaagccttatatataatgaactttgtactattcacattttgtatcagtattatgtagcataacaaaggtcataatgctttcagcaattgatgtcattttattaaagaacattgaaaaacttga

SEQ ID NO: 63739 - DNA, 314 bp, Homo sapiens
tgtgttaaatttgctttttacataatttttcctaggctcagttgtgtaaccttccacaaagtagtctacagaataaaactaaattacttcctagtattgaggaggcatggagcctaccaatccccgcagagcttacctccaggcagggtgccatgaacacagcacagcaggtgagaagttgggttatgttctgtaggtgcccagctttaagggtttttttttttcactcttcagtaatcaagtttatttcactaaacaaaggattgactttaaaatagagaaatctttttaattaaaaaataaaaattttttaa

SEQ ID NO: 63740 - DNA, 5217 bp, Homo sapiens
  misc_feature (4032)..(4032): n is a, c, g, or t
  misc_feature (4083)..(4083): n is a, c, g, or t
  misc_feature (4101)..(4101): n is a, c, g, or t
  misc_feature (4160)..(4160): n is a, c, g, or t
  misc_feature (4180)..(4180): n is a, c, g, or t
  misc_feature (4821)..(4821): n is a, c, g, or t
agagttatattgtgccatttatggaaaaactctccccactgctcttggctttgacagtaggaatcaggttatatatggtctctcggtttgaagatatttgtcattaaaaaccagaacaagggctctgagatagggtcctttcctgacctactctggtaaagtctttatcctcaggatgcaaggataccaccctcttcctgtggaaagtgtcgaatcacatgcagagctctaagtctttcagttactttggagtgcagaaccatttcagacatgctgagggggactctactgtgcgcggtgctcgggcttctgcgcgcccagcccttcccctgtccgccagcttgcaagtgtgtcttccgggacgccgcgcagtgctcggggggcgacgtggcgcgcatctccgcgctgggcctgcccaccaacctcacgcacatcctgctcttcggaatgggccgcggcgtcctgcagagccagagcttcagcggcatgaccgtcctgcagcgcctcatgatctccgacagccacatttccgccgttgcccccggcaccttcagtgacctgataaaactgaaaaccctgaggctgtcgcgcaacaaaatcacgcatcttccaggtgcgctgctggataagatggtgctcctggagcagttgtttttggaccacaatgcgctaaggggcattgaccaaaacatgtttcagaaactggttaacctgcaggagctcgctctgaaccagaatcagctcgatttccttcctgccagtctcttcacgaatctggagaacctgaagttgttggatttatcgggaaacaacctgacccacctgcccaaggggttgcttggagcacaggctaagctcgagagacttctgctccactcgaaccgccttgtgtctctggattcggggctgttgaacagcctgggcgccctgacggagctgcagttccaccgaaatcacatccgttccatcgcacccggggccttcgaccggctcccaaacctcagttctttgacgctttcgagaaaccaccttgcgtttctcccctctgcgctctttcttcattcgcacaatctgactctgttgactctgttcgagaacccgctggcagagctcccgggggtgctcttcggggagatggggggcctgcaggagctgtggctgaaccgcacccagctgcgcaccctgcccgccgccgccttccgcaacctgagccgcctgcggtacttaggggtgactctgagcccgcggctgagcgcgcttccgcagggcgccttccagggccttggcgagctccaggtgctcgccctgcactccaacggcctgaccgccctccccgacggcttgctgcgcggcctcggcaagctgcgccaggtgtccctgcgccgcaacaggctgcgcgccctgccccgtgccctcttccgcaatctcagcagcctggagagcgtccagctcgaccacaaccagctggagaccctgcctggcgacgtgtttggggctctgccccggctgacggaggtcctgttggggcacaactcctggcgctgcgactgtggcctggggcccttcctggggtggctgcggcagcacctaggcctcgtgggcggggaagagcccccacggtgcgcaggccctggggcgcacgccggcctgccgctctgggccctgccggggggtgacgcggagtgcccgggcccccggggcccgcctccccgccccgctgcggacagctcctcggaagcccctgtccacccagccttggctcccaacagctcagaaccctgggtgtgggcccagccggtgaccacgggcaaaggtcaagatcatagtccgttctgggggttttattttctgcttttagctgttcaggccatgatcaccgtgatcatcgtgtttgctatgattaaaattggccaactctttcgaaaattaatcagagagagagcccttgggtaaaccaatgggaaaatcttctaattacttagaacctgaccagatgtggctcggaggggaatccagacccgctgctgtcttgctctccctcccctccccactcctcctctcttcttcctcttctctctcactgccacgccttcctttccctcctcctccccctctccgctctgtgctcttcattctcacaggcccgcaacccctcctctctgtgtcccccgcccgttcctggaaactgagcttgacgtttgtaaactgtggttgcctgccttccccagctcccacgcgggtgtgcgctgacactgccgggggcgctggactgtgttggacccatccgtgctccgctgtgcctggcttggcgtctggtggagagaggggcctcttcagtgtctactgagtaaggggacagctccaggccggggcctgtctcctgcacagagtaagccggtaaatgtttgtgaaatcaatgcgtggataaaggaacacatgccatccaagtgatgatggcttttcctggagggaaaggataggctgttgctctatctaattttttgtttttgtttttggacagtctagctctgtggcccaggctggcgtgcagtgggccgtctcagttcactgcagcctccgcctcccaggttcaagtgattctcatgcctcagcgttctgagtagctgggattagaggcgtgtgccactacacccggctaatttttgtactttttaaagtagagacggggctttgccatattggcctggctgatctcaaactcctggtcttgaactcctggccacaagtgatctgcccgccttggcctcccaaagtgctgggattacaggcgtaagccactacacctggccctcttcatcgaattttatttgagaagtagagctcttgccattttttcccttgctccatttttctcactttatgtctctctgacctatgggctacttgggagagcactggactccattcatgcatgagcattttcaggataagcgacttctgtgaggctgagagaggaagaaaacacggagccttccctccaggtgcccagtgtaggtccagcgtgtttcctgagcctcctgtgagtttccacttgctttacatccatgcaacatgtcattttgaaactggattgatttgcatttcctggaactctgccacctcatttcacaagcatttatggagcagttaacatgtgactggtattcatgaatataatgataagcttgattctagttcagctgctgtcacagtctcatttgttcttccaactgaaagccgtaaaacctttgttgctttaattgaatgtctgtgcttatgagaggcagtggttaaaacaggggctggcgagttgacaactgtgggttcaaatcccagctctaccacttactaactgcatgggactttgggtaagacacctgcttacattctctaagccttggtttcctgaaccttaaaacaggataacatagtacctgcttcgtagagtttttgtgagaattaaaggcaataaagcatataatgacttagcccagcggcctgcaggcaatacatgttaatgaatgttagctattattactaaaggatgagcaattattattggcatcatgatttctaaagaagagctttgagttggtatttttctctgtgtataagggtaagtccgaactttctcagactggaggttacattcacatcagtctgtcttcccctgcggatggcctcagccctgggtggccagactctgtgctcacaatccagagcaatggatcctccaacaccaccaggtggatgtggagcaggagagctggatcgtggcatttgtttctgggttctgcagttgggagttggtttctgggttctccattggtctacttgtctagtcccataccagactcacggtctccattattggagctttaataatttttggtatagggtcatctctccaccttgtttttcttctattcttggttctttgcaattctatgaatatttcagggtcagcatgtcaactccattgaaaaaccctgctgggattttaatagaacttacagctcacgcctgtaatcncagcactttgggaggctgaggtgggtggatcacaggtcaggagtttgagancagctggccaagatggtnaaaccccgtctctactaaaaatacaaaaattagctgggtgcggtggcaggtgcctgtantcccagctacttgggacacngaggcaggagaatcacttgaacccgggaggcggaggttgcagtgagccgagatcgtgccactgcactctagcctgggcgacagagcgagactccatctcaaaaaaaaaaaaaaaaaattgcagtaaatttaaaactaatttggggaagaatctgtatttttacaatacctagtgttcttgccagtaagcatggttcatcttcccatttatttacgtcattttaaatctttcagtgatgttttagaattttttttataaaaaccttcactataagaacagaaaaccaaacaccgcatgttctcactcataggtgggaattgaacaatgagaacacttggacacagggcggggaacgtcacacgcctggactgtcggggggtggggggctgggagagggatagtgttaggagaaatacctaatgtaaatgacgagttaatgggtgcagccaaccaacctggcacatgtattcatatgtaacaaacctgcacgttgtgcacatgtaccctagaacttaaagtatataaaaaaaagaaaccttgcactgattttgttagatttattcctaggtatccttcctcttttttgatttgtcattgctattgtagatggcatctttttaaaaagttatattttctaaagnaaaaaataaaaaaagttgtatttctaatttttattaccaatatataagaatgtaatttatttttacataattatcttatgtctagtaataattctgataatttgcttcttcctattaaaaccttacacccattattgatttatttttctgttttaaaatatcttcctgcactggctaaaacctccactataatgttgagcagaacagtgagcatccttagaactatcttggttgcaaagggtaggtctctaatgtttcatcaataaatgtgatgtttctagtctgagtttgctaagtatattttaaaataatcagtaaagttagattttatccatttttatcttaactattgagatgctcatatcatttttcttcttcaatgtgttaaaatggtga

SEQ ID NO: 63741 - DNA, 5019 bp, Homo sapiens
  misc_feature (3834)..(3834): n is a, c, g, or t
  misc_feature (3885)..(3885): n is a, c, g, or t
  misc_feature (3903)..(3903): n is a, c, g, or t
  misc_feature (3962)..(3962): n is a, c, g, or t
  misc_feature (3982)..(3982): n is a, c, g, or t
  misc_feature (4623)..(4623): n is a, c, g, or t
ggatcccagggttcagtacaggcgcgaacgctcctgtgtgttgaccacactcccacggttgctttttcagacatgctgagggggactctactgtgcgcggtgctcgggcttctgcgcgcccagcccttcccctgtccgccagcttgcaagtgtgtcttccgggacgccgcgcagtgctcggggggcgacgtggcgcgcatctccgcgctgggcctgcccaccaacctcacgcacatcctgctcttcggaatgggccgcggcgtcctgcagagccagagcttcagcggcatgaccgtcctgcagcgcctcatgatctccgacagccacatttccgccgttgcccccggcaccttcagtgacctgataaaactgaaaaccctgaggctgtcgcgcaacaaaatcacgcatcttccaggtgcgctgctggataagatggtgctcctggagcagttgtttttggaccacaatgcgctaaggggcattgaccaaaacatgtttcagaaactggttaacctgcaggagctcgctctgaaccagaatcagctcgatttccttcctgccagtctcttcacgaatctggagaacctgaagttgttggatttatcgggaaacaacctgacccacctgcccaaggggttgcttggagcacaggctaagctcgagagacttctgctccactcgaaccgccttgtgtctctggattcggggctgttgaacagcctgggcgccctgacggagctgcagttccaccgaaatcacatccgttccatcgcacccggggccttcgaccggctcccaaacctcagttctttgacgctttcgagaaaccaccttgcgtttctcccctctgcgctctttcttcattcgcacaatctgactctgttgactctgttcgagaacccgctggcagagctcccgggggtgctcttcggggagatggggggcctgcaggagctgtggctgaaccgcacccagctgcgcaccctgcccgccgccgccttccgcaacctgagccgcctgcggtacttaggggtgactctgagcccgcggctgagcgcgcttccgcagggcgccttccagggccttggcgagctccaggtgctcgccctgcactccaacggcctgaccgccctccccgacggcttgctgcgcggcctcggcaagctgcgccaggtgtccctgcgccgcaacaggctgcgcgccctgccccgtgccctcttccgcaatctcagcagcctggagagcgtccagctcgaccacaaccagctggagaccctgcctggcgacgtgtttggggctctgccccggctgacggaggtcctgttggggcacaactcctggcgctgcgactgtggcctggggcccttcctggggtggctgcggcagcacctaggcctcgtgggcggggaagagcccccacggtgcgcaggccctggggcgcacgccggcctgccgctctgggccctgccggggggtgacgcggagtgcccgggcccccggggcccgcctccccgccccgctgcggacagctcctcggaagcccctgtccacccagccttggctcccaacagctcagaaccctgggtgtgggcccagccggtgaccacgggcaaaggtcaagatcatagtccgttctgggggttttattttctgcttttagctgttcaggccatgatcaccgtgatcatcgtgtttgctatgattaaaattggccaactctttcgaaaattaatcagagagagagcccttgggtaaaccaatgggaaaatcttctaattacttagaacctgaccagatgtggctcggaggggaatccagacccgctgctgtcttgctctccctcccctccccactcctcctctcttcttcctcttctctctcactgccacgccttcctttccctcctcctccccctctccgctctgtgctcttcattctcacaggcccgcaacccctcctctctgtgtcccccgcccgttcctggaaactgagcttgacgtttgtaaactgtggttgcctgccttccccagctcccacgcgggtgtgcgctgacactgccgggggcgctggactgtgttggacccatccgtgctccgctgtgcctggcttggcgtctggtggagagaggggcctcttcagtgtctactgagtaaggggacagctccaggccggggcctgtctcctgcacagagtaagccggtaaatgtttgtgaaatcaatgcgtggataaaggaacacatgccatccaagtgatgatggcttttcctggagggaaaggataggctgttgctctatctaattttttgtttttgtttttggacagtctagctctgtggcccaggctggcgtgcagtgggccgtctcagttcactgcagcctccgcctcccaggttcaagtgattctcatgcctcagcgttctgagtagctgggattagaggcgtgtgccactacacccggctaatttttgtactttttaaagtagagacggggctttgccatattggcctggctgatctcaaactcctggtcttgaactcctggccacaagtgatctgcccgccttggcctcccaaagtgctgggattacaggcgtaagccactacacctggccctcttcatcgaattttatttgagaagtagagctcttgccattttttcccttgctccatttttctcactttatgtctctctgacctatgggctacttgggagagcactggactccattcatgcatgagcattttcaggataagcgacttctgtgaggctgagagaggaagaaaacacggagccttccctccaggtgcccagtgtaggtccagcgtgtttcctgagcctcctgtgagtttccacttgctttacatccatgcaacatgtcattttgaaactggattgatttgcatttcctggaactctgccacctcatttcacaagcatttatggagcagttaacatgtgactggtattcatgaatataatgataagcttgattctagttcagctgctgtcacagtctcatttgttcttccaactgaaagccgtaaaacctttgttgctttaattgaatgtctgtgcttatgagaggcagtggttaaaacaggggctggcgagttgacaactgtgggttcaaatcccagctctaccacttactaactgcatgggactttgggtaagacacctgcttacattctctaagccttggtttcctgaaccttaaaacaggataacatagtacctgcttcgtagagtttttgtgagaattaaaggcaataaagcatataatgacttagcccagcggcctgcaggcaatacatgttaatgaatgttagctattattactaaaggatgagcaattattattggcatcatgatttctaaagaagagctttgagttggtatttttctctgtgtataagggtaagtccgaactttctcagactggaggttacattcacatcagtctgtcttcccctgcggatggcctcagccctgggtggccagactctgtgctcacaatccagagcaatggatcctccaacaccaccaggtggatgtggagcaggagagctggatcgtggcatttgtttctgggttctgcagttgggagttggtttctgggttctccattggtctacttgtctagtcccataccagactcacggtctccattattggagctttaataatttttggtatagggtcatctctccaccttgtttttcttctattcttggttctttgcaattctatgaatatttcagggtcagcatgtcaactccattgaaaaaccctgctgggattttaatagaacttacagctcacgcctgtaatcncagcactttgggaggctgaggtgggtggatcacaggtcaggagtttgagancagctggccaagatggtnaaaccccgtctctactaaaaatacaaaaattagctgggtgcggtggcaggtgcctgtantcccagctacttgggacacngaggcaggagaatcacttgaacccgggaggcggaggttgcagtgagccgagatcgtgccactgcactctagcctgggcgacagagcgagactccatctcaaaaaaaaaaaaaaaaaattgcagtaaatttaaaactaatttggggaagaatctgtatttttacaatacctagtgttcttgccagtaagcatggttcatcttcccatttatttacgtcattttaaatctttcagtgatgttttagaattttttttataaaaaccttcactataagaacagaaaaccaaacaccgcatgttctcactcataggtgggaattgaacaatgagaacacttggacacagggcggggaacgtcacacgcctggactgtcggggggtggggggctgggagagggatagtgttaggagaaatacctaatgtaaatgacgagttaatgggtgcagccaaccaacctggcacatgtattcatatgtaacaaacctgcacgttgtgcacatgtaccctagaacttaaagtatataaaaaaaagaaaccttgcactgattttgttagatttattcctaggtatccttcctcttttttgatttgtcattgctattgtagatggcatctttttaaaaagttatattttctaaagnaaaaaataaaaaaagttgtatttctaatttttattaccaatatataagaatgtaatttatttttacataattatcttatgtctagtaataattctgataatttgcttcttcctattaaaaccttacacccattattgatttatttttctgttttaaaatatcttcctgcactggctaaaacctccactataatgttgagcagaacagtgagcatccttagaactatcttggttgcaaagggtaggtctctaatgtttcatcaataaatgtgatgtttctagtctgagtttgctaagtatattttaaaataatcagtaaagttagattttatccatttttatcttaactattgagatgctcatatcatttttcttcttcaatgtgttaaaatggtga

SEQ ID NO: 63742 - DNA, 329 bp, Homo sapiens
  misc_feature (1)..(1): n is a, c, g, or t
nacaatcttggaaacagagttgctgtatgctgaaggtctgagagtagctcttagccttgcctatcttagatagtagttatgctgtgataatttaattgatgtactatgtttgatttgttgctgatactttaaatttgaagtttttctgagaaatggagcagcaatgcagcatcaacttgttaaattacatgttaagccttgaaaaaaaaaggagatcacacctgtaatcccagcacattgggaggccgaggcaggcagatcacgaggtcaggagatcaagaccatcctggctaacatggtgaaaccccgtctctactaaaaatacaaaa

SEQ ID NO: 63743 - DNA, 615 bp, Homo sapiens
tactactactaaattcgcggccgcgtcgccagaagaaccaaagagaagaagatatgggagtgaatttattccaagaatctacaatgacattgaagttgttggaggaatatactgtatttaaaaaacctgtgtcacattcaaaaatttcatctaagctgggcgcagtggcttgttcctgtagtcccagcacttcaggaggctgaggtgggtggattgcttgagcccaggagttggagaccagtctgggaaacatggtgagatgtcatctctctacaaaatacaaaaaaattagccgggcatggtggcgcttgcctatagtctcagctactcgggaggctgaaatgagaggatcacttgagcccggggaggtccaggccgcagtgatccgagatcacaccactgcactccagcctgggtgacagagtgagaccctgtctaaattaaaaaaaaaaaaaaggcaatggctttgtgcttttgaaggtggaatgaaaggtggaatgaagacacatccaccttaaggctttaaaagaccatgaagctgggtgcagtggctcactcctgtaatcctaggatttggggaagccaaggcaggaggattgcttgagcctaggagtt

SEQ ID NO: 63744 - DNA, 392 bp, Homo sapiens
  misc_feature (321)..(321): n is a, c, g, or t
tctttttgtgaactgttcaaatattttgctcctttgaaaatttgggtcatatgtcctcatgtaattgttgtggcattcttttttatattccagacacaagtgttttgtcagaattttatctcatatatataaatgtatgtgtgtgtatatatatatatataattttttttttttgagatggagtctcactctgtccctagggctgcaatggcgtgttcttgggctcactgcaacctctgcctcctggggttcaaggggattctcctgcctcagcctcccgagtagctggggattacagggcgcccaccaccacaccggggntaatttttgtgttttcagtaggagacggggggttttggcccatgttggcccaggggtgggtcttcaaactc

SEQ ID NO: 63745 - DNA, 288 bp, Homo sapiens
gtgagctaagatcacgccactgcactccagcctgggcaacagagcaagactctccccaaaaaaaaaaaaaaaaagtagagaacatttgctggtgattcaagtgatactataggtaaagaaatgaaattctaaattgttagcctaattgcaaagtctatataggaatttgaatgtttgataatataataaaaaattttacctttatattaagatctataaataggttagaataattcttatgctctctaatagaaaaacatttaaataattaataaagtaacatttaaa

SEQ ID NO: 63746 - DNA, 622 bp, Homo sapiens
aggagggagagatggaagctgggggaagatgggagctaggggcagtggctctgacttaacaccagcattggtttcccaatattgaataaagagggctgagctggacagcaggtgtccttaggggcttgacctcaccacccccagacggggcctgtctgcccaatttcaggggcttctcctcaatttcctggcttcagggcgaggctgctcagcccagggacaagaaggaaagatgggtatttgttaaaggcctactccacactgagcagcgctgtttacccatttaatcctcccagcctccttaggggagtgctatgaggacttctcttttatttctctcatctgaagctcagatgagagaggtacccagtcacatgtgtgtcagtggcagagctgggttttgaacccatagccgcctgcctccatgcaaggcctctgacctcccctctgtccaggctgcgtttggagcccaggaacagattccaaggctgggccccgcagggaggaaaaaacaaagcacgagtcgctctctgcacggaggctgagagatggagccaccgctgaggaagaacacacattcatcaggctggtgaccccggtgtaccagcgctttgtggcgtgt

SEQ ID NO: 63747 - DNA, 478 bp, Homo sapiens
cataaagagagtagagaatcaaactatgaagaaggtcaagacagattggcgggctagcaacatctcccttaaacatttaacacaacaaagaacatccaacaaaaatacagtgctatattctttgcaacagatttttgaattcctgtttaaaggggaaaaccatgtttttgatatcaatcataggttttaaggttttaagacatccatcaaaacattggaacatttcagtgaaaaatatgctgcagagagggcacctttagaacattttcagtagtgggatccttttcctgcctggggcttagaaataaaagcactgatcatcaaacaccatacattatatactgaaaaagggggtcactcaaaatttttgtaaatatattatgaaatatattgaacattctaaatagtctaatacagaagcgaatattgaatatatgtgtaatattttttaaagtctttgtatttttccaaaataaaa

SEQ ID NO: 63748 - DNA, 458 bp, Homo sapiens
attttgtggaagggttaatagcttgttggcatgctcttatcatctcccttaaacatttaacacaacaaagaacatccaacaaaaatacagtgctatattctttgcaacagatttttgaattcctgtttaaaggggaaaaccatgtttttgatatcaatcataggttttaaggttttaagacatccatcaaaacattggaacatttcagtgaaaaatatgctgcagagagggcacctttagaacattttcagtagtgggatccttttcctgcctggggcttagaaataaaagcactgatcatcaaacaccatacattatatactgaaaaagggggtcactcaaaatttttgtaaatatattatgaaatatattgaacattctaaatagtctaatacagaagcgaatattgaatatatgtgtaatattttttaaagtctttgtatttttccaaaataaaa

SEQ ID NO: 63749 - DNA, 686 bp, Homo sapiens
caggtatcctacctaggcctagagaactaagcttttgctgttcattatatgaagcttcttaaatgtcatacaggctagttgcatcctactaattcttcacagactagataaaaatacttttgctgaagtcttaatcggcctgtcctgaagtcaaccaggctgtatgttagtgccttgactcagtgcagctttcaagagaggcagaaagaatacccacagagaaggcacatgtgggcggtggcagtgtaggaccaggaaagaagctaggtctctatattccctcgcattttgaatctgtgttaaattcaatcatattagtatgaagcaatcctcttacctatctccttaatccagcctctgactgccagctcacaaaagagggagaagaggcactacatttaaagtagtgattatctctaactagaattttaagtccctacatgttttggctgtagaaccagccaaagttttgttccaattccctacaaaatttcacaatagtcaggagttagaattggtccctatgttatgaaacagctagtttttatactttaaacttaaaatgaagctttagttgtttattattactgtggatattttccaagagacagaataacatctgtggaagattctacacaggccttgatgccagacattgtaattatttccctgctcaaaggcaatag

SEQ ID NO: 63750 - DNA, 471 bp, Homo sapiens
gaactccctccctaagtgatcccagtctttaccatggtgttaaataccatctgtttgtagatgacttccaaatttgtagtttcaatccaaacgtttcctctgatttcctaactagtgtattcaactctgtacttgacatttctatttagatgttttacaggcttctcagacttaacatatcccaaatggaactcttggatcttcccccaaacttgttagtctttcctatcttcaaatggtaatattctgcctttttgctccccaattcccagtccatctgcaagcctgtcattcatatctgctaactataacttgaactatccatccctctccatctctactctccctacatgagttaagccaccatccagtctcacctggactactgcaatcacttccagattattttctctactcctacttacaccttcttccaaactgctctctgtataagtcagttgaaatatttga

SEQ ID NO: 63751 - DNA, 741 bp, Homo sapiens
atggtcacacagcctcatgctccggattgcaccgccctctccctgtgggggtcaatgtggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatggtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccaca

SEQ ID NO: 63752 - DNA, 2962 bp, Homo sapiens
  misc_feature (117)..(118): n is a, c, g, or t
ggaatttcctcagataccgtcgtagtcttaaccataaactatgccgactagggatcgggtggtgtttttttaatgacccactcggcaccttacgagaaatcaaagtctttgggttcnngggggcagtacacaaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatggggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccaca

SEQ ID NO: 63753 - DNA, 2566 bp, Homo sapiens
  misc_feature (117)..(118): n is a, c, g, or t
ggaatttcctcagataccgtcgtagtcttaaccataaactatgccgactagggatcgggtggtgtttttttaatgacccactcggcaccttacgagaaatcaaagtctttgggttcnngggggcagtacacaaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccagctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccaca

SEQ ID NO: 63754 - DNA, 2776 bp, Homo sapiens
  misc_feature (117)..(118): n is a, c, g, or t
ggaatttcctcagataccgtcgtagtcttaaccataaactatgccgactagggatcgggtggtgtttttttaatgacccactcggcaccttacgagaaatcaaagtctttgggttcnngggggcagtacacaaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccaca

SEQ ID NO: 63755 - DNA, 2909 bp, Homo sapiens
  misc_feature (117)..(118): n is a, c, g, or t
ggaatttcctcagataccgtcgtagtcttaaccataaactatgccgactagggatcgggtggtgtttttttaatgacccactcggcaccttacgagaaatcaaagtctttgggttcnngggggcagtacacaaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatggggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccaca

SEQ ID NO: 63756 - DNA, 2219 bp, Homo sapiens
tccttttgatggtcctaattctcaaaggtaaccttaaggggagtgtattttgctgttggttctgtggatgacaggtgacaaaacaggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccaca

SEQ ID NO: 63757 - DNA, 2689 bp, Homo sapiens
  misc_feature (117)..(118): n is a, c, g, or t
ggaatttcctcagataccgtcgtagtcttaaccataaactatgccgactagggatcgggtggtgtttttttaatgacccactcggcaccttacgagaaatcaaagtctttgggttcnngggggcagtacacaaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatggggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccaca

SEQ ID NO: 63758 - DNA, 1911 bp, Homo sapiens
tgcctcagcctcccaagaagctgggattacaggcatgcgccaccatgcctcgctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccaca

SEQ ID NO: 63759 - DNA, 3293 bp, Homo sapiens
  misc_feature (117)..(118): n is a, c, g, or t
  misc_feature (2971)..(2971): n is a, c, g, or t
ggaatttcctcagataccgtcgtagtcttaaccataaactatgccgactagggatcgggtggtgtttttttaatgacccactcggcaccttacgagaaatcaaagtctttgggttcnngggggcagtacacaaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatggggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccacaaaaaaaaanaaaaaaaaaaaaaaaaaaaaaagacaaaaaaaaaacaaacacaaaaaaatgaaacaaaaaaacaaacacaagggggcgcgcgccccgacaaacagtctaccaccgcagggggccgccaacgaaacgagccccaacacccacgaaaatggccgaccaaggggcgccgcacatagaggtcgacgaaagtaaaagaccacgagccagccgacgcccagttttaaaaacaggggcgcgcaagaagggagaaagacgcggtgtactagcgcgccacggggggcgcgcccacaactcctgggggcggagcaataccggaaccgccacg

SEQ ID NO: 63760 - DNA, 2678 bp, Homo sapiens
  misc_feature (117)..(118): n is a, c, g, or t
ggaatttcctcagataccgtcgtagtcttaaccataaactatgccgactagggatcgggtggtgtttttttaatgacccactcggcaccttacgagaaatcaaagtctttgggttcnngggggcagtacacaaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatggggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccaca

SEQ ID NO: 63761 - DNA, 2522 bp, Homo sapiens
  misc_feature (117)..(118): n is a, c, g, or t
ggaatttcctcagataccgtcgtagtcttaaccataaactatgccgactagggatcgggtggtgtttttttaatgacccactcggcaccttacgagaaatcaaagtctttgggttcnngggggcagtacacaaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatggggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctaccagcaggactgcctcgctgccccacctcccgctccttggcctgtccccagattccttccctggttgacttgactcatgcttgtttcactttcacatggaatttcccagttatgaaattaataaaaatcaatggtttccaca

SEQ ID NO: 63762 - DNA, 1662 bp, Homo sapiens
  misc_feature (117)..(118): n is a, c, g, or t
ggaatttcctcagataccgtcgtagtcttaaccataaactatgccgactagggatcgggtggtgtttttttaatgacccactcggcaccttacgagaaatcaaagtctttgggttcnngggggcagtacacaaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatggggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggtgggcaagctggtgggaagtcttgctggtagaaggacca

SEQ ID NO: 63763 - DNA, 488 bp, Homo sapiens
catatatttttaatatacatagcttctttttcaataaagaagctcacttttgaacctagtattggtaacttataactttctttttttcttgattactctaagagtttttataaataagttttgttgatattttaaaccttgtttcttatggacagagtagttgggtcatgctttttaaatccattctgaccatctctgtcttttaattggataatctaatccattaacatttattgtagttataaattttaatgcagttactaatatagtatttttttttgttttggagatggagtttcacttttgttgcccaggctggagtgcaatggcacaatctcagctcactgcaacctgcgcctcctgagttcaagcaattctcctgcttcagcctcccgagtagctggaattacaggcacccgccaccacgtctggctaattttttgtacttttagtagagatggggtttcaccatgttggccaggctggtc

SEQ ID NO: 63764 - DNA, 226 bp, Homo sapiens
ctcagctgtaacttctcaaagcctcctgctcagagaccttagctccctctctagttaacaaaccagtcccaggcccttttgggatgtcagtagctctggcctgtaccaggtgacagatggacagcacagaggtgttggacttatcttcaagctggagaaactcaagggaccagtgggaacccttagccagattcctccccatatttgggaaagtaaattttgagct

SEQ ID NO: 63765 - DNA, 1489 bp, Homo sapiens
gaccccgcgtccgctctggtgcagcatgatgctgcccccttggaccctcggccttctcctgctggccacagtcagaggaaaagaggtctgctacggacaacttggctgcttttctgatgaaaaaccatgggcaggaacccttcagcgacctgtaaaattacttccctggtcccccgaggacattgacacccgctttcttctgtacacaaatgaaaatccaaacaacttccaactaatcactggcacggaaccagacaccattgaggcttcaaacttccaactggaccgcaagacacgcttcatcatccatggcttcttagacaaggcggaggacagctggccatcggacatgtgcaagaaaatgtttgaagtggagaaggtgaactgcatctgtgtggactggaggcacgggtcccgggcaatgtacacccaagccgtgcaaaacattcgggttgttggggcggagacagctttcttaatacaagcactgtcgacgcagctagggtacagccttgaggacgtgcatgtcatcggccacagcctgggcgcgcacacggccgcggaggcgggcaggaggctggggggccgcgtgggcaggatcacagggctggatccagcagggccgtgcttccaggatgaacctgaggaggttcggttggatccatctgacgccgtgtttgtggatgtgattcacacagattcttctcccatagttccttccctaggtttcggaatgagccaaaaggtgggccatctggatttctttccaaatggaggaaaggaaatgcccggatgtaagaaaaatgtcctttcaaccattactgatattgatggaatatgggaaggaattggtggctttgtgtcttgcaatcacctaagaagcttcgagtattactcaagcagcgtcctcaaccctgatggcttcctgggctatccctgtgcctcctacgatgagtttcaggagagtaagtgtttcccttgtccagctgaaggatgccccaaaatggggcactatgctgaccaatttaaggggaaaacaagtgctgtggaacaaacctttttcctgaacacaggagagagtggtaactttactagttggagatataaggtatcagtcacactttctggaaaagagaaagtgaatgggtacatcaggattgctttgtatggaagtaatgaaaactcgaaacaatatgagattttcaaaggatccctcaaaccagatgcaagtcacacgtgtgctattgatgtggattttaatgttggaaaaatacagaaagttaaattcctctggaacaaacgtgggataaatctatctgagcccaaactgggggcttcccaaatcacagtgcaaagtggtgaagatgggactgagtataatttttgtagcagcgacactgtggaagaaaacgtcttgcaatctctttacccttgttaaaaacgtggtgcggctattgcggtaataaaatctttaatgcactcggaaaaa

SEQ ID NO: 63766 - DNA, 592 bp, Homo sapiens
gaccccgcgtccgctctggtgcagcatgatgctgcccccttggaccctcggccttctcctgctggccacagtcagaggaaaagaggtctgctacggacaacttggctgcttttctgatgaaaaaccatgggcaggaacccttcagcgacctgtaaaattacttccctggtcccccgaggacattgacacccgctttcttctgtacacaaatgaaaatccaaacaacttccaactaatcactggcacggaaccagacaccattgaggcttcaaacttccaactggaccgcaagacacgcttcatcatccatggcttcttagacaaggcggaggacagctggccatcggacatgtgcaagaaaatgtttgaagtggagaaggtgaactgcatctgtgtggactggaggcacgggtcccgggcaatgtacacccaagccgtgcaaaacattcgggttgttggggcggagacagctttcttaatacaagcactgtcggtaaaaccctgcctgggccctgtcctgtgggtaggggtcagagaggggcagggaggtaccacgtggcatggagaggcagcctggggacccgtgggcatg

SEQ ID NO: 63767 - DNA, 377 bp, Homo sapiens
ttttaaatggaagtgatactaacacctatcttacggagttgtcgagaggatttaaaaagttaaaactgcacataaaacatttacagctgtgcccagcccatgacatctgctcagtgaatgttgttggtagcagtagtagatccgggattctgaagtgcaaagtgccgtagcaggagtgtaaaaattgtgtaattcctgccacaccctattggcaccagaataaggtcacattctttctgccacgtatggagaagtgtgaaaagcaacattgttagttctagctcatatgggaaaagcaactacagcccgaagtgcaggtaatctcccgattacccaatctcgtttctttcgcagtttaaatatgaatcttacagagg

SEQ ID NO: 63768 - DNA, 467 bp, Homo sapiens
tcatgggatacttttattcagacatttctgacttgcctcttgtagcgtccgctttttatccaaatgatagaatttgatctagaggaaactgaattatctgggctacatcccatcatcatctctctttggaggcaatcaatgatcagccatcagaatgttcagatctgtgggtttgcggggctactcttaggggtccagcatgtacttctctttggccgggtctcttaagaaacttatcccaccatttctgggtcacctgaggctcatgaccactgtgatccagcttatcctcctgtcaaacacaatcaaggtccctgtaaagtggcaaagaggataccaggatttaaggtgatacctgggaaacaggagcctagagcccaccccatggtagatactcatttccattccaaactctgtacatcccagtagtccagatccatagggtcagtgccctgacagggaaatgg

SEQ ID NO: 63769 - DNA, 469 bp, Homo sapiens
gaaactaagggctgccaccaacagcccacatccacttgccagctctgagagcaaatagatcctgcaggcctagtcaagcctcatttgactgacgcctcagtcaacatcttgactgcaagcccatgcaaaacactgagccagaaaccacccacccaagaagctgtgaattcctgactggcaaaaaatgctgagcagaaaaccaggaaatggatggactccacctccgcagccacgcctgcccgtttgcgcttactgaacagaggtcctcaggaacgtggtgagacaaagagaaaggagggcgttttcgccaccctcttgctaatgcttcaataactccccattgccctaatgagctcaccatcagagcctgattaagacctttggaggccctaaaattataagacccactatctccatcaatgtaattaaaaaaaaaacaactttaaatggaactttaccaaaaagccga

SEQ ID NO: 63770 - DNA, 324 bp, Homo sapiens
gaaactaagggctgccaccaacagcccacatccacttgccagctctgagagcaaatagatcctgcaggcctagtcaagcctcatttgactgacgcctcagtcaacatcttgactgcaagcccatgcaaaacactgagccagaaaccacccacccaagaagctgtgaattcctgactggcaaaaaatgtgagtgattataaatatttattatacttttaagccactactttttggagtattgtgttaggcagcagtaaataactaatacaataatcattgcttcctgtttgtaatgacaaaaaagagaaagaaaataaaaaattt

SEQ ID NO: 63771 - DNA, 661 bp, Homo sapiens
  misc_feature (226)..(226): n is a, c, g, or t
gatcattggcggctgcacgaaggatgaacggtttgtggcagaggtgacctgcctggaccccctgaggcgcagccgcctggaggtggccaagctcccgctaacagagcatgagctggagagtgagaataagaagtgggtggagtttgcatgcgtgacattgaaaaatgaggtctacatctcaggtggcaaagaaacacagcatgatgtttggaaatataattcttcnatcaacaagtggattcagattgagtatttaaacataggccgctggaggcataagatggtggtgttgggtggcaaggtctatgtgatcggaggctttgacggcttacagagaatcaacaacgtggagacctacgacccctttcacaactgctggtcagaggtataggacacgatttctaccagtaactgcctgtattattacttcagtgcttttttaaaaagctttggaacgtgcctgccgtggtggtcagctttctgatcactttacttccaaggagaacagttttggtggctctgagcttccctcctcctaggagctattgcttcagtattgctgatcaagtcacagaaacaatgtccttccaagtggtgaaggtctgtgtgggcacctgtcctaatttggacagaaccccagatgtgcacagaggctcaccct

SEQ ID NO: 63772 - DNA, 4342 bp, Homo sapiens
  misc_feature (226)..(226): n is a, c, g, or t
  misc_feature (579)..(579): n is a, c, g, or t
  misc_feature (2140)..(2140): n is a, c, g, or t
gatcattggcggctgcacgaaggatgaacggtttgtggcagaggtgacctgcctggaccccctgaggcgcagccgcctggaggtggccaagctcccgctaacagagcatgagctggagagtgagaataagaagtgggtggagtttgcatgcgtgacattgaaaaatgaggtctacatctcaggtggcaaagaaacacagcatgatgtttggaaatataattcttcnatcaacaagtggattcagattgagtatttaaacataggccgctggaggcataagatggtggtgttgggtggcaaggtctatgtgatcggaggctttgacggcttacagagaatcaacaacgtggagacctacgacccctttcacaactgctggtcagaggccgcacccctccttgtccatgtcagttcctttgcagccaccagccataagaagaagctgtatgtgatcgggggagggcccaatgggaaactggccacagacaagactcagtgttatgacccttccaccaacaagtggagtttgaaggcggccatgcccgtggaggctaaatgcatcaatgcagtgagtttccnggaccgcatctatgtcgttggtggggccatgagagcgctgtacgcctacagcccgctggaagacagctggtgcctggtgacccagctcagccacgagcgggccagctgcggtatcgcgccctgcaacaaccggctctacatcaccggcgggcgggacgagaagaacgaggttatcgccacggtgctgtgctgggaccccgaggcccagaaactgacagaggagtgcgtcctgccccggggcgtgtcgcaccacggcagcgtcaccatcaggaagtcgtacacccacatccgcaggatcgtgcccggagcagtgtctgtctgacggcaggatggggagctggagagcccccccgaccctcagcgtacccgcctcacctctcaccctcctccagtcccacttcaggcagcaggctcgagtttgaggccatacatcaggggatccccttgactcactttgggggaaccttggaagtcacagtttggggtcacttgagaccggccaggaatgtttgcatgacctacctcaggaggggaggcgaggaagagtaatatttagcattcaggacccacccaccctatgccggcttctgtgccaggcacttccttttatcggttcatttaacctggtgactggctcttatcacttctagtttacaggtgagggaaccaagtttcacagaggctggtcttgaacgcctgaccttgtgatctgcccgcctcggcctcccgaagtgctgggattacaggtgtgagccactgggcccggtctttttttttttaaatgatcataagatggcccattttggaccggaactgtcattgccagacagaattgtacctttagcacattctggtgccctggcctcttagtgttcaccagttgtactgcaatatagacaagatgtctctagagactcaaactactgttttattaaaaaagtaaacacctgagcacagctggcctacacaggagcgacagattctccttgatggtacactttctagtttttacacagtgatttaggtccacgttcctgataccccatcctcctgaagccttcgttttcaagacttttaaaaagcacttctacttggttttttgatcagtgtagctcaattgtgacttaaagaacagaatctgtccttcactgtaagagctacagctttcaaatgagctcactggaaattcattctaatccccaagctggagaaacaggttaagagatcctgtttcatatgctgtatttaaaaagcaacaatgataacaacatagtaactgcgttacccaatggactttattttcatcatatgatttcaattctctttatagagttttatttcatatccggtgtggcttgttcttttcagcagtttgggaagttagttattagagttgatagtgaattgaattttcattaaacagtcacggttagaagaagctaatatttgaaacagattttaaaaacttgaaaaattacaggtgagatttctgtttatgccagattattgaagataaatataaatgtatgttggtgtgtgaaatgctctgtgccttagaagngtgacagttcagctctctgctgtggaaagtaacacagggcaatagaaacatatttgtggaattttagaacaaactattgctgactcatgagcactataataaccatcaggaagctcccaactgaagcaatgtaacagtgtaatctagttcaattcagcaaacattcatggagttcttcatgtctgtcaagccttgaggacacccacgaatggcaaatctccacgctagacactcaatacaggtaaataggccaccagttaatattcttgtttttattttcttcaagttagctaaaaatgagatgcgtatgaagtgaggaggctggatccaagtcttgattgcctttcagggggtcaaggtggtaagctgtgcagtgaagtcaaccagtggccatggcttacatgtttgtctctttgagatcgccaccagaaccatttgtgaactgatttgtgaaggaaaagtcagtcttactccaaagactattgcagggaggaacttccagagaggaaatccaatgacaatggtactggcatacacagggagcctcccttcaaaaagacagcgcccctagtcagggaggggatggcggtcctttgataagacccataggcaaacttcgagcccatcagcaggtcaaccctatgctgggaaagtgaggatttgggatttctgtgctataaacctgattctaaatgtaggacccaagtttctggactacttcagaatacctaaatgaatcatggaaacactctttatgattttttacaacaccagatatgcaggtgaattgtggaaaatgtcatgtagctgacactcaagaaatagggattcctaataatggcatgggtagggaacagatacacctggttagaaggtctagggttctgtatatgaagctgccagtctgtagctcttcgagaaagaaagttcaagtcatttgggggaaacttaagaatagtcatcagggttttagcttctaggcaccagccaaggatgagaacttctaaaatctaaaatccatttcaagaaataaagacgaacacatttgcaggaaggtaactgttataacccacaccatcagcagggggaaagccaagctgagaataaacccagagacaaagaaccctcggactcaggcaggacatggcaggatgttctggcacagcagactggagactgaggcagggcctgtgagtggacagagcacccctggctgggaagaagaagatggggtaggaggaggtcaggttccaaggatgcaggtctggaaaatgatatcggaggccctggagtttgtgagcttggctctagtcccaagaagggtgagggagaataagggtaagggagtattctaggcaaggaactaaggaaggaatccccttcttagagcagaggcacaagttagagcaggcccagcatttgggccaacttactgtggggcctctgagctgctcagctgggtctcctgtcctagagggaaggtggcccagagtctttggtggagcggaatctgtagatgaggttaagggactccagttgccaaggttgatctgaaacaggcagggagctaagctcatcagaacaccaacagattcatgttctcgtcttagctttcatctattctggtctcaatggcttcgggaaacacacatatacacatacaccatgcccttgaactcaaagcaaactacgctctcagggaaatacaaatatcacgttcttatagctgtaaagtatagcttagctatttatagaagactatgaggtactgttgtgagttatttgcttatcctgttttattctgaaaaatgaaagtgctcaatagaatttttaacgttggcaacaccataaggatttcttatgttaagtcccaacttggggttgcaaaatcattttttcccttaatacctgggtgttgtattagatctcataatttgacaagttaaccttttagaaatccacatatatctcaaatctggctactgcaaaaccagttttgacaggtcagattttcatatgtataggtataaatagccaacactcagtgaacaaaatcctttaagcattttggttacataaagttgtatgttttaagtgatcaaactaagaatattgtttataggttttaaaaaccaaaccaataaaatttttatttattcaataaaatatgcacagaacagatgcaaatgtgttatatacaat

SEQ ID NO: 63773 - DNA, 3114 bp, Homo sapiens
  misc_feature (912)..(912): n is a, c, g, or t
tagtagagacggggtttcaccatcttggccaggctggtcttgaacgcctgaccttgtgatctgcccgcctcggcctcccgaagtgctgggattacaggtgtgagccactgggcccggtctttttttttttaaatgatcataagatggcccattttggaccggaactgtcattgccagacagaattgtacctttagcacattctggtgccctggcctcttagtgttcaccagttgtactgcaatatagacaagatgtctctagagactcaaactactgttttattaaaaaagtaaacacctgagcacagctggcctacacaggagcgacagattctccttgatggtacactttctagtttttacacagtgatttaggtccacgttcctgataccccatcctcctgaagccttcgttttcaagacttttaaaaagcacttctacttggttttttgatcagtgtagctcaattgtgacttaaagaacagaatctgtccttcactgtaagagctacagctttcaaatgagctcactggaaattcattctaatccccaagctggagaaacaggttaagagatcctgtttcatatgctgtatttaaaaagcaacaatgataacaacatagtaactgcgttacccaatggactttattttcatcatatgatttcaattctctttatagagttttatttcatatccggtgtggcttgttcttttcagcagtttgggaagttagttattagagttgatagtgaattgaattttcattaaacagtcacggttagaagaagctaatatttgaaacagattttaaaaacttgaaaaattacaggtgagatttctgtttatgccagattattgaagataaatataaatgtatgttggtgtgtgaaatgctctgtgccttagaagngtgacagttcagctctctgctgtggaaagtaacacagggcaatagaaacatatttgtggaattttagaacaaactattgctgactcatgagcactataataaccatcaggaagctcccaactgaagcaatgtaacagtgtaatctagttcaattcagcaaacattcatggagttcttcatgtctgtcaagccttgaggacacccacgaatggcaaatctccacgctagacactcaatacaggtaaataggccaccagttaatattcttgtttttattttcttcaagttagctaaaaatgagatgcgtatgaagtgaggaggctggatccaagtcttgattgcctttcagggggtcaaggtggtaagctgtgcagtgaagtcaaccagtggccatggcttacatgtttgtctctttgagatcgccaccagaaccatttgtgaactgatttgtgaaggaaaagtcagtcttactccaaagactattgcagggaggaacttccagagaggaaatccaatgacaatggtactggcatacacagggagcctcccttcaaaaagacagcgcccctagtcagggaggggatggcggtcctttgataagacccataggcaaacttcgagcccatcagcaggtcaaccctatgctgggaaagtgaggatttgggatttctgtgctataaacctgattctaaatgtaggacccaagtttctggactacttcagaatacctaaatgaatcatggaaacactctttatgattttttacaacaccagatatgcaggtgaattgtggaaaatgtcatgtagctgacactcaagaaatagggattcctaataatggcatgggtagggaacagatacacctggttagaaggtctagggttctgtatatgaagctgccagtctgtagctcttcgagaaagaaagttcaagtcatttgggggaaacttaagaatagtcatcagggttttagcttctaggcaccagccaaggatgagaacttctaaaatctaaaatccatttcaagaaataaagacgaacacatttgcaggaaggtaactgttataacccacaccatcagcagggggaaagccaagctgagaataaacccagagacaaagaaccctcggactcaggcaggacatggcaggatgttctggcacagcagactggagactgaggcagggcctgtgagtggacagagcacccctggctgggaagaagaagatggggtaggaggaggtcaggttccaaggatgcaggtctggaaaatgatatcggaggccctggagtttgtgagcttggctctagtcccaagaagggtgagggagaataagggtaagggagtattctaggcaaggaactaaggaaggaatccccttcttagagcagaggcacaagttagagcaggcccagcatttgggccaacttactgtggggcctctgagctgctcagctgggtctcctgtcctagagggaaggtggcccagagtctttggtggagcggaatctgtagatgaggttaagggactccagttgccaaggttgatctgaaacaggcagggagctaagctcatcagaacaccaacagattcatgttctcgtcttagctttcatctattctggtctcaatggcttcgggaaacacacatatacacatacaccatgcccttgaactcaaagcaaactacgctctcagggaaatacaaatatcacgttcttatagctgtaaagtatagcttagctatttatagaagactatgaggtactgttgtgagttatttgcttatcctgttttattctgaaaaatgaaagtgctcaatagaatttttaacgttggcaacaccataaggatttcttatgttaagtcccaacttggggttgcaaaatcattttttcccttaatacctgggtgttgtattagatctcataatttgacaagttaaccttttagaaatccacatatatctcaaatctggctactgcaaaaccagttttgacaggtcagattttcatatgtataggtataaatagccaacactcagtgaacaaaatcctttaagcattttggttacataaagttgtatgttttaagtgatcaaactaagaatattgtttataggttttaaaaaccaaaccaataaaatttttatttattcaataaaatatgcacagaacagatgcaaatgtgttatatacaat

SEQ ID NO: 63774 - DNA, 1820 bp, Homo sapiens
  misc_feature (4)..(4): n is a, c, g, or t
aaanaaaattaggctaggtacgaggctgggtggtgatctgccgacagaaccatttgtgaactgatttgtgaaggaaaagtcagtcttactccaaagactattgcagggaggaacttccagagaggaaatccaatgacaatggtactggcatacacagggagcctcccttcaaaaagacagcgcccctagtcagggaggggatggcggtcctttgataagacccataggcaaacttcgagcccatcagcaggtcaaccctatgctgggaaagtgaggatttgggatttctgtgctataaacctgattctaaatgtaggacccaagtttctggactacttcagaatacctaaatgaatcatggaaacactctttatgattttttacaacaccagatatgcaggtgaattgtggaaaatgtcatgtagctgacactcaagaaatagggattcctaataatggcatgggtagggaacagatacacctggttagaaggtctagggttctgtatatgaagctgccagtctgtagctcttcgagaaagaaagttcaagtcatttgggggaaacttaagaatagtcatcagggttttagcttctaggcaccagccaaggatgagaacttctaaaatctaaaatccatttcaagaaataaagacgaacacatttgcaggaaggtaactgttataacccacaccatcagcagggggaaagccaagctgagaataaacccagagacaaagaaccctcggactcaggcaggacatggcaggatgttctggcacagcagactggagactgaggcagggcctgtgagtggacagagcacccctggctgggaagaagaagatggggtaggaggaggtcaggttccaaggatgcaggtctggaaaatgatatcggaggccctggagtttgtgagcttggctctagtcccaagaagggtgagggagaataagggtaagggagtattctaggcaaggaactaaggaaggaatccccttcttagagcagaggcacaagttagagcaggcccagcatttgggccaacttactgtggggcctctgagctgctcagctgggtctcctgtcctagagggaaggtggcccagagtctttggtggagcggaatctgtagatgaggttaagggactccagttgccaaggttgatctgaaacaggcagggagctaagctcatcagaacaccaacagattcatgttctcgtcttagctttcatctattctggtctcaatggcttcgggaaacacacatatacacatacaccatgcccttgaactcaaagcaaactacgctctcagggaaatacaaatatcacgttcttatagctgtaaagtatagcttagctatttatagaagactatgaggtactgttgtgagttatttgcttatcctgttttattctgaaaaatgaaagtgctcaatagaatttttaacgttggcaacaccataaggatttcttatgttaagtcccaacttggggttgcaaaatcattttttcccttaatacctgggtgttgtattagatctcataatttgacaagttaaccttttagaaatccacatatatctcaaatctggctactgcaaaaccagttttgacaggtcagattttcatatgtataggtataaatagccaacactcagtgaacaaaatcctttaagcattttggttacataaagttgtatgttttaagtgatcaaactaagaatattgtttataggttttaaaaaccaaaccaataaaatttttatttattcaataaaatatgcacagaacagatgcaaatgtgttatatacaat

SEQ ID NO: 63775 - DNA, 1807 bp, Homo sapiens
  misc_feature (226)..(226): n is a, c, g, or t
  misc_feature (579)..(579): n is a, c, g, or t
gatcattggcggctgcacgaaggatgaacggtttgtggcagaggtgacctgcctggaccccctgaggcgcagccgcctggaggtggccaagctcccgctaacagagcatgagctggagagtgagaataagaagtgggtggagtttgcatgcgtgacattgaaaaatgaggtctacatctcaggtggcaaagaaacacagcatgatgtttggaaatataattcttcnatcaacaagtggattcagattgagtatttaaacataggccgctggaggcataagatggtggtgttgggtggcaaggtctatgtgatcggaggctttgacggcttacagagaatcaacaacgtggagacctacgacccctttcacaactgctggtcagaggccgcacccctccttgtccatgtcagttcctttgcagccaccagccataagaagaagctgtatgtgatcgggggagggcccaatgggaaactggccacagacaagactcagtgttatgacccttccaccaacaagtggagtttgaaggcggccatgcccgtggaggctaaatgcatcaatgcagtgagtttccnggaccgcatctatgtcgttggtggggccatgagagcgctgtacgcctacagcccgctggaagacagctggtgcctggtgacccagctcagccacgagcgggccagctgcggtatcgcgccctgcaacaaccggctctacatcaccggcgggcgggacgagaagaacgaggttatcgccacggtgctgtgctgggaccccgaggcccagaaactgacagaggagtgcgtcctgccccggggcgtgtcgcaccacggcagcgtcaccatcaggaagtcgtacacccacatccgcaggatcgtgcccggagcagtgtctgtctgacggcaggatggggagctggagagcccccccgaccctcagcgtacccgcctcacctctcaccctcctccagtcccacttcaggcagcaggctcgagtttgaggccatacatcaggggatccccttgactcactttgggggaaccttggaagtcacagtttggggtcacttgagaccggccaggaatgtttgcatgacctacctcaggaggggaggcgaggaagagtaatatttagcattcaggacccacccaccctatgccggcttctgtgccaggcacttccttttatcggttcatttaacctggtgactggctcttatcacttctagtttacaggtgagggaaccaagtttcacagaggctaagtggcgtgcccctgatcactcagatagcaagtagctaccccaggagtctaaaatccaggtctttcatctccgaagtcaatgctctttccaccatgctgcctatctcagagcaggaaaaacaaacaaaaaacaacaacaaaacctggctcgtgctgggcgtggcggctcacgcctgtaatcccagccctatgggaggctgaggcgggcggatgacctgaggtcaggagttcaagaccagcctggccaacatggtgagaccgccccgtctctactaaaaatacaaaaattagccgcgtgcagtggcaggcgcctgtaattccagctactcaggaggctgaggcaggaggatcacttgaacttgggaggtggaggttgcagtgagccgagatcgccacactgcactgcagcccgggaaacaaaagtgaagctctgtctccaaaacaaaaacaaaaacaaagaaacctggctcatttcttgtttcggcaagtctgctaaaagattcactcagcacagcagggaaataaaggtgtttcctgctttct

SEQ ID NO: 63776 - DNA, 982 bp, Homo sapiens
  misc_feature (226)..(226): n is a, c, g, or t
  misc_feature (579)..(579): n is a, c, g, or t
gatcattggcggctgcacgaaggatgaacggtttgtggcagaggtgacctgcctggaccccctgaggcgcagccgcctggaggtggccaagctcccgctaacagagcatgagctggagagtgagaataagaagtgggtggagtttgcatgcgtgacattgaaaaatgaggtctacatctcaggtggcaaagaaacacagcatgatgtttggaaatataattcttcnatcaacaagtggattcagattgagtatttaaacataggccgctggaggcataagatggtggtgttgggtggcaaggtctatgtgatcggaggctttgacggcttacagagaatcaacaacgtggagacctacgacccctttcacaactgctggtcagaggccgcacccctccttgtccatgtcagttcctttgcagccaccagccataagaagaagctgtatgtgatcgggggagggcccaatgggaaactggccacagacaagactcagtgttatgacccttccaccaacaagtggagtttgaaggcggccatgcccgtggaggctaaatgcatcaatgcagtgagtttccnggaccgcatctatgtcgttggtggggccatgagagcgctgtacgcctacagcccgctggaagacagctggtgcctggtgacccagctcagccacgagcgggccagctgcggtatcgcgccctgcaacaaccggctctacatcaccggcgggcgggacgagaagaacgaggttatcgccacggtgctgtgctgggaccccgaggcccagaaactgacagaggagtgcgtcctgccccggggcgtgtcgcaccacggcagcgtcaccatcaggaagtcgtacacccacatccgcaggatcgtgcccggagcagtgtctgtctgacggcaggatggggagctggagagcccccccgacctcaccccggatgcccgggaccttgtcaaaaagtttctgaaacggaag

SEQ ID NO: 63777 - DNA, 4542 bp, Homo sapiens
  misc_feature (226)..(226): n is a, c, g, or t
  misc_feature (579)..(579): n is a, c, g, or t
  misc_feature (2340)..(2340): n is a, c, g, or t
gatcattggcggctgcacgaaggatgaacggtttgtggcagaggtgacctgcctggaccccctgaggcgcagccgcctggaggtggccaagctcccgctaacagagcatgagctggagagtgagaataagaagtgggtggagtttgcatgcgtgacattgaaaaatgaggtctacatctcaggtggcaaagaaacacagcatgatgtttggaaatataattcttcnatcaacaagtggattcagattgagtatttaaacataggccgctggaggcataagatggtggtgttgggtggcaaggtctatgtgatcggaggctttgacggcttacagagaatcaacaacgtggagacctacgacccctttcacaactgctggtcagaggccgcacccctccttgtccatgtcagttcctttgcagccaccagccataagaagaagctgtatgtgatcgggggagggcccaatgggaaactggccacagacaagactcagtgttatgacccttccaccaacaagtggagtttgaaggcggccatgcccgtggaggctaaatgcatcaatgcagtgagtttccnggaccgcatctatgtcgttggtggggccatgagagcgctgtacgcctacagcccgctggaagacagctggtgcctggtgacccagctcagccacgagcgggccagctgcggtatcgcgccctgcaacaaccggctctacatcaccggcgggcgggacgagaagaacgaggttatcgccacggtgctgtgctgggaccccgaggcccagaaactgacagaggagtgcgtcctgccccggggcgtgtcgcaccacggcagcgtcaccatcaggaagtcgtacacccacatccgcaggatcgtgcccggagcagtgtctgtctgacggcaggatggggagctggagagcccccccgaccctcagcgtacccgcctcacctctcaccctcctccagtcccacttcaggcagcaggctcgagtttgaggccatacatcaggggatccccttgactcactttgggggaaccttggaagtcacagtttggggtcacttgagaccggccaggaatgtttgcatgacctacctcaggaggggaggcgaggaagagtaatatttagcattcaggacccacccaccctatgccggcttctgtgccaggcacttccttttatcggttcatttaacctggtgactggctcttatcacttctagtttacaggtgagggaaccaagtttcacagaggctaagtggcgtgcccctgatcactcagatagcaagtagctaccccaggagtctaaaatccaggtctttcatctccgaagtcaatgctctttccaccatgctgcctatctcagagcaggaaaaacaaacaaaaaacaacaacaaaacctggctcgtgctgggcgtggcggctcacgcctgtaatcccagccctatgggaggctggtcttgaacgcctgaccttgtgatctgcccgcctcggcctcccgaagtgctgggattacaggtgtgagccactgggcccggtctttttttttttaaatgatcataagatggcccattttggaccggaactgtcattgccagacagaattgtacctttagcacattctggtgccctggcctcttagtgttcaccagttgtactgcaatatagacaagatgtctctagagactcaaactactgttttattaaaaaagtaaacacctgagcacagctggcctacacaggagcgacagattctccttgatggtacactttctagtttttacacagtgatttaggtccacgttcctgataccccatcctcctgaagccttcgttttcaagacttttaaaaagcacttctacttggttttttgatcagtgtagctcaattgtgacttaaagaacagaatctgtccttcactgtaagagctacagctttcaaatgagctcactggaaattcattctaatccccaagctggagaaacaggttaagagatcctgtttcatatgctgtatttaaaaagcaacaatgataacaacatagtaactgcgttacccaatggactttattttcatcatatgatttcaattctctttatagagttttatttcatatccggtgtggcttgttcttttcagcagtttgggaagttagttattagagttgatagtgaattgaattttcattaaacagtcacggttagaagaagctaatatttgaaacagattttaaaaacttgaaaaattacaggtgagatttctgtttatgccagattattgaagataaatataaatgtatgttggtgtgtgaaatgctctgtgccttagaagngtgacagttcagctctctgctgtggaaagtaacacagggcaatagaaacatatttgtggaattttagaacaaactattgctgactcatgagcactataataaccatcaggaagctcccaactgaagcaatgtaacagtgtaatctagttcaattcagcaaacattcatggagttcttcatgtctgtcaagccttgaggacacccacgaatggcaaatctccacgctagacactcaatacaggtaaataggccaccagttaatattcttgtttttattttcttcaagttagctaaaaatgagatgcgtatgaagtgaggaggctggatccaagtcttgattgcctttcagggggtcaaggtggtaagctgtgcagtgaagtcaaccagtggccatggcttacatgtttgtctctttgagatcgccaccagaaccatttgtgaactgatttgtgaaggaaaagtcagtcttactccaaagactattgcagggaggaacttccagagaggaaatccaatgacaatggtactggcatacacagggagcctcccttcaaaaagacagcgcccctagtcagggaggggatggcggtcctttgataagacccataggcaaacttcgagcccatcagcaggtcaaccctatgctgggaaagtgaggatttgggatttctgtgctataaacctgattctaaatgtaggacccaagtttctggactacttcagaatacctaaatgaatcatggaaacactctttatgattttttacaacaccagatatgcaggtgaattgtggaaaatgtcatgtagctgacactcaagaaatagggattcctaataatggcatgggtagggaacagatacacctggttagaaggtctagggttctgtatatgaagctgccagtctgtagctcttcgagaaagaaagttcaagtcatttgggggaaacttaagaatagtcatcagggttttagcttctaggcaccagccaaggatgagaacttctaaaatctaaaatccatttcaagaaataaagacgaacacatttgcaggaaggtaactgttataacccacaccatcagcagggggaaagccaagctgagaataaacccagagacaaagaaccctcggactcaggcaggacatggcaggatgttctggcacagcagactggagactgaggcagggcctgtgagtggacagagcacccctggctgggaagaagaagatggggtaggaggaggtcaggttccaaggatgcaggtctggaaaatgatatcggaggccctggagtttgtgagcttggctctagtcccaagaagggtgagggagaataagggtaagggagtattctaggcaaggaactaaggaaggaatccccttcttagagcagaggcacaagttagagcaggcccagcatttgggccaacttactgtggggcctctgagctgctcagctgggtctcctgtcctagagggaaggtggcccagagtctttggtggagcggaatctgtagatgaggttaagggactccagttgccaaggttgatctgaaacaggcagggagctaagctcatcagaacaccaacagattcatgttctcgtcttagctttcatctattctggtctcaatggcttcgggaaacacacatatacacatacaccatgcccttgaactcaaagcaaactacgctctcagggaaatacaaatatcacgttcttatagctgtaaagtatagcttagctatttatagaagactatgaggtactgttgtgagttatttgcttatcctgttttattctgaaaaatgaaagtgctcaatagaatttttaacgttggcaacaccataaggatttcttatgttaagtcccaacttggggttgcaaaatcattttttcccttaatacctgggtgttgtattagatctcataatttgacaagttaaccttttagaaatccacatatatctcaaatctggctactgcaaaaccagttttgacaggtcagattttcatatgtataggtataaatagccaacactcagtgaacaaaatcctttaagcattttggttacataaagttgtatgttttaagtgatcaaactaagaatattgtttataggttttaaaaaccaaaccaataaaatttttatttattcaataaaatatgcacagaacagatgcaaatgtgttatatacaat

SEQ ID NO: 63778 - DNA, 841 bp, Homo sapiens
  misc_feature (28)..(28): n is a, c, g, or t
cagcaaagtgaggtgacgtcccaccccnagggtgtgttggaggtaaaatcccggggagccactgaagggggaggtaaagtgggaggtgaaggggcccacagggaggctggaggggagtggcaagccccgagtctgaccttcagcgtgagccaccgcgcccggccaaaattattttttttaaagggtgtgtagagccacccaccttgaaatgatctatcaagggtgacagccagcccaaggccatcttacaagggaataaaagccctaccctccctctcctgactttgtctccagccagggatttctactgacaacccagccacaagctggaagaaggagatctattgatatagggtggaccttgggactggtgggaaagggtggagagtacaacatattcagctcagtagtggagatggaaagaggcaacagactcaaacttaagggatttcaaggcgggcagatcacttgaggccaggagttcgagaccagcctggccagctgaggcatgagaattgcttgcgcccccaggaggtgggggttgcagtgagccgagatcacaccagtatactccagcctgggtgacagagcaaaacttgtctcaaaaaaaaaaaaaaaaaaaaagagagagagattaaaggatcggatttggggagtgagggagatttttggcttgaacaatttggtggcctgttgtttgaggggtgacactagaagagggtctaccttgtggggtgggtaacatcatgttccgtttccagtgcgtttggggtgcctggagacatccgagtataaatgccaataagccacttgattggataggtctggggctggggtagcg

SEQ ID NO: 63779 - DNA, 531 bp, Homo sapiens
  misc_feature (28)..(28): n is a, c, g, or t
cagcaaagtgaggtgacgtcccaccccnagggtgtgttggaggtaaaatcccggggagccactgaagggggaggtaaagtgggaggtgaaggggcccacagggaggctggaggggagtggcaagccccgagtctgaccttcagcgtgagccaccgcgcccggccaaaattattttttttaaagggtgtgtagagccacccaccttgaaatgatctatcaagggtgacagccagcccaaggccatcttacaagggaataaaagccctaccctccctctcctgactttgtctccagccagggatttctactgacaacccagccacaagctggaagaaggagatctattgatatagggtggaccttgggactggtgggaaagggtggagagtacaacatattcagctcagtagtggagatggaaagaggcaacagactcaaacttaagggatttcaaggcgggcagatctgctgctcggcctcccaaagtgctgggattacaggcataagcatcatgcccggcttgaattctgt

SEQ ID NO: 63780 - DNA, 1274 bp, Homo sapiens
  misc_feature (202)..(202): n is a, c, g, or t
  misc_feature (1044)..(1044): n is a, c, g, or t
  misc_feature (1263)..(1264): n is a, c, g, or t
aattaattttgattacatttaaaattctatatggcaaaaataccataattaaagataaaaggcaaagaacaaattgggaaaaatatttttcaacatatataaccaagggctaatttctctaacacctaaaaagttcttataaatcaataaaaagaaaaccaacatctcaatggaaaaagaacaaagctcataaagagttcanagaaaaaggatatacaaatggctttaaacatgtgaaagaatgttcaacttcactcacaataagaaaaaatacaaattatgagttgcttcagcatcctggtgttgctgtgccgtgggtcctgtgcggtcacttagccaagatgcctgaggaaacccagacccaagaccaaccgatggaggaggaggaggttgagacattcgcctttcaggcagaaattgcccagttgatgtcattgatcatcaatactttctactcgaacaaagagatctttctgagagagctcatttcaaattcatcagatgcattggacaaaatctggtatgaaagcttgacagatcccagtaaattagactctgggaaagagctgcatattaaccttataccaaacaaacaagatcaaactctcactattgtggatactggaattggaatgaccaaggctgacttgatcaataaccttggtactatcgccaagtctgggaccaaagcgttcatggaagctttgcaggctggtgcagatatctctatgattggccagttcggtgttagtttttattctgcttatttggttgctgagaaagtaactgtgatcaccaaacataatgatgatgagcagtacgcctgggagtcctcagcagggggatcattcacagtgaggacagacacaggtgaacgtatgggtcgtggaacaaaggttatcctacacctgaaagaagaccaaactgagtacttggaggaacaaagaataaaggagattgtgaagaaacattctcagcttattggatatcccattactctttttgtggagaaggaatgtgataaagaagtcagcgacgatgagnctgaagaaaaggaagacaaagaagaagaaaaagaaaaagaagagaaagagtccaaagacaaacctgaaattgaagatgttggttctgatgaggaagaagaaaagaaggatggtgacaagaagaagaagaagactaaggaaaagtacatcgaccaagaagaactcaacaaaacaaagcccatctggaccagaaatcccgacgatattactaatgaggagnncggagaattc

SEQ ID NO: 63781 - DNA, 3371 bp, Homo sapiens
aactccaggaatttgtggcggagagggcaaataactgcggctctcccggcgccccgatgctcgcaccatgtcgaggcgcaagcaggcgaaaccccagcacatcaactcggaggaggaccagggcgagcagcagccgcagcagcagaccccggagtttgcagatgcggccccagcggcgcccgcggcgggggagctgggtgctccagtgaaccacccagggaatgacgaggtggcgagtgaggatgaagccacagtaaagcggcttcgtcgggaggagacgcacgtctgtgagaaatgctgtgcggagttcttcagcatctctgagttcctggaacataagaaaaattgcactaaaaatccacctgtcctcatcatgaatgacagcgaggggcctgtgccttcagaagacttctccggagctgtactgagccaccagcccaccagtcccggcagtaaggactgtcacagggagaatggcggcagctcagaggacatgaaggagaagccggatgcggagtctgtggtgtacctaaagacagagacagccctgccacccaccccccaggacataagctatttagccaaaggcaaagtggccaacactaatgtgaccttgcaggcactacggggcaccaaggtggcggtgaatcagcggagcgcggatgcactccctgcccccgtgcctggtgccaacagcatcccgtgggtcctcgagcagatcttgtgtctgcagcagcagcagctacagcagatccagctcaccgagcagatccgcatccaggtgaacatgtgggcctcccacgccctccactcaagcggggcaggggccgacactctgaagaccttgggcagccacatgtctcagcaggtttctgcagctgtggctttgctcagccagaaagctggaagccaaggtctgtctctggatgccttgaaacaagccaagctacctcacgccaacatcccttctgccaccagctccctgtccccagggctggcacccttcactctgaagccggatgggacccgggtgctcccgaacgtcatgtcccgcctcccgagcgctttgcttcctcaggccccgggctcggtgctcttccagagccctttctccactgtggcgctagacacatccaagaaagggaaggggaagccaccgaacatctccgcggtggatgtcaaacccaaagacgaggcggccctctacaagcacaagtgtaagtactgtagcaaggtttttgggactgatagctccttgcagatccacctccgctcccacactggagagagacccttcgtgtgctctgtctgtggtcatcgcttcaccaccaagggcaacctcaaggtgcactttcaccgacatccccaggtgaaggcaaacccccagctgtttgccgagttccaggacaaagtggcggccggcaatggcatcccctatgcactctctgtacctgaccccatagatgaaccgagtctttctttagacagcaaacctgtccttgtaaccacctctgtagggctacctcagaatctttcttcggggactaatcccaaggacctcacgggtggctccttgcccggtgacctgcagcctgggccttctccagaaagtgagggtggacccctgagccagggtcagagaccctgaaattgcagcagttggtggagaacattgacaaggccaccactgatcccaacgaatgtctcatttgccaccgagtcttaagctgtcagagctccctcaagatgcattatcgcacccacaccggggagagaccgttccagtgtaagatctgtggccgagccttttctaccaaaggtaacctgaagacacaccttggggttcaccgaaccaacacatccattaagacgcagcattcgtgccccatctgccagaagaagttcactaatgccgtgatgctgcagcaacatattcggatgcacatgggcggtcagattcccaacacgcccctgccagagaatccctgtgactttacgggttctgagccaatgaccgtgggtgagaacggcagcaccggcgctatctgccatgatgatgtcatcgaaagcatcgatgtagaggaagtcagctcccaggaggctcccagcagctcctccaaggtccccacgcctcttcccagcatccactcggcatcacccacgctagggtttgccatgatggcttccttagatgccccagggaaagtgggtcctgccccttttaacctgcagcgccagggcagcagagaaaacggttccgtggagagcgatggcttgaccaacgactcatcctcgctgatgggagaccaggagtatcagagccgaagcccagatatcctggaaaccacatccttccaggcactctccccggccaatagtcaagccgaaagcatcaagtcaaagtctcccgatgctgggagcaaagcagagagctccgagaacagccgcactgagatggaaggtcggagcagtctcccttccacgtttatccgagccccgccgacctatgtcaaggttgaagttcctggcacatttgtgggaccctcgacattgtccccagggatgacccctttgttagcagcccagccacgccgacaggccaagcaacatggctgcacacggtgtgggaagaacttctcgtctgctagcgctcttcagatccacgagcggactcacactggagagaagccttttgtgtgcaacatttgtgggcgagcttttaccaccaaaggcaacttaaaggttcactacatgacacacggggcgaacaataactcagcccgccgtggaaggaagttggccatcgagaacaccatggctctgttaggtacggacggaaaaagagtctcagaaatctttcccaaggaaatcctggccccttcagtgaatgtggaccctgttgtgtggaaccagtacaccagcatgctcaatggcggtctggccgtgaagaccaatgagatctctgtgatccagagtgggggggttcctaccctcccggtttccttgggggccacctccgttgtgaataacgccactgtctccaagatggatggctcccagtcgggtatcagtgcagatgtggaaaaaccaagtgctactgacggcgttcccaaacaccagtttcctcacttcctggaagaaaacaagattgcggtcagctaagggagaacttgcgtggaaggagcaatgcagacacagtgaaatctctagaatctgctttgttttgtaagaactcatctcctcctgttttctttttcttactgatatgcaaatgatgtttactacgttggttgtgaccacaacctcaggcaagtgctacaatcacgattgttgctatgctgctttgcaaaaagttgaaaaaataaaaaaaa

SEQ ID NO: 63782 - DNA, 3438 bp, Homo sapiens
aactccaggaatttgtggcggagagggcaaataactgcggctctcccggcgccccgatgctcgcaccatgtcgaggcgcaagcaggcgaaaccccagcacatcaactcggaggaggaccagggcgagcagcagccgcagcagcagaccccggagtttgcagatgcggccccagcggcgcccgcggcgggggagctgggtgctccagtgaaccacccagggaatgacgaggtggcgagtgaggatgaagccacagtaaagcggcttcgtcgggaggagacgcacgtctgtgagaaatgctgtgcggagttcttcagcatctctgagttcctggaacataagaaaaattgcactaaaaatccacctgtcctcatcatgaatgacagcgaggggcctgtgccttcagaagacttctccggagctgtactgagccaccagcccaccagtcccggcagtaaggactgtcacagggagaatggcggcagctcagaggacatgaaggagaagccggatgcggagtctgtggtgtacctaaagacagagacagccctgccacccaccccccaggacataagctatttagccaaaggcaaagtggccaacactaatgtgaccttgcaggcactacggggcaccaaggtggcggtgaatcagcggagcgcggatgcactccctgcccccgtgcctggtgccaacagcatcccgtgggtcctcgagcagatcttgtgtctgcagcagcagcagctacagcagatccagctcaccgagcagatccgcatccaggtgaacatgtgggcctcccacgccctccactcaagcggggcaggggccgacactctgaagaccttgggcagccacatgtctcagcaggtttctgcagctgtggctttgctcagccagaaagctggaagccaaggtctgtctctggatgccttgaaacaagccaagctacctcacgccaacatcccttctgccaccagctccctgtccccagggctggcacccttcactctgaagccggatgggacccgggtgctcccgaacgtcatgtcccgcctcccgagcgctttgcttcctcaggccccgggctcggtgctcttccagagccctttctccactgtggcgctagacacatccaagaaagggaaggggaagccaccgaacatctccgcggtggatgtcaaacccaaagacgaggcggccctctacaagcacaagtgtaagtactgtagcaaggtttttgggactgatagctccttgcagatccacctccgctcccacactggagagagacccttcgtgtgctctgtctgtggtcatcgcttcaccaccaagggcaacctcaaggtgcactttcaccgacatccccaggtgaaggcaaacccccagctgtttgccgagttccaggacaaagtggcggccggcaatggcatcccctatgcactctctgtacctgaccccatagatgaaccgagtctttctttagacagcaaacctgtccttgtaaccacctctgtagggctacctcagaatctttcttcggggactaatcccaaggacctcacgggtggctccttgcccggtgacctgcagcctgggccttctccagaaagtgagggtggacccacactccctggggtgggaccaaactataattccccaagggctggtggcttccaagggagtgggacccctgagccagggtcagagaccctgaaattgcagcagttggtggagaacattgacaaggccaccactgatcccaacgaatgtctcatttgccaccgagtcttaagctgtcagagctccctcaagatgcattatcgcacccacaccggggagagaccgttccagtgtaagatctgtggccgagccttttctaccaaaggtaacctgaagacacaccttggggttcaccgaaccaacacatccattaagacgcagcattcgtgccccatctgccagaagaagttcactaatgccgtgatgctgcagcaacatattcggatgcacatgggcggtcagattcccaacacgcccctgccagagaatccctgtgactttacgggttctgagccaatgaccgtgggtgagaacggcagcaccggcgctatctgccatgatgatgtcatcgaaagcatcgatgtagaggaagtcagctcccaggaggctcccagcagctcctccaaggtccccacgcctcttcccagcatccactcggcatcacccacgctagggtttgccatgatggcttccttagatgccccagggaaagtgggtcctgccccttttaacctgcagcgccagggcagcagagaaaacggttccgtggagagcgatggcttgaccaacgactcatcctcgctgatgggagaccaggagtatcagagccgaagcccagatatcctggaaaccacatccttccaggcactctccccggccaatagtcaagccgaaagcatcaagtcaaagtctcccgatgctgggagcaaagcagagagctccgagaacagccgcactgagatggaaggtcggagcagtctcccttccacgtttatccgagccccgccgacctatgtcaaggttgaagttcctggcacatttgtgggaccctcgacattgtccccagggatgacccctttgttagcagcccagccacgccgacaggccaagcaacatggctgcacacggtgtgggaagaacttctcgtctgctagcgctcttcagatccacgagcggactcacactggagagaagccttttgtgtgcaacatttgtgggcgagcttttaccaccaaaggcaacttaaaggttcactacatgacacacggggcgaacaataactcagcccgccgtggaaggaagttggccatcgagaacaccatggctctgttaggtacggacggaaaaagagtctcagaaatctttcccaaggaaatcctggccccttcagtgaatgtggaccctgttgtgtggaaccagtacaccagcatgctcaatggcggtctggccgtgaagaccaatgagatctctgtgatccagagtgggggggttcctaccctcccggtttccttgggggccacctccgttgtgaataacgccactgtctccaagatggatggctcccagtcgggtatcagtgcagatgtggaaaaaccaagtgctactgacggcgttcccaaacaccagtttcctcacttcctggaagaaaacaagattgcggtcagctaagggagaacttgcgtggaaggagcaatgcagacacagtgaaatctctagaatctgctttgttttgtaagaactcatctcctcctgttttctttttcttactgatatgcaaatgatgtttactacgttggttgtgaccacaacctcaggcaagtgctacaatcacgattgttgctatgctgctttgcaaaaagttgaaaaaataaaaaaaa

SEQ ID NO: 63783 - DNA, 779 bp, Homo sapiens
acttggaaaccagagtttgtggaaagtgaagaagtgatgtgctggagccagaggctcagtgctgggctggggctggctggcctgacccaagccacctggttactcagagcccagcactgggtggaatccctggggtctacaggcattcacccatccccagaagcccagatgagtctctgaacagttggctgtgagtgagatgacctcagaaatggaagaggtcagtgccttagccagacaggcactgacatgaatgtcataggcatgctccagggccttctgagaaatggaaataccatctggatggaatgacctttatgcaacaaaaagtttaattaaaagaagtctcctcaacaggcattgaatattagtgctcgtcaagattcaaaagagatttcccttagaataattcctcaccacatatattgaggttctggagtgattcatcctaccctcatacataaatgtttgtgctaaccaggctgatgcaatgtgacttgtgtacataagcatttttaaaatggaaaagcaattctgggacaacaagggattctggaagtgtcaggaaaagggtaagttgaagaaaggacttttaattcaacaggtcttgggtagcagaagagatataagccttttaaagagagagaagctaattggtttctgataataggtgcctgttggaaagaaaatattgacctcttgggatggtttgggtttggcaaaggtgcatggtcatggtatctcagtgggatttgactcctcatttggatacaagttta

SEQ ID NO: 63784 - DNA, 328 bp, Homo sapiens
cagcagcacaatctaggctcactgaaacctcagcctcctgggttcaagcaattctcctgcctcagtcaccctacatagtcatcattctgacatcatctaaaagaaattagtatctgcattgcatccttaaagaagaagggacaaaagacatgtccaaactgtctgtctgttctagtggaataaaacattaatttaatatgtattttggacaaccaccaacctagagattggaaacttttctcaaggatatatctctctgtatgtgggctactggctttgtggcttttctgtaggaaaattaaaattctagttttgttctcccttatca

SEQ ID NO: 63785 - DNA, 386 bp, Homo sapiens
  misc_feature (4)..(4): n is a, c, g, or t
  misc_feature (41)..(41): n is a, c, g, or t
  misc_feature (106)..(106): n is a, c, g, or t
gaanaaaatcagattcactctctctcttctggagctgaaanaactttcttttccctgcccataggacatcaaggacccccaggttctctggtcttgggactctganacttgcacccaggaatcctgccccaggctctcaggcctttggactcagactgagctacttcactggctttcctggttctccagcttgaagatggcagatcgtgggacttctcagcctccataattgagtgagccaattccctggagaatacaacaagaagatgcccatctgtagaccaggaggtggtccctccccagaaactggatgggccagcacgttgattctgaacttctagcctccagaactgtaagaaataaatttctattgtttaagccacctg

SEQ ID NO: 63786 - DNA, 569 bp, Homo sapiens
gcagtcttgactcactgcacctggacttcccaggctcaagcaatcctcccacctcagactcctgagtagctgggactacaggcacatgccaccaagcctggctaagtttgttagttttttatagagacaaggtctcactatgttgcccagtctgatctcgaacacctagccacaagcaattctcctgccttgtcttcccagagtgctgggattacaggtgtggaccactgaacccagcaggtcttgctttttttttgagatggaggtgtgagccaccacatccagccaggttttctctttttttttttttttgagacggagtcttgctctgtcgcccaggcggaggttgcagtgagctgagaactcaccattgcactccagcctggatgacagagtgagactccatctcaaaaaagaagaacaaactacagcggggagagggcgaggggaagaagatagtgggggaaaaagagcaccgagaaagggagaagagatggggagagctctattgtgtcactgaacattcctcagttaaagttaaaatgttctcataagttaaaaaaaaaaaa

SEQ ID NO: 63787 - DNA, 373 bp, Homo sapiens
caagtaaagactaaaaattaaaatcatgatgggggatgccatcatgactggccactctgaaggccgggcttgtgtcctgtctcccctcagactgagggctccctgagggcagagcctgtgcctgctccatcagacaaaggtagaaccagcttctccatcaggctagaagcaccctgagactcagggagaggcatggagcatctgggaacaagagctgaggtgtcctagaaacctcccaggaacagacccagggatagaagttggcaggcaactggcaaaggaccctcttcccagccaggccaaatgtgggagggcttccctctcctcctccccatccagcccccgaccccattaaacctttaaattaacttca

SEQ ID NO: 63788 - DNA, 2304 bp, Homo sapiens
tctcctaccctagcgatgacctcttccaggtagcggtcccttgtgcgcggttggtagtacccagggcttagagcgagcgcgcacccggggctgcggtggaggctcctctgtgagctctacctgcctcccatcccgaggcctaggagaaggcgggtacctggccgccagctgacgccctggtggtcactgtggccctttagaaacacacagctccatttcataagcaaaacctcctcccccagccccggctcaagcaccattcacactgccatccaagccgcgggcggccgtggaaagggcactggaccacccgtctcgcgggcgccgtgaggtacagcgatggctcccagtgccgggcagttcaggtgacaggagctttccaaagacacctagggtccaaaaagcagggttcccatctcacaatttggatttgctcatagaggagcagataggacaggctgctcacatttctcctttgaaggcacttccacagtggactgtcgctggcgggcccctgggcggtgaccatcggtgccccgggagacagcgaggaattgaccctttggtcactgtgtaagcccccactaggctgctgctctttccaaagggaaggggctgggggaaccaggaaggaagcccacccccacacctgcatctgtctgggttcagccaggtaaagggactcactgtgatcgtggcccctccacggggcaggacgaccctgcctccgtctcgtgacacaatgagggagcagcccgatccctgagcggtctcttttttggtgcctcctacatttcttgaggaaaaaaaaaatgtgtccttagctaccctgttttgagcagcaatatgcagcctcttccttccaagattacctccggagaacaccgttcttggccaaggacactgaggagctaaatctgcctcactaaggaacgagcttgtttccaagaaatgaggataagatgggtaaaatcctcactaacaaagaatactataaaacctgtgagagccttagaatagcttctaataatcctaggacaggagaaagcgcctggctttgctgtgagtgtatcctcagaaaaagcaggaggtcgaccatctcttcactggagccagcttctcctctagaaacgatgcttttttccctaactaaagagcagcaaaaacaaaaaaaaagggggggcgaggggattttttttacttgtttgagaaattataataaaataattgagtatctcctgtgagtaatgcctttttgtttttaattattccacagcaggtggagttttcagtaatttgttcaagttttgcataagtggttccttaaatcaaaaattatttattaaataggatctttaagaaattttttgaaagttttacttttcctgctgaacaatattttcaatgtgtggtaattactgtactaacatccatgtccctaatattactggggtttcttttattactcagaaaacaaaagtggttttttaaaaatctcatggagagggtctgtggcagctttctggactgattcttcgtgtcacgctgagcagctgctttggcatccaaagctgtgggatcacagaaagtgttgcttcaggtgtggatgccagccactcctcatgctcgtcactcttaaaagattgagacacccaaccttaaaaatgctccaataatccattcagaaaccaaactcatatgcacaagatgtcaaggaggcataaagtcaattcttgcttgtttttttcatttcttaatgtaaaaacagccaaccagaaatttctaaaactggctatgctaattcagatattttctttctcacgctatctgccaggtttgtctaatttaaaaaataaaaaaataaaacagaataaaaaccgtccattgtaatagaggaaaaccttccaaaccaggcagagtacgtaattatcaaaacaccaggacctattctacccttgcatttccaagttacctccacccatcaccatctgatgacagatgtgccctaaataagagcctgagataaagccactggctgcatcctgcaccccagcttctcaatgtggtaacgaggcgccagacgcctgtagacacctgctccaggctgatacattaccactcagtccacatgacttaggaatagccatttccttttgtgagagaagctggatccatccttcctctaaacagtattaaaatgcaaaagggagagagcggatggtcatattaaatgtgctagtcccgtgcaccgacagcatgctccttgagaagaggcgtgtagacctcgtccctggccagagacca

SEQ ID NO: 63789 - DNA, 1244 bp, Homo sapiens
tctcctaccctagcgatgacctcttccaggtagcggtcccttgtgcgcggttggtagtacccagggcttagagcgagcgcgcacccggggctgcggtggaggctcctctgtgagctctacctgcctcccatcccgaggcctaggagaaggcgggtacctggccgccagctgacgccctggtggtcactgtggccctttagaaacacacagctccatttcataagcaaaacctcctcccccagccccggctcaagcaccattcacactgccatccaagccgcgggcggccgtggaaagggcactggaccacccgtctcgcgggcgccgtgaggtacagcgatggctcccagtgccgggcagttcaggtgacaggagctttccaaagacacctagggtccaaaaagcagggttcccatctcacaatttggatttgctcatagaggagcagataggacaggctgctcacatttctcctttgaaggcacttccacagtggactgtcgctggcgggcccctgggcggtgaccatcggtgccccgggagacagcgaggaattgaccctttggtcactgtgtaagcccccactaggctgctgctctttccaaagggaaggggctgggggaaccaggaaggaagcccacccccacacctgcatctgtctgggttcagccaggtaaagggactcactgtgatcgtggcccctccacggggcaggacgaccctgcctccgtctcgtgacacaatgagggagcagcccgatccctgagcggtctcttttttggtgcctcctacatttcttgaggaaaaaaaaaatgtgtccttagctaccctgttttgagcagcaatatgcagcctcttccttccaagattacctccggagaacaccgttcttggccaaggacactgaggagctaaatctgcctcactaaggaacgagcttgtttccaagaaatgaggataagatgggtaaaatcctcactaacaaagaatactataaaacctgtgagagccttagaatagcttctaataatcctaggacaggagaaagcgcctggctttgctgtgagtgtatcctcagaaaaagcaggaggtcgaccatctcttcactggagccagcttctcctctagaaacgatgcttttttccctaactaaagagcagcaaaaacaaaaaaaaagggggggcgaggggattttttttacttgtttgagaaattataataaaataattgagtatctcctgtga

SEQ ID NO: 63790 - DNA, 5075 bp, Homo sapiens
ggggctgaggaggcgagggcagcggagtttcctgccctgagatagttgcagcccgctctgctgcaaccatttcaaattagagaagaaagcagttcagccggtggggctggcgggactctgaccggcccggtggcctcgccggcaacggccccgccccgctggcggcagcggcggcggcagcggctgcgcggggcctggaactggtcgggccggctggggttccgggggacaggtttgcagggtggggcccgagaggctggcgggcaggcagcagtggagccggaagggtaggcagccaggagagagagaggagctatggagagggcccgcaagttctcgggctccggcttggccatgggcttgggctccgcctccgcttcggcctggaggagggcttcgcagaggtgggcctggccgctccgctccctgcggcccggaggggatgccagagagcctcgcaagatcatcctgcacaaaggctccacaggcctgggcttcaacatcgtaggaggagaggatggagaaggcatttttgtctccttcatcctggcaggaggcccagctgacctgagtggggagctgcgcaggggagaccggatcttatcggtgaatggagtgaatctgaggaatgcaactcatgagcaggctgcagctgctctgaaacgggccggccagtcagtcaccattgtggcccagtacagacctgaagaatacagtcgctttgaatcgaagatacatgacttacgagaacaaatgatgaacagcagcatgagctctgggtctgggtccctccgaacaagtgaaaagaggtccttgtatgtcagggccctgtttgattatgatcggactcgggacagctgcctgccaagccaggggctcagcttctcttatggtgacattctgcatgtcattaatgcctctgatgatgagtggtggcaggcaaggctggtgaccccacacggagaaagtgagcagatcggtgtgatccccagtaagaagagggtggaaaagaaagaaagagctcgattgaaaactgtgaagttccatgccaggacggggatgattgagtctaacaggtcgatcaaaacgaaacgtaaaaagagtttccgcctctctcgaaagtttccattttacaagagcaaagaaaacatggcccaggagagcagcatacaggaacagggagtgacatccaacaccagtgacagcgaaagcagttccaaaggacaagaggatgctattttgtcatatgagccagtgacacggcaagaaattcactatgcaaggcctgtgatcatcctgggcccaatgaaggaccgagtcaatgatgacctgatctccgaatttccacataaatttggatcctgtgtgccacatactacccggcctcgacgtgataatgaggtggatggacaagactaccactttgtggtgtcccgagaacaaatggagaaagatattcaggacaacaagttcatcgaggcgggccaatttaatgataacctctatgggaccagcatccagtcagtgcgggcagttgcagagaggggcaagcactgcatcttagatgtttccggcaatgctatcaagagactgcagcaagcacaactttaccccattgccattttcatcaagcccaagtccattgaagcccttatggaaatgaaccgaaggcagacatatgaacaagcaaataagatctatgacaaagccatgaaactggagcaggaatttggagagtactttacagccattgtacagggtgactcactggaagagatttataacaaaatcaaacaaatcattgaggaccagtctgggcactacatttgggtcccatcccctgaaaaactctgaagaatcccctccaaccattctcttgtgaacagaagaaatcaagtccctcttccctcctccctcttcattcctgtccccatggggagaacaaatgctactgttcttgtccccttttttagatatgtcaaaaaaaattaagttttctagtcctgttctttttttttttttaagtttttgtttgtttcagtttattttttgggatgatgccatctcattcatcatgtgactgtgcccattcctgcatggacctttcccaagcgctagcacaggtgcaaaatccatcagagccattgttttcataaaaaccaagcagaagtgaagagaaaagaggaggactgatggaaagacagactctggacagctgcacggcttgtgaagtgagctaaatgcaccacatgatgagatgctcctgggcatttctccctatctgtactgctgtcttgcagctctgaacggtgcaacgtaatggcgacagaaagtatcttatttatatatagatatatatatgtaatttatataaaatatatagaaattattatatatatatattatacactctcatataatatatatatattcacacacatttgggttagaaaatctatggagacttcatcaatggtactatgttattagagaaatgctttaattttcatattccaatcagatggcatcttctatcccagctggttgggaagggattgaagatggtagcaagtgctgcactaagggcactcgcatttggtcattctcttgagagctaggaggggtcagcctgaggccggagaggaagggcttttgcctggggtgagagggtgagagacttgacctgaaagcagctgctgcccctgaggtgcagccagagtcctgtgtgcggacagagagaatggctaatgatgctccgcgtggaattgcctattgttttatgccacctgatgtgtctgcatgagaggtttcctttttgttcctttttaagctgctgttaaaccaaaaccatgttgtgctactgtgtcagccttttcattattgcaaattttacttttactatttaagtgaatgcatagaatccaatttgccaaggttctaaaggcttatgaggtcctgaaggagccaggccttgtgatggagtaggtgacacaggcctggttgtcctgtcagcagaagggaaagcaggggctgggctgagaggaggacacggagggctctgctgaggttccttcctgggttccaccaacagggacagggagtcacttgccttccagttctgtgctgggatggcgggacagcacttggcttgcttggccagctgcgtcatgagtttgatttggtttttttttttttgcagctgcttcatatgctctgctccagcccctccccaacagctggtagcttatggtttcttcaagaggaaagtagactttatgctgtacatttgagctgtagagctaagattcgcttactggtgagctgtgaaaccttgttgctttttcccagagtctgatggcagtgactgtgatcaagggaatcttcaccgccacaagtgcaggcagcaggtgtggttcaggtccccccccaccccactgtgctcctttgaagccaacgtgcctccctcgcctccatactggagggacgacgcaggggagaacagagaagtgcttggccctaggattgaggcacttgtttcctagcccgctgggttagggctggtgcaagcgaggcaatgttgaggatgctttaagcactaccagccgaatccgggaactctgttaacagttgtccaaccagcagaatgaggctaactgtataaagcatgggacccaggatgaggataaggaaaggacagcggctttccctgggcagtacaatggcttgaaggcaaaaagggataaagtgacagccgactgtgactctggtgaggaggggtgagcagggaggttgattctctgatgttaactaagtggcaaagtctcaaccgtgctcagccctccccctcccagggaagagaaacaaagattcaaagtaagcatgatactagtgggtttaccagtgtttcttccaaggagacatatattttttaataaacgatagttgcaatgaactgtggctcagagaccttcttaaagtagttgagaagggagggcgtgggcaaagcagtgggaagaacatcccaaacttttgggggccagagggctctctccttagtgatgatcagctagccgagctgggccgtcctggggatcggtacagctccctggggtggtgacaggccctttgtgaaagttgtgtgcttggtcttccaccccagccccagacactgcttcaaatagcaccaaccagatgggagtccacatctgtggtggcaaaatgctgacattttcccaagaggtacacaaggtgggagaggcctgctgtagcagaggtgtgtgttagagaaagcaggggcctgatttagtagcagagaactgggtgagaaaaatggccagagaaagtgacctgccagctaccagtgtttccgaaaatgagggtgggatgggcccatttgcagagcaggacagcagtcatccccatagccctctgaggaggggagggatgcttagagcaggcagttctgtcagttctgacgtggcaggtgccattgcaacttgtgcggaggagtcttaggaagtgctgtcataattcataaggtcaagagcaacatctggatgaatgagccacctgaaatgtgtgtgggctgagccacaggaagggtgagtcctcttgcttgtggtgctttatggtgtgcaggttgcttgctttcccacattctctcatttgcttgaaggcagcctaacaaaagggagtccccaaagagctccatgagagcttaagaaaattcatctcctgaggacaaagagaacaaagatctgtcctgtggtcacactgttgaggctctgtcttcacagctgatgttctcctagtggaggtacagctgaagaacattcagccccagcacgagaagatacagagcaacttggaaaccccaaagggagacacacccttaacactgccgtgctgtgctgtgccgtgtcctgaaggaggagagagccctatctcctcctggttttgttgctgacattgcagctgatcatgccttgactccttcatctctaacagaggaagaactgtattatcaaaccttatggtctacccatgaataaataaaatatttgttcaagcacaaa

SEQ ID NO: 63791 - DNA, 5995 bp, Homo sapiens
agcacccattctctgcttgagctcccgcttcttctttgccgctgggcctcggcccagaagccacgacgggcgacacggagccgccagtgctggagggggagccgtgggtgcggggcaccgtgggggccgaggccccgggacgcccgcccggccccaggccccgctcagcccgggcgcccccacgggtgccccccccttcttggtccgagcagtgtgagtgtgccagggagcccggcggcggcggcggcggtggtggcggcggtggcggcggcgtggaatccggcgtgggctggggggtccgagccgcggggggcagtgccatgcacaagcaccagcactgctgtaagtgccctgagtgctatgaggtgacccgcctggccgccctgcggcgcctcgagcctccggggtacggcgactggcaagtccccgacccttacgggccaggtgggggcaacggcgccagcgcgggttatgggggctacagctcgcagaccttgccctcgcaggcgggggccacccccacccctcgcaccaaggccaagctcatccccaccggccgggatgtggggccggtgcctcttaagccagtcccgggcaagagcacccccaaactcaacggcagcggccccagctggtggccagagtgcacctgtaccaaccgggactggtatgagcaggtgaatggcagtgatggcatgttcaaatatgaggaaatcgtacttgagaggggcaactctggcctgggcttcagtatcgcaggtggcatcgacaatccccatgtccctgatgaccctggcatttttattaccaagattatccctggtggagcagctgccatggatgggaggctgggggtgaatgactgtgtgctgcgggtgaatgaggtggaagtgtcggaggtggtacacagccgggcggtggaggcgctgaaagaggcaggccctgtggtgcgattggtggtgcggaggcgacagcctccacccgagaccatcatggaggtcaacctgctcaaagggcccaaaggcctgggtttcagcattgctgggggtattggcaaccagcacatcccaggagacaacagcatctacatcaccaagatcattgaggggggtgctgctcagaaggatggacgcctacagattggggaccggctgctggcggtgaacaacaccaatctgcaggatgtgaggcacgaggaagctgtggcctcactgaagaacacatctgatatggtgtatttgaaggtggccaagccaggcagcctccacctcaacgacatgtacgctccccctgactacgccagcacttttactgccttggctgacaaccacataagccataattccagcctgggttatctcggggctgtggagagcaaggtcagctaccctgctcctcctcaggttccccccacccgctactctcctattcccaggcacatgctggctgaggaggacttcaccagagagcctcgcaagatcatcctgcacaaaggctccacaggcctgggcttcaacatcgtaggaggagaggatggagaaggcatttttgtctccttcatcctggcaggaggcccagctgacctgagtggggagctgcgcaggggagaccggatcttatcggtgaatggagtgaatctgaggaatgcaactcatgagcaggctgcagctgctctgaaacgggccggccagtcagtcaccattgtggcccagtacagacctgaagaatacagtcgctttgaatcgaagatacatgacttacgagaacaaatgatgaacagcagcatgagctctgggtctgggtccctccgaacaagtgaaaagaggtccttgtatgtcagggccctgtttgattatgatcggactcgggacagctgcctgccaagccaggggctcagcttctcttatggtgacattctgcatgtcattaatgcctctgatgatgagtggtggcaggcaaggctggtgaccccacacggagaaagtgagcagatcggtgtgatccccagtaagaagagggtggaaaagaaagaaagagctcgattgaaaactgtgaagttccatgccaggacggggatgattgagtctaacagggacttcccggggttaagtgacgattattatggagcaaagaacctgaaaggacaagaggatgctattttgtcatatgagccagtgacacggcaagaaattcactatgcaaggcctgtgatcatcctgggcccaatgaaggaccgagtcaatgatgacctgatctccgaatttccacataaatttggatcctgtgtgccacatactacccggcctcgacgtgataatgaggtggatggacaagactaccactttgtggtgtcccgagaacaaatggagaaagatattcaggacaacaagttcatcgaggcgggccaatttaatgataacctctatgggaccagcatccagtcagtgcgggcagttgcagagaggggcaagcactgcatcttagatgtttccggcaatgctatcaagagactgcagcaagcacaactttaccccattgccattttcatcaagcccaagtccattgaagcccttatggaaatgaaccgaaggcagacatatgaacaagcaaataagatctatgacaaagccatgaaactggagcaggaatttggagagtactttacagccattgtacagggtgactcactggaagagatttataacaaaatcaaacaaatcattgaggaccagtctgggcactacatttgggtcccatcccctgaaaaactctgaagaatcccctccaaccattctcttgtgaacagaagaaatcaagtccctcttccctcctccctcttcattcctgtccccatggggagaacaaatgctactgttcttgtccccttttttagatatgtcaaaaaaaattaagttttctagtcctgttctttttttttttttaagtttttgtttgtttcagtttattttttgggatgatgccatctcattcatcatgtgactgtgcccattcctgcatggacctttcccaagcgctagcacaggtgcaaaatccatcagagccattgttttcataaaaaccaagcagaagtgaagagaaaagaggaggactgatggaaagacagactctggacagctgcacggcttgtgaagtgagctaaatgcaccacatgatgagatgctcctgggcatttctccctatctgtactgctgtcttgcagctctgaacggtgcaacgtaatggcgacagaaagtatcttatttatatatagatatatatatgtaatttatataaaatatatagaaattattatatatatatattatacactctcatataatatatatatattcacacacatttgggttagaaaatctatggagacttcatcaatggtactatgttattagagaaatgctttaattttcatattccaatcagatggcatcttctatcccagctggttgggaagggattgaagatggtagcaagtgctgcactaagggcactcgcatttggtcattctcttgagagctaggaggggtcagcctgaggccggagaggaagggcttttgcctggggtgagagggtgagagacttgacctgaaagcagctgctgcccctgaggtgcagccagagtcctgtgtgcggacagagagaatggctaatgatgctccgcgtggaattgcctattgttttatgccacctgatgtgtctgcatgagaggtttcctttttgttcctttttaagctgctgttaaaccaaaaccatgttgtgctactgtgtcagccttttcattattgcaaattttacttttactatttaagtgaatgcatagaatccaatttgccaaggttctaaaggcttatgaggtcctgaaggagccaggccttgtgatggagtaggtgacacaggcctggttgtcctgtcagcagaagggaaagcaggggctgggctgagaggaggacacggagggctctgctgaggttccttcctgggttccaccaacagggacagggagtcacttgccttccagttctgtgctgggatggcgggacagcacttggcttgcttggccagctgcgtcatgagtttgatttggtttttttttttttgcagctgcttcatatgctctgctccagcccctccccaacagctggtagcttatggtttcttcaagaggaaagtagactttatgctgtacatttgagctgtagagctaagattcgcttactggtgagctgtgaaaccttgttgctttttcccagagtctgatggcagtgactgtgatcaagggaatcttcaccgccacaagtgcaggcagcaggtgtggttcaggtccccccccaccccactgtgctcctttgaagccaacgtgcctccctcgcctccatactggagggacgacgcaggggagaacagagaagtgcttggccctaggattgaggcacttgtttcctagcccgctgggttagggctggtgcaagcgaggcaatgttgaggatgctttaagcactaccagccgaatccgggaactctgttaacagttgtccaaccagcagaatgaggctaactgtataaagcatgggacccaggatgaggataaggaaaggacagcggctttccctgggcagtacaatggcttgaaggcaaaaagggataaagtgacagccgactgtgactctggtgaggaggggtgagcagggaggttgattctctgatgttaactaagtggcaaagtctcaaccgtgctcagccctccccctcccagggaagagaaacaaagattcaaagtaagcatgatactagtgggtttaccagtgtttcttccaaggagacatatattttttaataaacgatagttgcaatgaactgtggctcagagaccttcttaaagtagttgagaagggagggcgtgggcaaagcagtgggaagaacatcccaaacttttgggggccagagggctctctccttagtgatgatcagctagccgagctgggccgtcctggggatcggtacagctccctggggtggtgacaggccctttgtgaaagttgtgtgcttggtcttccaccccagccccagacactgcttcaaatagcaccaaccagatgggagtccacatctgtggtggcaaaatgctgacattttcccaagaggtacacaaggtgggagaggcctgctgtagcagaggtgtgtgttagagaaagcaggggcctgatttagtagcagagaactgggtgagaaaaatggccagagaaagtgacctgccagctaccagtgtttccgaaaatgagggtgggatgggcccatttgcagagcaggacagcagtcatccccatagccctctgaggaggggagggatgcttagagcaggcagttctgtcagttctgacgtggcaggtgccattgcaacttgtgcggaggagtcttaggaagtgctgtcataattcataaggtcaagagcaacatctggatgaatgagccacctgaaatgtgtgtgggctgagccacaggaagggtgagtcctcttgcttgtggtgctttatggtgtgcaggttgcttgctttcccacattctctcatttgcttgaaggcagcctaacaaaagggagtccccaaagagctccatgagagcttaagaaaattcatctcctgaggacaaagagaacaaagatctgtcctgtggtcacactgttgaggctctgtcttcacagctgatgttctcctagtggaggtacagctgaagaacattcagccccagcacgagaagatacagagcaacttggaaaccccaaagggagacacacccttaacactgccgtgctgtgctgtgccgtgtcctgaaggaggagagagccctatctcctcctggttttgttgctgacattgcagctgatcatgccttgactccttcatctctaacagaggaagaactgtattatcaaaccttatggtctacccatgaataaataaaatatttgttcaagcacaaa

SEQ ID NO: 63792 - DNA, 4871 bp, Homo sapiens
agcacccattctctgcttgagctcccgcttcttctttgccgctgggcctcggcccagaagccacgacgggcgacacggagccgccagtgctggagggggagccgtgggtgcggggcaccgtgggggccgaggccccgggacgcccgcccggccccaggccccgctcagcccgggcgcccccacgggtgccccccccttcttggtccgagcagtgtgagtgtgccagggagcccggcggcggcggcggcggtggtggcggcggtggcggcggcgtggaatccggcgtgggctggggggtccgagccgcggggggcagtgccatgcacaagcaccagcactgctgtaagtgccctgagtgctatgaggtgacccgcctggccgccctgcggcgcctcgagcctccggggtacggcgactggcaagtccccgacccttacgggccaggtgggggcaacggcgccagcgcgggttatgggggctacagctcgcagaccttgccctcgcaggcgggggccacccccacccctcgcaccaaggccaagctcatccccaccggccgggatgtggggccggtgcctcttaagccagtcccgggcaagagcacccccaaactcaacggcagcggccccagctggtggccagagtgcacctgtaccaaccgggactggtatgagcaggtgaatggcagtgatggcatgttcaaatatgaggaaatcgtacttgagaggggcaactctggcctgggcttcagtatcgcaggtggcatcgacaatccccatgtccctgatgaccctggcatttttattaccaagattatccctggtggagcagctgccatggatgggaggctgggggtgaatgactgtgtgctgcgggtgaatgaggtggaagtgtcggaggtggtacacagccgggcggtggaggcgctgaaagaggcaggccctgtggtgcgattggtggtgcggaggcgacagcctccacccgagaccatcatggaggtcaacctgctcaaagggcccaaaggcctgggtttcagcattgctgggggtattggcaaccagcacatcccaggagacaacagcatctacatcaccaagatcattgaggggggtgctgctcagaaggatggacgcctacagattggggaccggctgctggcggtgaacaacaccaatctgcaggatgtgaggcacgaggaagctgtggcctcactgaagaacacatctgatatggtgtatttgaaggtggccaagccaggcagcctccacctcaacgacatgtacgctccccctgactacgccagcacttttactgccttggctgacaaccacataagccataattccagcctgggttatctcggggctgtggagagcaaggtcagctaccctgctcctcctcaggttccccccacccgctactctcctattcccaggcacatgctggctgaggaggacttcaccagagagcctcgcaagatcatcctgcacaaaggctccacaggcctgggcttcaacatcgtaggaggagaggatggagaaggcatttttgtctccttcatcctggcaggaggcccagctgacctgagtggggagctgcgcaggggagaccggatcttatcggtgaatggagtgaatctgaggaatgcaactcatgagcaggctgcagctgctctgaaacgggccggccagtcagtcaccattgtggcccagtacagacctgaagaatacagtcgctttgaatcgaagatacatgacttacgagaacaaatgatgaacagcagcatgagctctgggtctgggtccctccgaacaagtgaaaagaggtccttgtatgtcagggccctgtttgattatgatcggactcgggacagctgcctgccaagccaggggctcagcttctcttatggtgacattctgcatgtcattaatgcctctgatgatgagtggtggcaggcaaggctggtgaccccacacggagaaagtgagcagatcggtgtgatccccagtaagaagagggtggaaaagaaagaaagagctcgattgaaaactgtgaagttccatgccaggacggggatgattgagtctaacagggacttcccggggttaagtgacgattattatggagcaaagaacctgaaaggacaagaggatgctattttgtcatatgagccagtgacacggcaagaaattcactatgcaaggcctgtgatcatcctgggcccaatgaaggaccgagtcaatgatgacctgatctccgaatttccacataaatttggatcctgtgtgccacatactacccggcctcgacgtgataatgaggtggatggacaagactaccactttgtggtgtcccgagaacaaatggagaaagatattcaggacaacaagttcatcgaggcgggccaatttaatgataacctctatgggaccagcatccagtcagtgcgggcagttgcagagaggggcaagcactgcatcttagatgtttccggcaatgctatcaagagactgcagcaagcacaactttaccccattgccattttcatcaagcccaagtccattgaagcccttatggaaatgaaccgaaggcagacatatgaacaagcaaataagatctatgacaaagccatgaaactggagcaggaatttggagagtactttacagccattgtacagggtgactcactggaagagatttataacaaaatcaaacaaatcattgaggaccagtctgggcactacatttgggtcccatcccctgaaaaactctgaagaatcccctccaaccattctcttgtgaacagaagaaatcaagtccctcttccctcctccctcttcattcctgtccccatggggagaacaaatgctactgttcttgtccccttttttagatatgtcaaaaaaaattaagttttctagtcctgttctttttttttttttaagtttttgtttgtttcagtttattttttgggatgatgccatctcattcatcatgtgactgtgcccattcctgcatggacctttcccaagcgctagcacaggtgcaaaatccatcagagccattgttttcataaaaaccaagcagaagtgaagagaaaagaggaggactgatggaaagacagactctggacagctgcacggcttgtgaagtgagctaaatgcaccacatgatgagatgctcctgggcatttctccctatctgtactgctgtcttgcagctctgaacggtgcaacgtaatggcgacagaaagtatcttatttatatatagatatatatatgtaatttatataaaatatatagaaattattatatatatatattatacactctcatataatatatatatattcacacacatttgggttagaaaatctatggagacttcatcaatggtactatgttattagagaaatgctttaattttcatattccaatcagatggcatcttctatcccagctggttgggaagggattgaagatggtagcaagtgctgcactaagggcactcgcatttggtcattctcttgagagctaggaggggtcagcctgaggccggagaggaagggcttttgcctggggtgagagggtgagagacttgacctgaaagcagctgctgcccctgaggtgcagccagagtcctgtgtgcggacagagagaatggctaatgatgctccgcgtggaattgcctattgttttatgccacctgatgtgtctgcatgagaggtttcctttttgttcctttttaagctgctgttaaaccaaaaccatgttgtgctactgtgtcagccttttcattattgcaaattttacttttactatttaagtgaatgcatagaatccaatttgccaaggttctaaaggcttatgaggtcctgaaggagccaggccttgtgatggagtaggtgacacaggcctggttgtcctgtcagcagaagggaaagcaggggctgggctgagaggaggacacggagggctctgctgaggttccttcctgggttccaccaacagggacagggagtcacttgccttccagttctgtgctgggatggcgggacagcacttggcttgcttggccagctgcgtcatgagtttgatttggtttttttttttttgcagctgcttcatatgctctgctccagcccctccccaacagctggtagcttatggtttcttcaagaggaaagtagactttatgctgtacatttgagctgtagagctaagattcgcttactggtgagctgtgaaaccttgttgctttttcccagagtctgatggcagtgactgtgatcaagggaatcttcaccgccacaagtgcaggcagcaggtgtggttcaggtccccccccaccccactgtgctcctttgaagccaacgtgcctccctcgcctccatactggagggacgacgcaggggagaacagagaagtgcttggccctaggattgaggcacttgtttcctagcccgctgggttagggctggtgcaagcgaggcaatgttgaggatgctttaagcactaccagccgaatccgggaactctgttaacagttgtccaaccagcagaatgaggctaactgtataaagcatgggacccaggatgaggataaggaaaggacagcggctttccctgggcagtacaatggcttgaaggcaaaaagggataaagtgacagccgactgtgactctggtgaggaggggtgagcagggaggttgattctctgatgttaactaagtggcaaagtctcaaccgtgctcagccctccccctcccagggaagagaaacaaagattcaaagtaagcatgatactagtgggtttaccagtgtttcttccaaggagacatatattttttaataaacgatagttgcaatga

SEQ ID NO: 63793 - DNA, 4662 bp, Homo sapiens
agcacccattctctgcttgagctcccgcttcttctttgccgctgggcctcggcccagaagccacgacgggcgacacggagccgccagtgctggagggggagccgtgggtgcggggcaccgtgggggccgaggccccgggacgcccgcccggccccaggccccgctcagcccgggcgcccccacgggtgccccccccttcttggtccgagcagtgtgagtgtgccagggagcccggcggcggcggcggcggtggtggcggcggtggcggcggcgtggaatccggcgtgggctggggggtccgagccgcggggggcagtgccatgcacaagcaccagcactgctgtaagtgccctgagtgctatgaggtgacccgcctggccgccctgcggcgcctcgagcctccggggtacggcgactggcaagtccccgacccttacgggccaggtgggggcaacggcgccagcgcgggttatgggggctacagctcgcagaccttgccctcgcaggcgggggccacccccacccctcgcaccaaggccaagctcatccccaccggccgggatgtggggccggtgcctcttaagccagtcccgggcaagagcacccccaaactcaacggcagcggccccagctggtggccagagtgcacctgtaccaaccgggactggtatgagcaggtgaatggcagtgatggcatgttcaaatatgaggaaatcgtacttgagaggggcaactctggcctgggcttcagtatcgcaggtggcatcgacaatccccatgtccctgatgaccctggcatttttattaccaagattatccctggtggagcagctgccatggatgggaggctgggggtgaatgactgtgtgctgcgggtgaatgaggtggaagtgtcggaggtggtacacagccgggcggtggaggcgctgaaagaggcaggccctgtggtgcgattggtggtgcggaggcgacagcctccacccgagaccatcatggaggtcaacctgctcaaagggcccaaaggcctgggtttcagcattgctgggggtattggcaaccagcacatcccaggagacaacagcatctacatcaccaagatcattgaggggggtgctgctcagaaggatggacgcctacagattggggaccggctgctggcggtgaacaacaccaatctgcaggatgtgaggcacgaggaagctgtggcctcactgaagaacacatctgatatggtgtatttgaaggtggccaagccaggcagcctccacctcaacgacatgtacgctccccctgactacgccagcacttttactgccttggctgacaaccacataagccataattccagcctgggttatctcggggctgtggagagcaaggtcagctaccctgctcctcctcaggttccccccacccgctactctcctattcccaggcacatgctggctgaggaggacttcaccagagagcctcgcaagatcatcctgcacaaaggctccacaggcctgggcttcaacatcgtaggaggagaggatggagaaggcatttttgtctccttcatcctggcaggaggcccagctgacctgagtggggagctgcgcaggggagaccggatcttatcggtgaatggagtgaatctgaggaatgcaactcatgagcaggctgcagctgctctgaaacgggccggccagtcagtcaccattgtggcccagtacagacctgaagaatacagtcgctttgaatcgaagatacatgacttacgagaacaaatgatgaacagcagcatgagctctgggtctgggtccctccgaacaagtgaaaagaggtccttgtatgtcagggccctgtttgattatgatcggactcgggacagctgcctgccaagccaggggctcagcttctcttatggtgacattctgcatgtcattaatgcctctgatgatgagtggtggcaggcaaggctggtgaccccacacggagaaagtgagcagatcggtgtgatccccagtaagaagagggtggaaaagaaagaaagagctcgattgaaaactgtgaagttccatgccaggacggggatgattgagtctaacagggacttcccggggttaagtgacgattattatggagcaaagaacctgaaaggacaagaggatgctattttgtcatatgagccagtgacacggcaagaaattcactatgcaaggcctgtgatcatcctgggcccaatgaaggaccgagtcaatgatgacctgatctccgaatttccacataaatttggatcctgtgtgccacatactacccggcctcgacgtgataatgaggtggatggacaagactaccactttgtggtgtcccgagaacaaatggagaaagatattcaggacaacaagttcatcgaggcgggccaatttaatgataacctctatgggaccagcatccagtcagtgcgggcagttgcagagaggggcaagcactgcatcttagatgtttccggcaatgctatcaagagactgcagcaagcacaactttaccccattgccattttcatcaagcccaagtccattgaagcccttatggaaatgaaccgaaggcagacatatgaacaagcaaataagatctatgacaaagccatgaaactggagcaggaatttggagagtactttacagccattgtacagggtgactcactggaagagatttataacaaaatcaaacaaatcattgaggaccagtctgggcactacatttgggtcccatcccctgaaaaactctgaagaatcccctccaaccattctcttgtgaacagaagaaatcaagtccctcttccctcctccctcttcattcctgtccccatggggagaacaaatgctactgttcttgtccccttttttagatatgtcaaaaaaaattaagttttctagtcctgttctttttttttttttaagtttttgtttgtttcagtttattttttgggatgatgccatctcattcatcatgtgactgtgcccattcctgcatggacctttcccaagcgctagcacaggtgcaaaatccatcagagccattgttttcataaaaaccaagcagaagtgaagagaaaagaggaggactgatggaaagacagactctggacagctgcacggcttgtgaagtgagctaaatgcaccacatgatgagatgctcctgggcatttctccctatctgtactgctgtcttgcagctctgaacggtgcaacgtaatggcgacagaaagtatcttatttatatatagatatatatatgtaatttatataaaatatatagaaattattatatatatatattatacactctcatataatatatatatattcacacacatttgggttagaaaatctatggagacttcatcaatggtactatgttattagagaaatgctttaattttcatattccaatcagatggcatcttctatcccagctggttgggaagggattgaagatggtagcaagtgctgcactaagggcactcgcatttggtcattctcttgagagctaggaggggtcagcctgaggccggagaggaagggcttttgcctggggtgagagggtgagagacttgacctgaaagcagctgctgcccctgaggtgcagccagagtcctgtgtgcggacagagagaatggctaatgatgctccgcgtggaattgcctattgttttatgccacctgatgtgtctgcatgagaggtttcctttttgttcctttttaagctgctgttaaaccaaaaccatgttgtgctactgtgtcagccttttcattattgcaaattttacttttactatttaagtgaatgcatagaatccaatttgccaaggttctaaaggcttatgaggtcctgaaggagccaggccttgtgatggagtaggtgacacaggcctggttgtcctgtcagcagaagggaaagcaggggctgggctgagaggaggacacggagggctctgctgaggttccttcctgggttccaccaacagggacagggagtcacttgccttccagttctgtgctgggatggcgggacagcacttggcttgcttggccagctgcgtcatgagtttgatttggtttttttttttttgcagctgcttcatatgctctgctccagcccctccccaacagctggtagcttatggtttcttcaagaggaaagtagactttatgctgtacatttgagctgtagagctaagattcgcttactggtgagctgtgaaaccttgttgctttttcccagagtctgatggcagtgactgtgatcaagggaatcttcaccgccacaagtgcaggcagcaggtgtggttcaggtccccccccaccccactgtgctcctttgaagccaacgtgcctccctcgcctccatactggagggacgacgcaggggagaacagagaagtgcttggccctaggattgaggcacttgtttcctagcccgctgggttagggctggtgcaagcgaggcaatgttgaggatgctttaagcactaccagccgaatccgggaactctgttaacagttgtccaaccagcagaatgaggctaactgtataaagcatgggacccaggatgaggataaggaaaggtgccatgccggcgccattgggccggctgccattgggcgggtgccgagct

SEQ ID NO: 63794 - DNA, 4430 bp, Homo sapiens
acggagggactggccggagctggcgctttctcagcactagatctggactccgacccggcgccagaatacagtcgctttgaatcgaagatacatgacttacgagaacaaatgatgaacagcagcatgagctctgggtctgggtccctccgaacaagtgaaaagaggtccttgtatgtcagggccctgtttgattatgatcggactcgggacagctgcctgccaagccaggggctcagcttctcttatggtgacattctgcatgtcattaatgcctctgatgatgagtggtggcaggcaaggctggtgaccccacacggagaaagtgagcagatcggtgtgatccccagtaagaagagggtggaaaagaaagaaagagctcgattgaaaactgtgaagttccatgccaggacggggatgattgagtctaacaggtcgatcaaaacgaaacgtaaaaagagtttccgcctctctcgaaagtttccattttacaagagcaaagaaaacatggcccaggagagcagcatacaggaacagggagtgacatccaacaccagtgacagcgaaagcagttccaaaggacaagaggatgctattttgtcatatgagccagtgacacggcaagaaattcactatgcaaggcctgtgatcatcctgggcccaatgaaggaccgagtcaatgatgacctgatctccgaatttccacataaatttggatcctgtgtgccacatactacccggcctcgacgtgataatgaggtggatggacaagactaccactttgtggtgtcccgagaacaaatggagaaagatattcaggacaacaagttcatcgaggcgggccaatttaatgataacctctatgggaccagcatccagtcagtgcgggcagttgcagagaggggcaagcactgcatcttagatgtttccggcaatgctatcaagagactgcagcaagcacaactttaccccattgccattttcatcaagcccaagtccattgaagcccttatggaaatgaaccgaaggcagacatatgaacaagcaaataagatctatgacaaagccatgaaactggagcaggaatttggagagtactttacagccattgtacagggtgactcactggaagagatttataacaaaatcaaacaaatcattgaggaccagtctgggcactacatttgggtcccatcccctgaaaaactctgaagaatcccctccaaccattctcttgtgaacagaagaaatcaagtccctcttccctcctccctcttcattcctgtccccatggggagaacaaatgctactgttcttgtccccttttttagatatgtcaaaaaaaattaagttttctagtcctgttctttttttttttttaagtttttgtttgtttcagtttattttttgggatgatgccatctcattcatcatgtgactgtgcccattcctgcatggacctttcccaagcgctagcacaggtgcaaaatccatcagagccattgttttcataaaaaccaagcagaagtgaagagaaaagaggaggactgatggaaagacagactctggacagctgcacggcttgtgaagtgagctaaatgcaccacatgatgagatgctcctgggcatttctccctatctgtactgctgtcttgcagctctgaacggtgcaacgtaatggcgacagaaagtatcttatttatatatagatatatatatgtaatttatataaaatatatagaaattattatatatatatattatacactctcatataatatatatatattcacacacatttgggttagaaaatctatggagacttcatcaatggtactatgttattagagaaatgctttaattttcatattccaatcagatggcatcttctatcccagctggttgggaagggattgaagatggtagcaagtgctgcactaagggcactcgcatttggtcattctcttgagagctaggaggggtcagcctgaggccggagaggaagggcttttgcctggggtgagagggtgagagacttgacctgaaagcagctgctgcccctgaggtgcagccagagtcctgtgtgcggacagagagaatggctaatgatgctccgcgtggaattgcctattgttttatgccacctgatgtgtctgcatgagaggtttcctttttgttcctttttaagctgctgttaaaccaaaaccatgttgtgctactgtgtcagccttttcattattgcaaattttacttttactatttaagtgaatgcatagaatccaatttgccaaggttctaaaggcttatgaggtcctgaaggagccaggccttgtgatggagtaggtgacacaggcctggttgtcctgtcagcagaagggaaagcaggggctgggctgagaggaggacacggagggctctgctgaggttccttcctgggttccaccaacagggacagggagtcacttgccttccagttctgtgctgggatggcgggacagcacttggcttgcttggccagctgcgtcatgagtttgatttggtttttttttttttgcagctgcttcatatgctctgctccagcccctccccaacagctggtagcttatggtttcttcaagaggaaagtagactttatgctgtacatttgagctgtagagctaagattcgcttactggtgagctgtgaaaccttgttgctttttcccagagtctgatggcagtgactgtgatcaagggaatcttcaccgccacaagtgcaggcagcaggtgtggttcaggtccccccccaccccactgtgctcctttgaagccaacgtgcctccctcgcctccatactggagggacgacgcaggggagaacagagaagtgcttggccctaggattgaggcacttgtttcctagcccgctgggttagggctggtgcaagcgaggcaatgttgaggatgctttaagcactaccagccgaatccgggaactctgttaacagttgtccaaccagcagaatgaggctaactgtataaagcatgggacccaggatgaggataaggaaaggacagcggctttccctgggcagtacaatggcttgaaggcaaaaagggataaagtgacagccgactgtgactctggtgaggaggggtgagcagggaggttgattctctgatgttaactaagtggcaaagtctcaaccgtgctcagccctccccctcccagggaagagaaacaaagattcaaagtaagcatgatactagtgggtttaccagtgtttcttccaaggagacatatattttttaataaacgatagttgcaatgaactgtggctcagagaccttcttaaagtagttgagaagggagggcgtgggcaaagcagtgggaagaacatcccaaacttttgggggccagagggctctctccttagtgatgatcagctagccgagctgggccgtcctggggatcggtacagctccctggggtggtgacaggccctttgtgaaagttgtgtgcttggtcttccaccccagccccagacactgcttcaaatagcaccaaccagatgggagtccacatctgtggtggcaaaatgctgacattttcccaagaggtacacaaggtgggagaggcctgctgtagcagaggtgtgtgttagagaaagcaggggcctgatttagtagcagagaactgggtgagaaaaatggccagagaaagtgacctgccagctaccagtgtttccgaaaatgagggtgggatgggcccatttgcagagcaggacagcagtcatccccatagccctctgaggaggggagggatgcttagagcaggcagttctgtcagttctgacgtggcaggtgccattgcaacttgtgcggaggagtcttaggaagtgctgtcataattcataaggtcaagagcaacatctggatgaatgagccacctgaaatgtgtgtgggctgagccacaggaagggtgagtcctcttgcttgtggtgctttatggtgtgcaggttgcttgctttcccacattctctcatttgcttgaaggcagcctaacaaaagggagtccccaaagagctccatgagagcttaagaaaattcatctcctgaggacaaagagaacaaagatctgtcctgtggtcacactgttgaggctctgtcttcacagctgatgttctcctagtggaggtacagctgaagaacattcagccccagcacgagaagatacagagcaacttggaaaccccaaagggagacacacccttaacactgccgtgctgtgctgtgccgtgtcctgaaggaggagagagccctatctcctcctggttttgttgctgacattgcagctgatcatgccttgactccttcatctctaacagaggaagaactgtattatcaaaccttatggtctacccatgaataaataaaatatttgttcaagcacaaa

SEQ ID NO: 63795 - DNA, 1927 bp, Homo sapiens
  misc_feature (111)..(111): n is a, c, g, or t
tcatgcatgtgctgagcgaaggaaagagtatcgccgtgctggtataagctggagatggccctaagtgctgaagtctggtgatgctgccattgttgatatgggtcctggcangaggaaagtagactttatgctgtacatttgagctgtagagctaagattcgcttactggtgagctgtgaaaccttgttgctttttcccagagtctgatggcagtgactgtgatcaagggaatcttcaccgccacaagtgcaggcagcaggtgtggttcaggtccccccccaccccactgtgctcctttgaagccaacgtgcctccctcgcctccatactggagggacgacgcaggggagaacagagaagtgcttggccctaggattgaggcacttgtttcctagcccgctgggttagggctggtgcaagcgaggcaatgttgaggatgctttaagcactaccagccgaatccgggaactctgttaacagttgtccaaccagcagaatgaggctaactgtataaagcatgggacccaggatgaggataaggaaaggacagcggctttccctgggcagtacaatggcttgaaggcaaaaagggataaagtgacagccgactgtgactctggtgaggaggggtgagcagggaggttgattctctgatgttaactaagtggcaaagtctcaaccgtgctcagccctccccctcccagggaagagaaacaaagattcaaagtaagcatgatactagtgggtttaccagtgtttcttccaaggagacatatattttttaataaacgatagttgcaatgaactgtggctcagagaccttcttaaagtagttgagaagggagggcgtgggcaaagcagtgggaagaacatcccaaacttttgggggccagagggctctctccttagtgatgatcagctagccgagctgggccgtcctggggatcggtacagctccctggggtggtgacaggccctttgtgaaagttgtgtgcttggtcttccaccccagccccagacactgcttcaaatagcaccaaccagatgggagtccacatctgtggtggcaaaatgctgacattttcccaagaggtacacaaggtgggagaggcctgctgtagcagaggtgtgtgttagagaaagcaggggcctgatttagtagcagagaactgggtgagaaaaatggccagagaaagtgacctgccagctaccagtgtttccgaaaatgagggtgggatgggcccatttgcagagcaggacagcagtcatccccatagccctctgaggaggggagggatgcttagagcaggcagttctgtcagttctgacgtggcaggtgccattgcaacttgtgcggaggagtcttaggaagtgctgtcataattcataaggtcaagagcaacatctggatgaatgagccacctgaaatgtgtgtgggctgagccacaggaagggtgagtcctcttgcttgtggtgctttatggtgtgcaggttgcttgctttcccacattctctcatttgcttgaaggcagcctaacaaaagggagtccccaaagagctccatgagagcttaagaaaattcatctcctgaggacaaagagaacaaagatctgtcctgtggtcacactgttgaggctctgtcttcacagctgatgttctcctagtggaggtacagctgaagaacattcagccccagcacgagaagatacagagcaacttggaaaccccaaagggagacacacccttaacactgccgtgctgtgctgtgccgtgtcctgaaggaggagagagccctatctcctcctggttttgttgctgacattgcagctgatcatgccttgactccttcatctctaacagaggaagaactgtattatcaaaccttatggtctacccatgaataaataaaatatttgttcaagcacaaa

SEQ ID NO: 63796 - DNA, 457 bp, Homo sapiens
tggccttccatcttttcaaggtgccagtgtcttggcatttagggttggatgatcacttcatctttcactgtgcctttcagggccctgtttgattatgatcggactcgggacagctgcctgccaagccaggggctcagcttctcttatggtgacattctgcatgtcattaatgcctctgatgatgagtggtggcaggcaaggctggtgaccccacacggagaaagtgagcagatcggtgtgatccccagtaagaagaggtgagtcgtcatgatcatgagcaaggcctttcctgccctcttgctggtatttctttcttgttttcctattagaagttgcttgagagcaacgtttgtgccttgattcctttttggtagagtcggtactcaacatggtttttactcagtgagccaaaaaaatggctgctgtgcctgctgcaacccactgctgagaccattta

SEQ ID NO: 63797 - DNA, 616 bp, Homo sapiens
tttgttaggttcactgtctcctctaccaagtttggcaccctctgccatgctttagctcaggaaaccccacctttctagtccagtttaagctaaagcaaatagccccctgtgtgagacctggagattggaagagaagtaggccagacaaaccgcttcccaactgcttgttttctcccacttacttgaaaaaaaaaatggagtggcccagtgacccacccagatgagaatggaccagtcagtattttttggtttggggcggatcactgcccctgggccacaaagcatttcctttcttccttcagatactacccggcctcgacgtgataatgaggtggatggacaagactaccactttgtggtgtcccgagaacaaatggagaaagatattcaggacaacaagttcatcgaggcgggccaatttaatgataacctctatgggaccagcatccagtcagtgcgggcagttgcagagagggtaagtgtacaggagatggcctcaaaggggaggccaatgcttatgccaaggttccacttggatccttatccttccaacacaggagctgcccaacagtgctgctgaccaaagccatagcacatctgcatactcccagcgcct

SEQ ID NO: 63798 - DNA, 6042 bp, Homo sapiens
agcacccattctctgcttgagctcccgcttcttctttgccgctgggcctcggcccagaagccacgacgggcgacacggagccgccagtgctggagggggagccgtgggtgcggggcaccgtgggggccgaggccccgggacgcccgcccggccccaggccccgctcagcccgggcgcccccacgggtgccccccccttcttggtccgagcagtgtgagtgtgccagggagcccggcggcggcggcggcggtggtggcggcggtggcggcggcgtggaatccggcgtgggctggggggtccgagccgcggggggcagtgccatgcacaagcaccagcactgctgtaagtgccctgagtgctatgaggtgacccgcctggccgccctgcggcgcctcgagcctccggggtacggcgactggcaagtccccgacccttacgggccaggtgggggcaacggcgccagcgcgggttatgggggctacagctcgcagaccttgccctcgcaggcgggggccacccccacccctcgcaccaaggccaagctcatccccaccggccgggatgtggggccggtgcctcttaagccagtcccgggcaagagcacccccaaactcaacggcagcggccccagctggtggccagagtgcacctgtaccaaccgggactggtatgagcaggtgaatggcagtgatggcatgttcaaatatgaggaaatcgtacttgagaggggcaactctggcctgggcttcagtatcgcaggtggcatcgacaatccccatgtccctgatgaccctggcatttttattaccaagattatccctggtggagcagctgccatggatgggaggctgggggtgaatgactgtgtgctgcgggtgaatgaggtggaagtgtcggaggtggtacacagccgggcggtggaggcgctgaaagaggcaggccctgtggtgcgattggtggtgcggaggcgacagcctccacccgagaccatcatggaggtcaacctgctcaaagggcccaaaggcctgggtttcagcattgctgggggtattggcaaccagcacatcccaggagacaacagcatctacatcaccaagatcattgaggggggtgctgctcagaaggatggacgcctacagattggggaccggctgctggcggtgaacaacaccaatctgcaggatgtgaggcacgaggaagctgtggcctcactgaagaacacatctgatatggtgtatttgaaggtggccaagccaggcagcctccacctcaacgacatgtacgctccccctgactacgccagcacttttactgccttggctgacaaccacataagccataattccagcctgggttatctcggggctgtggagagcaaggtcagctaccctgctcctcctcaggttccccccacccgctactctcctattcccaggcacatgctggctgaggaggacttcaccagagagcctcgcaagatcatcctgcacaaaggctccacaggcctgggcttcaacatcgtaggaggagaggatggagaaggcatttttgtctccttcatcctggcaggaggcccagctgacctgagtggggagctgcgcaggggagaccggatcttatcggtgaatggagtgaatctgaggaatgcaactcatgagcaggctgcagctgctctgaaacgggccggccagtcagtcaccattgtggcccagtacagacctgaagaatacagtcgctttgaatcgaagatacatgacttacgagaacaaatgatgaacagcagcatgagctctgggtctgggtccctccgaacaagtgaaaagaggtccttgtatgtcagggccctgtttgattatgatcggactcgggacagctgcctgccaagccaggggctcagcttctcttatggtgacattctgcatgtcattaatgcctctgatgatgagtggtggcaggcaaggctggtgaccccacacggagaaagtgagcagatcggtgtgatccccagtaagaagagggtggaaaagaaagaaagagctcgattgaaaactgtgaagttccatgccaggacggggatgattgagtctaacagggacttcccggggttaagtgacgattattatggagcaaagaacctgaaaggacaagaggatgctattttgtcatatgagccagtgacacggcaagaaattcactatgcaaggcctgtgatcatcctgggcccaatgaaggaccgagtcaatgatgacctgatctccgaatttccacataaatttggatcctgtgtgccacatactacccggcctcgacgtgataatgaggtggatggacaagactaccactttgtggtgtcccgagaacaaatggagaaagatattcaggacaacaagttcatcgaggcgggccaatttaatgataacctctatgggaccagcatccagtcagtgcgggcagttgcagagaggggcaagcactgcatcttagatgtttccggcaatgctatcaagagactgcagcaagcacaactttaccccattgccattttcatcaagcccaagtccattgaagcccttatggaaatgaaccgaaggcagacatatgaacaagcaaataagatctatgacaaagccatgaaactggagcaggaatttggagagtactttacagccattgtacagggtgactcactggaagagatttataacaaaatcaaacaaatcattgaggaccagtctgggcactacatttgggtcccatcccctgaaaaactctgaagaatcccctccaaccattctcttgtgaacagaagaaatcaagtccctcttccctcctccctcttcattcctgtccccatggggagaacaaatgctactgttcttgtccccttttttagatatgtcaaaaaaaattaagttttctagtcctgttctttttttttttttaagtttttgtttgtttcagtttattttttgggatgatgccatctcattcatcatgtgactgtgcccattcctgcatggacctttcccaagcgctagcacaggtgcaaaatccatcagagccattgttttcataaaaaccaagcagaagtgaagagaaaagaggaggactgatggaaagacagactctggacagctgcacggcttgtgaagtgagctaaatgcaccacatgatgagatgctcctgggcatttctccctatctgtactgctgtcttgcagctctgaacggtgcaacgtaatggcgacagaaagtatcttatttatatatagatatatatatgtaatttatataaaatatatagaaattattatatatatatattatacactctcatataatatatatatattcacacacatttgggttagaaaatctatggagacttcatcaatggtactatgttattagagaaatgctttaattttcatattccaatcagatggcatcttctatcccagctggttgggaagggattgaagatggtagcaagtgctgcactaagggcactcgcatttggtcattctcttgagagctaggaggggtcagcctgaggccggagaggaagggcttttgcctggggtgagagggtgagagacttgacctgaaagcagctgctgcccctgaggtgcagccagagtcctgtgtgcggacagagagaatgctgcacctcaggggcagccagagtcctgtgtgcggacagagagaatggctaatgatgctccgcgtggaattgcctattgttttatgccacctgatgtgtctgcatgagaggtttcctttttgttcctttttaagctgctgttaaaccaaaaccatgttgtgctactgtgtcagccttttcattattgcaaattttacttttactatttaagtgaatgcatagaatccaatttgccaaggttctaaaggcttatgaggtcctgaaggagccaggccttgtgatggagtaggtgacacaggcctggttgtcctgtcagcagaagggaaagcaggggctgggctgagaggaggacacggagggctctgctgaggttccttcctgggttccaccaacagggacagggagtcacttgccttccagttctgtgctgggatggcgggacagcacttggcttgcttggccagctgcgtcatgagtttgatttggtttttttttttttgcagctgcttcatatgctctgctccagcccctccccaacagctggtagcttatggtttcttcaagaggaaagtagactttatgctgtacatttgagctgtagagctaagattcgcttactggtgagctgtgaaaccttgttgctttttcccagagtctgatggcagtgactgtgatcaagggaatcttcaccgccacaagtgcaggcagcaggtgtggttcaggtccccccccaccccactgtgctcctttgaagccaacgtgcctccctcgcctccatactggagggacgacgcaggggagaacagagaagtgcttggccctaggattgaggcacttgtttcctagcccgctgggttagggctggtgcaagcgaggcaatgttgaggatgctttaagcactaccagccgaatccgggaactctgttaacagttgtccaaccagcagaatgaggctaactgtataaagcatgggacccaggatgaggataaggaaaggacagcggctttccctgggcagtacaatggcttgaaggcaaaaagggataaagtgacagccgactgtgactctggtgaggaggggtgagcagggaggttgattctctgatgttaactaagtggcaaagtctcaaccgtgctcagccctccccctcccagggaagagaaacaaagattcaaagtaagcatgatactagtgggtttaccagtgtttcttccaaggagacatatattttttaataaacgatagttgcaatgaactgtggctcagagaccttcttaaagtagttgagaagggagggcgtgggcaaagcagtgggaagaacatcccaaacttttgggggccagagggctctctccttagtgatgatcagctagccgagctgggccgtcctggggatcggtacagctccctggggtggtgacaggccctttgtgaaagttgtgtgcttggtcttccaccccagccccagacactgcttcaaatagcaccaaccagatgggagtccacatctgtggtggcaaaatgctgacattttcccaagaggtacacaaggtgggagaggcctgctgtagcagaggtgtgtgttagagaaagcaggggcctgatttagtagcagagaactgggtgagaaaaatggccagagaaagtgacctgccagctaccagtgtttccgaaaatgagggtgggatgggcccatttgcagagcaggacagcagtcatccccatagccctctgaggaggggagggatgcttagagcaggcagttctgtcagttctgacgtggcaggtgccattgcaacttgtgcggaggagtcttaggaagtgctgtcataattcataaggtcaagagcaacatctggatgaatgagccacctgaaatgtgtgtgggctgagccacaggaagggtgagtcctcttgcttgtggtgctttatggtgtgcaggttgcttgctttcccacattctctcatttgcttgaaggcagcctaacaaaagggagtccccaaagagctccatgagagcttaagaaaattcatctcctgaggacaaagagaacaaagatctgtcctgtggtcacactgttgaggctctgtcttcacagctgatgttctcctagtggaggtacagctgaagaacattcagccccagcacgagaagatacagagcaacttggaaaccccaaagggagacacacccttaacactgccgtgctgtgctgtgccgtgtcctgaaggaggagagagccctatctcctcctggttttgttgctgacattgcagctgatcatgccttgactccttcatctctaacagaggaagaactgtattatcaaaccttatggtctacccatgaataaataaaatatttgttcaagcacaaa

SEQ ID NO: 63799 - DNA, 4325 bp, Homo sapiens
agcacccattctctgcttgagctcccgcttcttctttgccgctgggcctcggcccagaagccacgacgggcgacacggagccgccagtgctggagggggagccgtgggtgcggggcaccgtgggggccgaggccccgggacgcccgcccggccccaggccccgctcagcccgggcgcccccacgggtgccccccccttcttggtccgagcagtgtgagtgtgccagggagcccggcggcggcggcggcggtggtggcggcggtggcggcggcgtggaatccggcgtgggctggggggtccgagccgcggggggcagtgccatgcacaagcaccagcactgctgtaagtgccctgagtgctatgaggtgacccgcctggccgccctgcggcgcctcgagcctccggggtacggcgactggcaagtccccgacccttacgggccaggtgggggcaacggcgccagcgcgggttatgggggctacagctcgcagaccttgccctcgcaggcgggggccacccccacccctcgcaccaaggccaagctcatccccaccggccgggatgtggggccggtgcctcttaagccagtcccgggcaagagcacccccaaactcaacggcagcggccccagctggtggccagagtgcacctgtaccaaccgggactggtatgagcaggtgaatggcagtgatggcatgttcaaatatgaggaaatcgtacttgagaggggcaactctggcctgggcttcagtatcgcaggtggcatcgacaatccccatgtccctgatgaccctggcatttttattaccaagattatccctggtggagcagctgccatggatgggaggctgggggtgaatgactgtgtgctgcgggtgaatgaggtggaagtgtcggaggtggtacacagccgggcggtggaggcgctgaaagaggcaggccctgtggtgcgattggtggtgcggaggcgacagcctccacccgagaccatcatggaggtcaacctgctcaaagggcccaaaggcctgggtttcagcattgctgggggtattggcaaccagcacatcccaggagacaacagcatctacatcaccaagatcattgaggggggtgctgctcagaaggatggacgcctacagattggggaccggctgctggcggtgaacaacaccaatctgcaggatgtgaggcacgaggaagctgtggcctcactgaagaacacatctgatatggtgtatttgaaggtggccaagccaggcagcctccacctcaacgacatgtacgctccccctgactacgccagcacttttactgccttggctgacaaccacataagccataattccagcctgggttatctcggggctgtggagagcaaggtcagctaccctgctcctcctcaggttccccccacccgctactctcctattcccaggcacatgctggctgaggaggacttcaccagagagcctcgcaagatcatcctgcacaaaggctccacaggcctgggcttcaacatcgtaggaggagaggatggagaaggcatttttgtctccttcatcctggcaggaggcccagctgacctgagtggggagctgcgcaggggagaccggatcttatcggtgaatggagtgaatctgaggaatgcaactcatgagcaggctgcagctgctctgaaacgggccggccagtcagtcaccattgtggcccagtacagacctgaagaatacagtcgctttgaatcgaagatacatgacttacgagaacaaatgatgaacagcagcatgagctctgggtctgggtccctccgaacaagtgaaaagaggtccttgtatgtcagggccctgtttgattatgatcggactcgggacagctgcctgccaagccaggggctcagcttctcttatggtgacattctgcatgtcattaatgcctctgatgatgagtggtggcaggcaaggctggtgaccccacacggagaaagtgagcagatcggtgtgatccccagtaagaagagggtggaaaagaaagaaagagctcgattgaaaactgtgaagttccatgccaggacggggatgattgagtctaacagggacttcccggggttaagtgacgattattatggagcaaagaacctgaaaggacaagaggatgctattttgtcatatgagccagtgacacggcaagaaattcactatgcaaggcctgtgatcatcctgggcccaatgaaggaccgagtcaatgatgacctgatctccgaatttccacataaatttggatcctgtgtgccacatactacccggcctcgacgtgataatgaggtggatggacaagactaccactttgtggtgtcccgagaacaaatggagaaagatattcaggacaacaagttcatcgaggcgggccaatttaatgataacctctatgggaccagcatccagtcagtgcgggcagttgcagagaggggcaagcactgcatcttagatgtttccggcaatgctatcaagagactgcagcaagcacaactttaccccattgccattttcatcaagcccaagtccattgaagcccttatggaaatgaaccgaaggcagacatatgaacaagcaaataagatctatgacaaagccatgaaactggagcaggaatttggagagtactttacagccattgtacagggtgactcactggaagagatttataacaaaatcaaacaaatcattgaggaccagtctgggcactacatttgggtcccatcccctgaaaaactctgaagaatcccctccaaccattctcttgtgaacagaagaaatcaagtccctcttccctcctccctcttcattcctgtccccatggggagaacaaatgctactgttcttgtccccttttttagatatgtcaaaaaaaattaagttttctagtcctgttctttttttttttttaagtttttgtttgtttcagtttattttttgggatgatgccatctcattcatcatgtgactgtgcccattcctgcatggacctttcccaagcgctagcacaggtgcaaaatccatcagagccattgttttcataaaaaccaagcagaagtgaagagaaaagaggaggactgatggaaagacagactctggacagctgcacggcttgtgaagtgagctaaatgcaccacatgatgagatgctcctgggcatttctccctatctgtactgctgtcttgcagctctgaacggtgcaacgtaatggcgacagaaagtatcttatttatatatagatatatatatgtaatttatataaaatatatagaaattattatatatatatattatacactctcatataatatatatatattcacacacatttgggttagaaaatctatggagacttcatcaatggtactatgttattagagaaatgctttaattttcatattccaatcagatggcatcttctatcccagctggttgggaagggattgaagatggtagcaagtgctgcactaagggcactcgcatttggtcattctcttgagagctaggaggggtcagcctgaggccggagaggaagggcttttgcctggggtgagagggtgagagacttgacctgaaagcagctgctgcccctgaggtgcagccagagtcctgtgtgcggacagagagaatggctaatgatgctccgcgtggaattgcctattgttttatgccacctgatgtgtctgcatgagaggtttcctttttgttcctttttaagctgctgttaaaccaaaaccatgttgtgctactgtgtcagccttttcattattgcaaattttacttttactatttaagtgaatgcatagaatccaatttgccaaggttctaaaggcttatgaggtcctgaaggagccaggccttgtgatggagtaggtgacacaggcctggttgtcctgtcagcagaagggaaagcaggggctgggctgagaggaggacacggagggctctgctgaggttccttcctgggttccaccaacagggacagggagtcacttgccttccagttctgtgctgggatggcgggacagcacttggacagcggctttccctgggcagtacaatggcttgaaggcaaaaagggataaagtgacagccgactgtgactctggtgaggaggggtgagcagggaggttgattctctgatgttaactaagtggcaaagtctcaaccgtgctcagccctccccctcccagggaagagaaacaaagattcaaagtaagcatgatactagtgggtttaccagtgtttcttccaaggagacatatattttttaataaacgatagttgcaatga

SEQ ID NO: 63800 - DNA, 3080 bp, Homo sapiens
agcacccattctctgcttgagctcccgcttcttctttgccgctgggcctcggcccagaagccacgacgggcgacacggagccgccagtgctggagggggagccgtgggtgcggggcaccgtgggggccgaggccccgggacgcccgcccggccccaggccccgctcagcccgggcgcccccacgggtgccccccccttcttggtccgagcagtgtgagtgtgccagggagcccggcggcggcggcggcggtggtggcggcggtggcggcggcgtggaatccggcgtgggctggggggtccgagccgcggggggcagtgccatgcacaagcaccagcactgctgtaagtgccctgagtgctatgaggtgacccgcctggccgccctgcggcgcctcgagcctccggggtacggcgactggcaagtccccgacccttacgggccaggtgggggcaacggcgccagcgcgggttatgggggctacagctcgcagaccttgccctcgcaggcgggggccacccccacccctcgcaccaaggccaagctcatccccaccggccgggatgtggggccggtgcctcttaagccagtcccgggcaagagcacccccaaactcaacggcagcggccccagctggtggccagagtgcacctgtaccaaccgggactggtatgagcaggtgaatggcagtgatggcatgttcaaatatgaggaaatcgtacttgagaggggcaactctggcctgggcttcagtatcgcaggtggcatcgacaatccccatgtccctgatgaccctggcatttttattaccaagattatccctggtggagcagctgccatggatgggaggctgggggtgaatgactgtgtgctgcgggtgaatgaggtggaagtgtcggaggtggtacacagccgggcggtggaggcgctgaaagaggcaggccctgtggtgcgattggtggtgcggaggcgacagcctccacccgagaccatcatggaggtcaacctgctcaaagggcccaaaggcctgggtttcagcattgctgggggtattggcaaccagcacatcccaggagacaacagcatctacatcaccaagatcattgaggggggtgctgctcagaaggatggacgcctacagattggggaccggctgctggcggtgaacaacaccaatctgcaggatgtgaggcacgaggaagctgtggcctcactgaagaacacatctgatatggtgtatttgaaggtggccaagccaggcagcctccacctcaacgacatgtacgctccccctgactacgccagcacttttactgccttggctgacaaccacataagccataattccagcctgggttatctcggggctgtggagagcaaggtcagctaccctgctcctcctcaggttccccccacccgctactctcctattcccaggcacatgctggctgaggaggacttcaccagagagcctcgcaagatcatcctgcacaaaggctccacaggcctgggcttcaacatcgtaggaggagaggatggagaaggcatttttgtctccttcatcctggcaggaggcccagctgacctgagtggggagctgcgcaggggagaccggatcttatcggtgaatggagtgaatctgaggaatgcaactcatgagcaggctgcagctgctctgaaacgggccggccagtcagtcaccattgtggcccagtacagacctgaagaatacagtcgctttgaatcgaagatacatgacttacgagaacaaatgatgaacagcagcatgagctctgggtctgggtccctccgaacaagtgaaaagaggtccttgtatgtcagggccctgtttgattatgatcggactcgggacagctgcctgccaagccaggggctcagcttctcttatggtgacattctgcatgtcattaatgcctctgatgatgagtggtggcaggcaaggctggtgaccccacacggagaaagtgagcagatcggtgtgatccccagtaagaagagggtggaaaagaaagaaagagctcgattgaaaactgtgaagttccatgccaggacggggatgattgagtctaacaggtcgatcaaaacgaaacgtaaaaagagtttccgcctctctcgaaagtttccattttacaagagcaaagaaaacatggcccaggagagcagcatacaggaacagggagtgacatccaacaccagtgacagcgaaagcagttccaaaggacaagaggatgctattttgtcatatgagccagtgacacggcaagaaattcactatgcaaggcctgtgatcatcctgggcccaatgaaggaccgagtcaatgatgacctgatctccgaatttccacataaatttggatcctgtgtgccacatactacccggcctcgacgtgataatgaggtggatggacaagactaccactttgtggtgtcccgagaacaaatggagaaagatattcaggacaacaagttcatcgaggcgggccaatttaatgataacctctatgggaccagcatccagtcagtgcgggcagttgcagagaggggcaagcactgcatcttagatgtttccggcaatgctatcaagagactgcagcaagcacaactttaccccattgccattttcatcaagcccaagtccattgaagcccttatggaaatgaaccgaaggcagacatatgaacaagcaaataagatctatgacaaagccatgaaactggagcaggaatttggagagtactttacagccattgtacagggtgactcactggaagagatttataacaaaatcaaacaaatcattgagacagcggctttccctgggcagtacaatggcttgaaggcaaaaagggataaagtgacagccgactgtgactctggtgaggaggggtgagcagggaggttgattctctgatgttaactaagtggcaaagtctcaaccgtgctcagccctccccctcccagggaagagaaacaaagattcaaagtaagcatgatactagtgggtttaccagtgtttcttccaaggagacatatattttttaataaacgatagttgcaatga

SEQ ID NO: 63801 - DNA, 2505 bp, Homo sapiens
agcacccattctctgcttgagctcccgcttcttctttgccgctgggcctcggcccagaagccacgacgggcgacacggagccgccagtgctggagggggagccgtgggtgcggggcaccgtgggggccgaggccccgggacgcccgcccggccccaggccccgctcagcccgggcgcccccacgggtgccccccccttcttggtccgagcagtgtgagtgtgccagggagcccggcggcggcggcggcggtggtggcggcggtggcggcggcgtggaatccggcgtgggctggggggtccgagccgcggggggcagtgccatgcacaagcaccagcactgctgtaagtgccctgagtgctatgaggtgacccgcctggccgccctgcggcgcctcgagcctccggggtacggcgactggcaagtccccgacccttacgggccaggtgggggcaacggcgccagcgcgggttatgggggctacagctcgcagaccttgccctcgcaggcgggggccacccccacccctcgcaccaaggccaagctcatccccaccggccgggatgtggggccggtgcctcttaagccagtcccgggcaagagcacccccaaactcaacggcagcggccccagctggtggccagagtgcacctgtaccaaccgggactggtatgagcaggtgaatggcagtgatggcatgttcaaatatgaggaaatcgtacttgagaggggcaactctggcctgggcttcagtatcgcaggtggcatcgacaatccccatgtccctgatgaccctggcatttttattaccaagattatccctggtggagcagctgccatggatgggaggctgggggtgaatgactgtgtgctgcgggtgaatgaggtggaagtgtcggaggtggtacacagccgggcggtggaggcgctgaaagaggcaggccctgtggtgcgattggtggtgcggaggcgacagcctccacccgagaccatcatggaggtcaacctgctcaaagggcccaaaggcctgggtttcagcattgctgggggtattggcaaccagcacatcccaggagacaacagcatctacatcaccaagatcattgaggggggtgctgctcagaaggatggacgcctacagattggggaccggctgctggcggtgaacaacaccaatctgcaggatgtgaggcacgaggaagctgtggcctcactgaagaacacatctgatatggtgtatttgaaggtggccaagccaggcagcctccacctcaacgacatgtacgctccccctgactacgccagcacttttactgccttggctgacaaccacataagccataattccagcctgggttatctcggggctgtggagagcaaggtcagctaccctgctcctcctcaggttccccccacccgctactctcctattcccaggcacatgctggctgaggaggacttcaccagagagcctcgcaagatcatcctgcacaaaggctccacaggcctgggcttcaacatcgtaggaggagaggatggagaaggcatttttgtctccttcatcctggcaggaggcccagctgacctgagtggggagctgcgcaggggagaccggatcttatcggtgaatggagtgaatctgaggaatgcaactcatgagcaggctgcagctgctctgaaacgggccggccagtcagtcaccattgtggcccagtacagacctgaagaatacagtcgctttgaatcgaagatacatgacttacgagaacaaatgatgaacagcagcatgagctctgggtctgggtccctccgaacaagtgaaaagaggtccttgtatgtcagggccctgtttgattatgatcggactcgggacagctgcctgccaagccaggggctcagcttctcttatggtgacattctgcatgtcattaatgcctctgatgatgagtggtggcaggcaaggctggtgaccccacacggagaaagtgagcagatcggtgtgatccccagtaagaagagggtggaaaagaaagaaagagctcgattgaaaactgtgaagttccatgccaggacggggatgattgagtctaacagggtaagtggggatccccaaggaaatcagccagtaggtaaagagggttgagaagcctggagtttagtctgatgtgtaggagaactggggaacacaaaagaaaatctctttttcagggggctggctctgtcctatcagaacattgactgcttttcagaaagcagagagggagctcttaaagttcacagccagtctgtgctcctttcccctgggtaccggctcttgaagatgtgttagagttggactgtctggaaggctgacttgcttggggaaaatgaaaccactcgtgggtgtctccctggctatagatcctgtcagagcatccggccaagaagcccagctccagagctcccacctcccttcagaccacctgaggcaggcgggttctccattcacccctttttttctatgagct

SEQ ID NO: 63802 - DNA, 1839 bp, Homo sapiens
  misc_feature (180)..(180): n is a, c, g, or t
ggggacagtcctggcccactgcactgggaatctaggatgggggccttggccagagccctgccgtccatactgctggcattgctgcttacgtccaccccagaggctctgggtgccaaccccggcttggtcgccaggatcaccgacaagggactgcagtatgcggcccaggaggggctattngctctgcagagtgagctgctcaggatcacgctgcctgacttcaccggggacttgaggatcccccacgtcggccgtgggcgctatgagttccacagcctgaacatccacagctgtgagctgcttcactctgcgctgaggcctgtccctggccagggcctgagtctcagcatctccgactcctccatccgggtccagggcaggtggaaggtgcgcaagtcattcttcaaactacagggctcctttgatgtcagtgtcaagggcatcagcatttcggtcaacctcctgttgggcagcgagtcctccgggaggcccacagttactgcctccagctgcagcagtgacatcgctgacgtggaggtggacatgtcgggagacttggggtggctgttgaacctcttccacaaccagattgagtccaagttccagaaagtactggagagcaggatttgcgaaatgatccagaaatcggtgtcctccgatctacagccttatctccaaactctgccagttacaacagagattgacagtttcgccgacattgattatagcttagtggaagcccctcgggcaacagcccagatgctggaggtgatgtttaagggtgaaatctttcatcgtaaccaccgttctccagttaccctccttgctgcagtcatgagccttcctgaggaacacaacaaaatggtctactttgccatctcggattatgtcttcaacacggccagcctggtttatcatgaggaaggatatctgaacttctccatcacagatgacatgataccgcctgactctaatatccgactgaccaccaagtccttccgacccttcgtcccacggttagccaggctctaccccaacatgaacctggaactccagggatcagtgccctctgctccgctcctgaacttcagccctgggaatctgtctgtggacccctatatggagatagatgcctttgtgctcctgcccagctccagcaaggagcctgtcttccggctcagtgtggccactaatgtgtccgccaccttgaccttcaataccagcaagatcactgggttcctgaagccaggaaaggtaaaagtggaactgaaagaatccaaagttggactattcaatgcagagctgttggaagcgctcctcaactattacatccttaacaccttctaccccaagttcaatgataagttggccgaaggcttcccccttcctctgctgaagcgtgttcagctctacgaccttgggctgcagatccataaggacttcctgttcttgggtgccaatgtccaatacatgagagtttgaggacaagaaagatgaagcttggaggtcacagctggatctgcttgttgcatttccagctgtgcagcacgtctcagagattcttgaagaatgaagacatttctgctctcagctccgggggtgaggtgtgcctggcctctgcctccaccctcctcctcttcaccaggtgcatgcatgccctctctgagtctggactttgcttcccctccaggagggaccaccctccccgactggcctgggatatctttacaagcaggcactgtatttttttattcgccatctgatccccatgcctagcagagtgctggcacttagtaggtcctcaataaatatttattaaatgatgagatgatggaatca

SEQ ID NO: 63803 - DNA, 469 bp, Homo sapiens
aaggtccctggtgaggctgggtccaggcccagggctgacacctccttccatgtctctcccttcagcctgaacatccacagctgtgagctgcttcactctgcgctgaggcctgtccctggccagggcctgagtctcagcatctccgactcctccatccgggtccagggcaggtggaaggtgcgcaagtcattcttgtaagttggctctgctcccaggccctggagctcttggccttggccttcgccccatccttcttaggtccaaggtgttcctagcttatcagaaaggccacgtgatggacagatggagtccaagcccggaggtggcctggggattgagtcctggctcttggatgagtgtctttctgtctctgagtctctacttcctcatctcccaaaggggacgggcctgcttccttgatggagtcatgggagggctaagtgcggtaatatcatgtctccttggtttg

SEQ ID NO: 63804 - DNA, 1394 bp, Homo sapiens
ggggacagtcctggcccactgcactgggaatctaggatgggggccttggccagagccctgccgtccatactgctggcattgctgcttacgtccaccccagaggctctgggtgccaaccccggcttggtcgccaggatcaccagattgagtccaagttccagaaagtactggagagcaggatttgcgaaatgatccagaaatcggtgtcctccgatctacagccttatctccaaactctgccagttacaacagagattgacagtttcgccgacattgattatagcttagtggaagcccctcgggcaacagcccagatgctggaggtgatgtttaagggtgaaatctttcatcgtaaccaccgttctccagttaccctccttgctgcagtcatgagccttcctgaggaacacaacaaaatggtctactttgccatctcggattatgtcttcaacacggccagcctggtttatcatgaggaaggatatctgaacttctccatcacagatgacatgataccgcctgactctaatatccgactgaccaccaagtccttccgacccttcgtcccacggttagccaggctctaccccaacatgaacctggaactccagggatcagtgccctctgctccgctcctgaacttcagccctgggaatctgtctgtggacccctatatggagatagatgcctttgtgctcctgcccagctccagcaaggagcctgtcttccggctcagtgtggccactaatgtgtccgccaccttgaccttcaataccagcaagatcactgggttcctgaagccaggaaaggtaaaagtggaactgaaagaatccaaagttggactattcaatgcagagctgttggaagcgctcctcaactattacatccttaacaccttctaccccaagttcaatgataagttggccgaaggcttcccccttcctctgctgaagcgtgttcagctctacgaccttgggctgcagatccataaggacttcctgttcttgggtgccaatgtccaatacatgagagtttgaggacaagaaagatgaagcttggaggtcacagctggatctgcttgttgcatttccagctgtgcagcacgtctcagagattcttgaagaatgaagacatttctgctctcagctccgggggtgaggtgtgcctggcctctgcctccaccctcctcctcttcaccaggtgcatgcatgccctctctgagtctggactttgcttcccctccaggagggaccaccctccccgactggcctgggatatctttacaagcaggcactgtatttttttattcgccatctgatccccatgcctagcagagtgctggcacttagtaggtcctcaataaatatttattaaatgatgagatgatggaatca

SEQ ID NO: 63805 - DNA, 1271 bp, Homo sapiens
  misc_feature (180)..(180): n is a, c, g, or t
ggggacagtcctggcccactgcactgggaatctaggatgggggccttggccagagccctgccgtccatactgctggcattgctgcttacgtccaccccagaggctctgggtgccaaccccggcttggtcgccaggatcaccgacaagggactgcagtatgcggcccaggaggggctattngctctgcagagtgagctgctcaggatcacgctgcctgacttcaccggggacttgaggatcccccacgtcggccgtgggcgctatgagttccacagcctgaacatccacagctgtgagctgcttcactctgcgctgaggcctgtccctggccagggcctgagtctcagcatctccgactcctccatccgggtccagggcaggtggaaggtgcgcaagtcattcttcaaactacagggctcctttgatgtcagtgtcaagggcatcagcatttcggtcaacctcctgttgggcagcgagtcctccgggaggcccacagttactgcctccagctgcagcagtgacatcgctgacgtggaggtggacatgtcgggagacttggggtggctgttgaacctcttccacaaccagattgagtccaagttccagaaagtactggagagcaggatttgcgaaatgatccagaaatcggtgtcctccgatctacagccttatctccaaactctgccagttacaacagagattgacagtttcgccgacattgattatagcttagtggaagcccctcgggcaacagcccagatgctggaggtgatgtttaagggtgaaatctttcatcgtaaccaccgttctccagttaccctccttgctgcagtcatgagccttcctgaggaacacaacaaaatggtctactttgccatctcggattatgtcttcaacacggccagcctggtttatcatgaggaaggatatctgaacttctccatcacagatgacatgataccgcctgactctaatatccgactgaccaccaagtccttccgacccttcgtcccacgggtaaggagtcccttagttccccatgagtgcagaccgagcctactagactccagaggtttctctttaaaacctctgcatctctcagcttgaccaagagtgagaaggccgggatgagactcccactgaaggctggggtgctgctcctttcaaagcctaaataacagaggccacgccccatatcttgtgggaccacagcttgtccaatcttttattggtgttatctaagaatcccaaggaatgctggcatagtccat

SEQ ID NO: 63806 - DNA, 243 bp, Homo sapiens
acaaactcctggactcaagtgacctactcacctcaacatcccaaagtgctgggattgcacgtgtgagccaccgtgcctggccctatatattttttaatgttcacattgcttatctgtataaaatataataaggttacattatttaatcaacattaccaataaataagaatatggagtactctttctgctcattttagatctaggctttaattttacagtggttctaaagtggtaagatggaaa

SEQ ID NO: 63807 - DNA, 726 bp, Homo sapiens
catgatgcagcagctaatttcaaacctaccactgcatgacagttttagtttgcctttttgcctctggtgggcatgaagactgagcaaagctgggaatcctgcagatgagagtgtgaggagccagggaaaggcagaaccacctccatgctgtagcaagcaatttctagatactagaagcataatagaaacatttttctgtacaggtattaaactactggtctgtttgacagactttggtaacaatccaaagaccctgagggtctgagcagctagaagtcctagacaaagaacttgtggatgacttttgtcccatgtggcttttgtgaagtatggcaaaggtttttcatgagtgcctgattgttattcctgaacaatatccatagcactgttggcctcaggagtgcacagctcctgctgatgtatttttctttttgtgaaggcaaagggacaattatcactgcatgtcatctcctagacaatcagtcaaatagagctggtggccagtggttagctattcgcacgttatttgccatgtaaatgaaaacgtctttatttatcaaaaaaacacagaggctatttttatatccttggtatgaaatatgtatttaaactatttaaatatttataaagaaatgaatgttttcttttcattttggtaaaaaaaaagcttgctgttttaacaagaaatgcactactgttgtgtatagtagatcaaaaattatttat

SEQ ID NO: 63808 - DNA, 238 bp, Homo sapiens
aaatggaagttgaactgagtgtggtttccagtacagggcatctggccaccttcacctcagtaaatactgctgatcgactctctctggctctggctgtcctgccagagacagccaaacacaggagacatgacaaattactatcatcttttgcttctttatttttattattattatttttctttttgtggagaacagcgtcttgctgtattgcccagcctgatctcaaactcctgggctg

SEQ ID NO: 63809 - DNA, 264 bp, Homo sapiens
tcctgaaatactctctactgtcactgcttcagtttaatttatagatagcaccagatatgagtccttattagttctgataactctgaaatggttatttggtatttcttcagtgacaagcaaactatccccccacctgcctttaatggccagtgtttttgatttgcataccaataagcgatctaggtagaggtaatcatctactaatttgctaacctttggaacataattttttctctagtaagctgtaaatcacttgaagttaga

SEQ ID NO: 63810 - DNA, 726 bp, Homo sapiens
cctctgtcgctagataggttaccaagggatggtgaggacacacacacacacacacagttggtgataaccttgtgtcctgaagcatgagactcttacctgtggtagataaggagatagaagttgaagagaaagcttggcttatgcagtagctttgtcacttgaaagatgtggaagcagctgctgttgcaaggattatggaggtggctagcttttctaaatcaccttagcagctttgaagcaagagaatgaaagatgcagttcagcctgctatctactcagagtatgctgtgaaaggcaggaactctcccaagacaacatgtaaagaaaaccttgcttccgtggccaggaggcagagcatgctgaaaatgagaaccaatatttcatcacaagagcagcagagctgcaaaagacacttgtgcatcctcagcaggtctcctgtactaaagtgggggcttctattatttttatttttgtagagacggggatcttgctatgttcctcaggctggtttcgaactcctggcctcaactgatccacctgccatggcctcacaaacttctgggattacagacatgagccacagtaaccggcccattgggtgcttttaaaggaataaatgggactctaggcctgacgtgggatgtttgggtggatgtaccaaagaaccttgagcccccagagtcccctgaagcatcctggccagcagaaactgccttcttcccattg

SEQ ID NO: 63811 - DNA, 884 bp, Homo sapiens
ccttgtctctgcaaaaaattaaatattagttgggcacggtgtcatgtgcctgtagtcccagctacttgggaagctgttgttgggaggatgccttgaactcctgagctcaagtcatcctcccacctcagccttccgagtagctggaactgcaggtgtgagccaccatgcctggctgatttgtctttttaaattttttatagagaccgagtctcaactatattgtccaggctggaaaagaacttctttccctccaagtgataaccttttccagacaagtcagcttaaaaactgacccaaaggccctgaagtacacagttttcttggagaaagaaaaaaataagtgaaaaggacttgctgacttgctaattcattttggggcctgtgggtaacatcagaatggcaaagcacttggggcttttttctaatttgtatttttttaatcttctgagaaatgacttttatatgccaagattcattccatgattagtttttatgaccaagttatgaacgcttttgaatatggggacctagaatagaaatgctaacctacctgcaaggagagctctgtgattggcatccccatcatgctgtaactgacacaaaataaacttagggtaattgccgcatagtgtaactttaatgtgtgagcatactgtaacatctgacaagcttcttgatctagatcagcaatgtgtaacccattcattgttgtcactctcaacaaggccttatggtcaaacatcatcactctcactaaagagatagtttactgaaatatactgagattttgaaactggagtcaagaggtagcacactgttttatgttgatccatttaatggtccttgacagccaataaaaagacactggaagaataaaaaaaaaa

SEQ ID NO: 63812 - DNA, 1411 bp, Homo sapiens
ctctcgcccgtgacattttctccaaatcggaagaaaatcaagtgtatgtcgagctttgccgcaggcagcccttggtctccgctttcagattcggggtccgggagcggagcgccctgcccgcggcggtgctaaactctggggccagggtgtggccctcagcgagcgccctgggactggccgccccgccgaaggatgccgaggatcgggcaaggccggcgtccggtctgcgcggggcgcgggtgctctccgaaggccgcgagccaggggcctcgctgcgggttcaagtgcgtccgggtttggacgtcgcggctccaggagtgtgctctctctcctgcccatcccctccccggagttcagcgcatccggggccccggggacccctcttcccggccctgctggccgcgcttgcccgcccgcatggggccgaggttcctggccgacgcgcgagggcgcgggcgggtaccgggttccggtttttcccaggccccgatccccgcccacgcacgaggcccccggcccacgcacgaggcgcccacgcccatcgtggaggctccgcctggaaaagaagtccgacttcctctccaagctgctccgaggggaatggggaatcggcaggaaatgacccgaactgccagcctgcgcctttgcagccggccctcgctttgctgaagacgagcagctcccaccaaagtcttgcctccccttaccccgaaagccccgctcagttcaatatttcaagtgaaaatctgcctgttcgaaaagaaaatattcacaaatgagcagtgtattagaagacaactgaattgcttctaagaatgggtctcactctgccatcacccaggctggagtgtggtggcaccatcatggctcactgcagccttgaactcctgagctcaagtcatcctcccacctcagccttccgagtagctggaactgcaggtgtgagccaccatgcctggctgatttgtctttttaaattttttatagagaccgagtctcaactatattgtccaggctggaaaagaacttctttccctccaagtgataaccttttccagacaagtcagcttaaaaactgacccaaaggccctgaagtacacagttttcttggagaaagaaaaaaataagtgaaaaggacttgctgacttgctaattcattttggggcctgtgggtaacatcagaatggcaaagcacttggggcttttttctaatttgtatttttttaatcttctgagaaatgacttttatatgccaagattcattccatgattagtttttatgaccaagttatgaacgcttttgaatatggggacctagaatagaaatgctaacctacctgcaaggagagctctgtgattggcatccccatcatgctgtaactgacacaaaataaacttagggtaattgccg

SEQ ID NO: 63813 - DNA, 1671 bp, Homo sapiens
ctctcgcccgtgacattttctccaaatcggaagaaaatcaagtgtatgtcgagctttgccgcaggcagcccttggtctccgctttcagattcggggtccgggagcggagcgccctgcccgcggcggtgctaaactctggggccagggtgtggccctcagcgagcgccctgggactggccgccccgccgaaggatgccgaggatcgggcaaggccggcgtccggtctgcgcggggcgcgggtgctctccgaaggccgcgagccaggggcctcgctgcgggttcaagtgcgtccgggtttggacgtcgcggctccaggagtgtgctctctctcctgcccatcccctccccggagttcagcgcatccggggccccggggacccctcttcccggccctgctggccgcgcttgcccgcccgcatggggccgaggttcctggccgacgcgcgagggcgcgggcgggtaccgggttccggtttttcccaggccccgatccccgcccacgcacgaggcccccggcccacgcacgaggcgcccacgcccatcgtggaggctccgcctggaaaagaagtccgacttcctctccaagctgctccgaggggaatggggaatcggcaggaaatgacccgaactgccagcctgcgcctttgcagccggccctcgctttgctgaagacgagcagctcccaccaaagtcttgcctccccttaccccgaaagccccgctcagttcaatatttcaagtgaaaatctgcctgttcgaaaagaaaatattcacaaatgagcagtgtattagaagacaactgaattgcttctaagaatgggtctcactctgccatcacccaggctggagtgtggtggcaccatcatggctcactgcagccttgaactcctgagctcaagtcatcctcccacctcagccttccgagtagctggaactgcaggtgtgagccaccatgcctggctgatttgtctttttaaattttttatagagaccgagtctcaactatattgtccaggctggaaaagaacttctttccctccaagtgataaccttttccagacaagtcagcttaaaaactgacccaaaggccctgaagtacacagttttcttggagaaagaaaaaaataagtgaaaaggacttgctgacttgctaattcattttggggcctgtgggtaacatcagaatggcaaagcacttggggcttttttctaatttgtatttttttaatcttctgagaaatgacttttatatgccaagattcattccatgattagtttttatgaccaagttatgaacgcttttgaatatggggacctagaatagaaatgctaacctacctgcaaggagagctctgtgattggcatccccatcatgctgtaactgacacaaaataaacttagggtaattgccgcatagtgtaactttaatgtgtgagcatactgtaacatctgacaagcttcttgatctagatcagcaatgtgtaacccattcattgttgtcactctcaacaaggccttatggtcaaacatcatcactctcactaaagagatagtttactgaaatatactgagattttgaaactggagtcaagaggtagcacactgttttatgttgatccatttaatggtccttgacagccaataaaaagacactggaagaataaaaaaaaaa

SEQ ID NO: 63814 - DNA, 3040 bp, Homo sapiens
gggccgccgtcggcgcgctgggtgcgggaagggggctctggatttcggtccctcccctttttcctctgagtctcggaacgctccagctctcagaccctcttcctcccaggtaaaggccgggagaggagggcgcatctcttttccaggcaccccaccatgggcaatgcctccaatgactcccagtctgaggactgcgagacgcgacagtggcttcccccaggcgaaagcccagccatcagctccgtcatgttctcggccggggtgctggggaacctcatagcactggcgctgctggcgcgccgctggcggggggacgtggggtgcagcgccggccgcaggagctccctctccttgttccacgtgctggtgaccgagctggtgttcaccgacctgctcgggacctgcctcatcagcccagtggtactggcttcgtacgcgcggaaccagaccctggtggcactggcgcccgagagccgcgcgtgcacctacttcgctttcgccatgaccttcttcagcctggccacgatgctcatgctcttcgccatggccctggagcgctacctctcgatcgggcacccctacttctaccagcgccgcgtctcggcgctccgggggcctggccgtgctgcctgtcatctatgcagtctccctgctcttctgctcgctgccgctgctggactatgggcagtacgtccagtactgccccgggacctggtgcttcatccggcacgggcggaccgcttacctgcagctgtacgccaccctgctgctgcttctcattgtctcggtgctcgcctgcaacttcagtgtcattctcaacctcatccgcatgcaccgccgaagccggagaagccgctgcggaccttccctgggcagtggccggggcggccccggggcccgcaggagaggggaaagggtgtccatggcggaggagacggaccacctcattctcctggctatcatgaccatcaccttcgccgtctgctccttgcctttcacgatttttgcatatatgaatgaaacctcttcccgaaaggaaaaatgggacctccaagctcttaggtttttatcaattaattcaataattgacccttgggtctttgccatccttaggcctcctgttctgagactaatgcgttcagtcctctgttgtcggatttcattaagaacacaagatgcaacacaaacttcctgttctacacagtcagatgccagtaaacaggctgacctttgaggtcagtagtttaaaagttcttagttatatagcatctggaagatcattttgaaattgttccctggagaaatgaaaacagtgtgtaaacaaaatgaagctgccctaataaaaaggagtatacaaacatttaagctgtggtcaaggctacagatgtgctgacaaggcacttcatgtaaagtgtcagaaggagctacaaaacctaccctcaatgagcatggtacttggcctttggaggaacaatcggctgcattgaagatccagctgcctattgatttaagctttcctgttgaatgacaaagtatgtggttttgtaatttgtttgaaaccccaaacagtgactgtactttctattttaatcttgctactaccgttatacacatatagtgtacagccagaccagattaaacttcatatgtaatctctaggaagtcaatatgtggaagcaaccaagcctgctgtcttgtgatcacttagcgaaccctttatttgaacaatgaagttgaaaatcataggcaccttttactgtgatgtttgtgtatgtgggagtactctcatcactacagtattactcttacaagagtggactcagtgggttaacatcagttttgtttactcatcctccaggaactgcaggtcaagttgtcaggttatttattttataatgtccatatgctaatagtgatcaagaagactttaggaatggttctctcaacaagaaataatagaaatgtctcaaggcagttaattctcattaatactcttattatcctatttctgggggaggatgtacgtggccatgtatgaagccaaatattaggcttaaaaactgaaaaatctggttcattcttcagatatactggaacccttttaaagttgatattggggccatgagtaaaatagattttataagatgactgtgttgtaccaaaattcatctgtctatattttatttagggaacatggtttgactcatcttatatgggaaaccatgtagcagtgagtcatatcttaatatatttctaaatgtttggcatgtaaatgtaaactcagcatcaaaatatttcagtgaatttgcactgtttaatcatagttactgtgtaaactcatctgaaatgttacaaaaataaactataaaacaaaaatttgaaaatggagtagtattttatgaactccctcaaataacattttgtgattaatataaacatagtatcttttaaatgagttcaaagtggaaaaattatatttaatttggcagattcgtaaagtgtggttgccaggttttaaagtgaggttgcaaattagagtttaaaatattcattataatacttggtattagaagatatttttttcctccagtttttacccttccagtatgatctttaaaatagtagaatcatcttatttttttcatagtgatattattggatagccactccttaaaaaaaaaaaagagatgcttgttttctccaaagtctcattgagttgtttatccaaagctatttcctttaagcagttatcaaactagctgatcacttagaatgatttcaaaccaatctaggcatcagtgtattttgatacaaacaatctacgtcaaatcagctcttaagaagaataaataagtggtttgcttttctacaaatttaaacaagccaggcaaaatttaacttaactaaaatctagacatgtaaataaatcttccctgtccaccaggcattctaaagttaagaaattattctaaatgggactaattaggcccatgggtaattcctaaacataaaattctgaagttgctttgaactagaagat

SEQ ID NO: 63815 - DNA, 2986 bp, Homo sapiens
gggccgccgtcggcgcgctgggtgcgggaagggggctctggatttcggtccctcccctttttcctctgagtctcggaacgctccagctctcagaccctcttcctcccaggtaaaggccgggagaggagggcgcatctcttttccaggcaccccaccatgggcaatgcctccaatgactcccagtctgaggactgcgagacgcgacagtggcttcccccaggcgaaagcccagccatcagctccgtcatgttctcggccggggtgctggggaacctcatagcactggcgctgctggcgcgccgctggcggggggacgtggggtgcagcgccggccgcaggagctccctctccttgttccacgtgctggtgaccgagctggtgttcaccgacctgctcgggacctgcctcatcagcccagtggtactggcttcgtacgcgcggaaccagaccctggtggcactggcgcccgagagccgcgcgtgcacctacttcgctttcgccatgaccttcttcagcctggccacgatgctcatgctcttcgccatggccctggagcgctacctctcgatcgggcacccctacttctaccagcgccgcgtctcggcgctccgggggcctggccgtgctgcctgtcatctatgcagtctccctgctcttctgctcgctgccgctgctggactatgggcagtacgtccagtactgccccgggacctggtgcttcatccggcacgggcggaccgcttacctgcagctgtacgccaccctgctgctgcttctcattgtctcggtgctcgcctgcaacttcagtgtcattctcaacctcatccgcatgcaccgccgaagccggagaagccgctgcggaccttccctgggcagtggccggggcggccccggggcccgcaggagaggggaaagggtgtccatggcggaggagacggaccacctcattctcctggctatcatgaccatcaccttcgccgtctgctccttgcctttcacgatttttgcatatatgaatgaaacctcttcccgaaaggaaaaatgggacctccaagctcttaggtttttatcaattaattcaataattgacccttgggtctttgccatccttaggcctcctgttctgagactaatgcgttcagtcctctgttgtcggatttcattaagaacacaagatgcaacacaaacttcctgttctacacagtcagatgccagtaaacaggctgacctttgaggtcagtagtttaaaagttcttagttatatagcatctggaagatcattttgaaattgttccctggagaaatgaaaacagtgtgtaaacaaaatgaagctgccctaataaaaaggagtatacaaacatttaagctgtggtcaaggctacagatgtgctgacaaggcacttcatgtaaagtgtcagaaggagctacattgaagatccagctgcctattgatttaagctttcctgttgaatgacaaagtatgtggttttgtaatttgtttgaaaccccaaacagtgactgtactttctattttaatcttgctactaccgttatacacatatagtgtacagccagaccagattaaacttcatatgtaatctctaggaagtcaatatgtggaagcaaccaagcctgctgtcttgtgatcacttagcgaaccctttatttgaacaatgaagttgaaaatcataggcaccttttactgtgatgtttgtgtatgtgggagtactctcatcactacagtattactcttacaagagtggactcagtgggttaacatcagttttgtttactcatcctccaggaactgcaggtcaagttgtcaggttatttattttataatgtccatatgctaatagtgatcaagaagactttaggaatggttctctcaacaagaaataatagaaatgtctcaaggcagttaattctcattaatactcttattatcctatttctgggggaggatgtacgtggccatgtatgaagccaaatattaggcttaaaaactgaaaaatctggttcattcttcagatatactggaacccttttaaagttgatattggggccatgagtaaaatagattttataagatgactgtgttgtaccaaaattcatctgtctatattttatttagggaacatggtttgactcatcttatatgggaaaccatgtagcagtgagtcatatcttaatatatttctaaatgtttggcatgtaaatgtaaactcagcatcaaaatatttcagtgaatttgcactgtttaatcatagttactgtgtaaactcatctgaaatgttacaaaaataaactataaaacaaaaatttgaaaatggagtagtattttatgaactccctcaaataacattttgtgattaatataaacatagtatcttttaaatgagttcaaagtggaaaaattatatttaatttggcagattcgtaaagtgtggttgccaggttttaaagtgaggttgcaaattagagtttaaaatattcattataatacttggtattagaagatatttttttcctccagtttttacccttccagtatgatctttaaaatagtagaatcatcttatttttttcatagtgatattattggatagccactccttaaaaaaaaaaaagagatgcttgttttctccaaagtctcattgagttgtttatccaaagctatttcctttaagcagttatcaaactagctgatcacttagaatgatttcaaaccaatctaggcatcagtgtattttgatacaaacaatctacgtcaaatcagctcttaagaagaataaataagtggtttgcttttctacaaatttaaacaagccaggcaaaatttaacttaactaaaatctagacatgtaaataaatcttccctgtccaccaggcattctaaagttaagaaattattctaaatgggactaattaggcccatgggtaattcctaaacataaaattctgaagttgctttgaactagaagat

SEQ ID NO: 63816 - DNA, 421 bp, Homo sapiens
ctatcttagaaattatttaggtatacaatgaataataatctgttaatcaattcattgtaatattagaccaaaagtgtaagttaccctaaagatcttagaaattgtcttcaaggccaggcgcagtggctcacgcctgtaatcccagcactttgggaagctgaggctggcctcaagcaatccatgtgcctcagcctcccaaagtactggtattataggtgtgagccaccgtgcctggccccaaagtgcttttgcttatataggttatgtgggttataattacttatacttaatcatattaaaaatcacaactgagaaatttagaatgtctgtttaaaaccacattagggccaagtgggagaatcatttgaagccaaaggaggccagcctgggcaacatagtgagacctcatctctacaaaaac

SEQ ID NO: 63817 - DNA, 498 bp, Homo sapiens
tatgttactattattgcaaagcaaactacccagaatttgatgagcaaaagctactgtcatttatttactcatgattctgtggattaggaattcagtgtcactcatttggagggttctgctccctgtgacgttggctgagtctttccttggctgcattcagctggtggttgagctgagccagaaagtccgagaaagcttcttgtttggtgtcagtgcatctctattggcctctttctctctccacatagcttgggcatcctcacagtaacatgttcttaagatagacttagatggctgccggcttctaacagggagtgcttcaagagagcctgtggaagctgacgatctcataaggccgagtcctgggtgtcatatagtgtgacttctgctgcattttattaatcaaaaacaaaacaaaacaaaacgtcattgggccagcccagattcaaggggaaggaaaataaacttcacctctcaatatgaagagtggcaaagaga

SEQ ID NO: 63818 - DNA, 3028 bp, Homo sapiens
  misc_feature (1993)..(1993): n is a, c, g, or t
  misc_feature (2793)..(2793): n is a, c, g, or t
gttcttttaaggtgagcatctccaggcttggccctagagcctcatacttgttacagtaaagaggagatggccacagcacaatgcccagagtgggcagaggccgggcaccaccaactgctgccgtggctcctgcaggagggcaggtgcagaccctcttggtggaggcatgtgccataacccttagcccaggcagggaacctaccatggacccagcatgccaggagagtccaagagcaaggggagagaagccacatgcggctccagattcattcctgggcttgagaggagccaggcaccaccgtaagagccagggtccctgcctgtacctgcccagccttgtggctcttctctggaagagcagccaggcacatggcaattaaggaggggaacaggtagaagcgcccgcagcttattgcataagtacttaaaatgcagtgttcaccaggttcacctcccagaggagacaaccttttgtgtgaggatgttcgtggagggaagtcactgaatggtttcagaatcctgttttttaattgaattgaggcatctctggttacttaaatataatgtatttgccaattaatttttccattgacgtcttaaaactcaggttcagatctcaggccagctacctcagaagatgcagctcagttgagagccccagaggggatttaggagcatcctggttagggctcagttgagggaggaaggaaccaaaggattttccaggtagctcgatcccagcagagcaggagctacactgacaatctgccaggtgcagtcctcgcctgtgaggcaggaagctgcagcccagaggggttgaggggctcacctgagtgagtgtgagcaggtgagcaagtgaggggcagaggcaggattccccccagggcagcctgaccgcagagcagcacagagggcatggcaggtgaatatgcgcaataaagacatcctgagaaggtgaggaccatgtgtctgatcagaagagaaatgacgggctgagaaatggcagccacaccttgaatgagctgccaccaccgaggaccctccctgacccctgtagaactctgacctggggacagggtcttcacagatggcccctggactggtgctctgtgcagtgtctgcctttctgggatagagggcacaggccagatgaggcagatgagggttcagggcctgatgccatacagcaccaggccttcggctccccagagagcagagggctccccctcaggccacaggctttctgctgcctgactgcatggagtggtggggccttgcccctgatgttgctgccttagaggagatgtttaaccttgcatctttgtttactcattagtcacagtgaatggggctgagggctggaagaggatgcgagtggtgtactcacatcacagcccagaagatggcgggggcccacctggccctgagattccatgtcctactctagaagatgccccatatcagtttagttcccttctcacccctcccttccagccatcctaaagatgtcatggccagatgtgccctggggtgagcattcctggccctatatctagacagaccatgaaggaaccaagtgcctggtgaggaattgagccccagaggagcaggagggcgggacacagggaagaggcagaaaggaagacactcccagaggcctcgttctgccacctgtgttcaagcgttaagatcagacgcacacatgtgagcacacatgtacacagctgctatcgggccttgcttggtcctcatcaaattgtgaactccacgagggcaaggaccaaatctccctgttcactgaattccccccctgcagctcacccagggccaccaaggaggcacttagcccatgttgaatgggtgaatgagcaccacctttctctttggtgccgtgaggagcaaagccttccctcaggtcgccccttcatgcgttcctcaggtggtacccttcctagctgcccctccccaggcagtctcacagcgctggccccanggtagtggctgcctctgggttgatgtgtgtggagcagacagccccagccagccagtgaggttcttcgagattgcactaagctctagcatgcttgttccctcctcccagccatctggtcagccctactgcagagacagtagggccagaatctcagggctaggtgggcccccaccatcctggtcatcttcaggcttgagccagagcccttttcttagccttggctgagggagagtcaagcccctgtttcttcatctgctgaccccacgtagacgcttctctgccaaggaggcagtgctgtgttcttcacgtgggagacctgattcctcaatgccagactgctgcagaaatgctgccttggaagccaggtgaggggtgacagagcagagtgggttgaggtgagagcctgcctcgcagaaggcagggcgggcagactccacagggaggtctgtcgggtcctagctgcctgaaggagcttgtttggcccaagcagagtgggtgcgtgcatttcactctccacctcagagtgtgagagcctgagaaagctctgtgtgtgtgcgtgtgtgtgtgtgtgtgtgtgtgttgggggagggggacttgcccaggctgctgtctgcaccatgaattaacttcactctttaagctgagtgtggatgggaagccagggagcagctgcacacaggctcatcctcgctcgcaggcactgctgcagcacagactgcccaaaggagtgtgagcagtgcgctggcttcctcctgcctcaggaatagagcccttcatcctccctgaagggaagattcatnagcagcgagggaagattcacgagcccagcccagctggcatttgtcatcattccagagacatgagccacgcccctgacccctctgccccttggctgctcttcgcagaccctctgtggcctcacctctctctgcatgcatgctgggccctctccttttcccgccaccacacagactgtgtgctttggagaaaatgaaaatgttcccgaagtaggttaataaacatcatctgaagaat

SEQ ID NO: 63819 - DNA, 339 bp, Homo sapiens
caaagcacccgtcctgaaggcctagagggtgccccctgtgccccgcggctccccagcacctgcttctcgtttcacatcttcaagtttgactgctcctgacactgccatactgtaaggaagcttaaaacagctcatatggagaaaccacatggagaagacctgagacttcagagaacgagagatagatgctttgccagctgcatgctaatccagtttcaatcattgtttggctgcaacagcatgagagatcccaaactagaaccacccagctgagcccttcccaaattcttcagccacagaaagtatgagagacagtaaaatcagtgtttttattttaat

SEQ ID NO: 63820 - DNA, 393 bp, Homo sapiens
attgattgacagatgattcatagataacttgcaacgtttcttcagtgaacgcatatttatttcttgggtaataagaaaaaacaatagaatgtggaatttggggcttggcctcttttagctcatttaaaaaaatattaaacacttggaattatcgagcgctgaaaaaggcaatagaaaattcaccttttaactccctcaaagatagaaatgtgtgaatctgctagtgggttgcgtttggctggtcctgcaggctgatttggtctgtcctctctcccagagagatccccaagcccggctgagatgtgcttgtttgtcttgagggcagacaaagcctagcaaaatcttatggaagctgatataaaagcttaatagcttataaaagctctaaaaatg

SEQ ID NO: 63821 - DNA, 399 bp, Homo sapiens
atatgtgccacgctctgtgataaaggcgaggtgtgttcttgtcggaaatttgagcagataatgtaaatcattttatagacggggaagccggggccaaaggaagttgccctgggtcatgcacctaggaagcggcacaatcaggagttggggtgattttaatcggtcatcctccggcctaattcccctctaggctgttcttttggggtacattctgcacctttgtatcgcctgcacctcaccccttgccgggcacgcagggcgtccgctaggcgctggatgcatttactacacctctgggagggttcctgaggggcacctggaaccggttagtccttgtcaacaagtctcccatctagtggcggagacaggcatgcaaaataaagtatgtagaacaagagt

SEQ ID NO: 63822 - DNA, 373 bp, Homo sapiens
actccagaacttcccagggctgccctgaagagcctgtctcttggtgatgggggtgcagccactggggccaggcaacagcaggaggctgaacccctaccataagcagtagaccatgagtgggctcctaagaacctccagttatccaaggccccatcagagtagctagatacacggtgtcgattggtgcattcacaaaccctgagctagacacaggatgctgattggtatgtttacacactttgagctagatacagagtgcgattggtatatttacaacccctgggctagacataaaagttctccaagtccccatgagaatagctagatacagcatgtcaatttggtgcactcaaaatccctgagctagacacag

SEQ ID NO: 63823 - DNA, 1863 bp, Homo sapiens
  misc_feature (1782)..(1782): n is a, c, g, or t
  misc_feature (1793)..(1793): n is a, c, g, or t
  misc_feature (1818)..(1818): n is a, c, g, or t
  misc_feature (1825)..(1825): n is a, c, g, or t
  misc_feature (1830)..(1832): n is a, c, g, or t
  misc_feature (1839)..(1839): n is a, c, g, or t
  misc_feature (1846)..(1846): n is a, c, g, or t
  misc_feature (1850)..(1850): n is a, c, g, or t
  misc_feature (1857)..(1857): n is a, c, g, or t
gcaggaaagaatttgagcccctcccccagcctgaccatctctgttggttgctcggccaggctccacgtcaaatccagtttgaaacacagaccctaggaccacgcaggaggtggtgggctcgcaggaaggttcctctcccagtggccatgggtagcaacagtgggcaggctggccgccacatctataaatccctagctgatgatggcccctttgactctgtggagccgcctaaaagacccaccagcagactcatcatgcacagcatggccatgttcggaagagagttctgctacgcggtggaggcagcgtatgtgaccccagtcctgctcagcgtaggtctgcccagcagcctgtacagcattgtgtggttcctcagccccatcctgggattcctgctgcagcccgtggtcggatcggccagcgaccactgccggtccaggtggggccgccggagaccctacatcctcaccctgggagtcatgatgctcgtgggcatggctctgtacctcaatggggctactgttgtagcagctttgattgctaacccaaggaggaagctggtttgggccataagtgtcaccatgataggtgtcgttctctttgattttgctgccgacttcattgatgggcccatcaaagcctacttatttgatgtctgctcccatcaggacaaggagaagggcctccactaccatgccctcttcacaggttttggaggtgccctgggttaccttttgggtgctatagactgggcccatctggagctgggaagactgttgggtacagaattccaggtcatgttcttcttctctgcattggtgctcactttgtgttttactgttcatctgtgcagtatctctgaagccccacttacagaggttgcaaagggcattcccccacagcaaacccctcaggaccctccattgtcatcagatggaatgtacgagtatggttctatcgagaaagttaaaaatggttacgtaaatccagagctggcaatgcagggagcaaaaaacaaaaatcatgctgaacagactcgcagggcaatgacattaaagtcactgctgagagcactggtgaacatgcctcctcactaccgctacctttgcatcagccacctcattggatggacggccttcctgtccaacatgctgttcttcacagatttcatgggccagattgtgtaccgcggggatccctatagtgcacacaactccacagagtttctcatctacgaaagaggagtcgaggttggatgttggggcttctgcatcaactccgtgttttcctcactttattcttactttcagaaagttttggtatcctacattggattaaagggtctttacttcacgggatatttgctgtttggcctggggacgggatttattgggctcttcccgaatgtctactccaccctggtcctgtgcagcctgtttggtgtaatgtccagcaccctgtacactgtgccctttaacctcattactgagtaccaccgcgaggaagaaaaggagaggcagcaggccccaggaggggacccagacaacagcgtgagagggaagggcatggactgcgccaccctcacatgcatggtgcagctggctcagatcctggtcggaggtggcctgggctttctggtcaacacagccgggaccgttgtcgtcgtggtgatcacagcgtctgcggtggcactgataggctgttgctttgtcgctctctttgttagatatgtggattaggtcaataaagagacaatgaccctaaaaaaaaaaaaaaaaaaangaaaaaaaaanaaaaaaaaaaaaaaaaaaacaaaanaccgccnggggnnntcattantggcggnggcnggaaaanaaaggg

SEQ ID NO: 63824 - DNA, 1686 bp, Homo sapiens
  misc_feature (1605)..(1605): n is a, c, g, or t
  misc_feature (1616)..(1616): n is a, c, g, or t
  misc_feature (1641)..(1641): n is a, c, g, or t
  misc_feature (1648)..(1648): n is a, c, g, or t
  misc_feature (1653)..(1655): n is a, c, g, or t
  misc_feature (1662)..(1662): n is a, c, g, or t
  misc_feature (1669)..(1669): n is a, c, g, or t
  misc_feature (1673)..(1673): n is a, c, g, or t
  misc_feature (1680)..(1680): n is a, c, g, or t
gcaggaaagaatttgagcccctcccccagcctgaccatctctgttggttgctcggccaggctccacgtcaaatccagtttgaaacacagaccctaggaccacgcaggaggtggtgggctcgcaggaaggttcctctcccagtggccatgggtagcaacagtgggcaggctggccgccacatctataaatccctagctgatgatggcccctttgactctgtggagccgcctaaaagacccaccagcagactcatcatgcacagcatggccatgttcggaagagagttctgctacgcggtggaggcagcgtatgtgaccccagtcctgctcagcgtaggtctgcccagcagcctgtacagcattgtgtggttcctcagccccatcctgggattcctgctgcagcccgtggtcggatcggccagcgaccactgccggtccaggtggggccgccggagaccctacatcctcaccctgggagtcatgatgctcgtgggcatggctctgtacctcaatggggctactgttgtagcaggttttggaggtgccctgggttaccttttgggtgctatagactgggcccatctggagctgggaagactgttgggtacagaattccaggtcatgttcttcttctctgcattggtgctcactttgtgttttactgttcatctgtgcagtatctctgaagccccacttacagaggttgcaaagggcattcccccacagcaaacccctcaggaccctccattgtcatcagatggaatgtacgagtatggttctatcgagaaagttaaaaatggttacgtaaatccagagctggcaatgcagggagcaaaaaacaaaaatcatgctgaacagactcgcagggcaatgacattaaagtcactgctgagagcactggtgaacatgcctcctcactaccgctacctttgcatcagccacctcattggatggacggccttcctgtccaacatgctgttcttcacagatttcatgggccagattgtgtaccgcggggatccctatagtgcacacaactccacagagtttctcatctacgaaagaggagtcgaggttggatgttggggcttctgcatcaactccgtgttttcctcactttattcttactttcagaaagttttggtatcctacattggattaaagggtctttacttcacgggatatttgctgtttggcctggggacgggatttattgggctcttcccgaatgtctactccaccctggtcctgtgcagcctgtttggtgtaatgtccagcaccctgtacactgtgccctttaacctcattactgagtaccaccgcgaggaagaaaaggagaggcagcaggccccaggaggggacccagacaacagcgtgagagggaagggcatggactgcgccaccctcacatgcatggtgcagctggctcagatcctggtcggaggtggcctgggctttctggtcaacacagccgggaccgttgtcgtcgtggtgatcacagcgtctgcggtggcactgataggctgttgctttgtcgctctctttgttagatatgtggattaggtcaataaagagacaatgaccctaaaaaaaaaaaaaaaaaaangaaaaaaaaanaaaaaaaaaaaaaaaaaaacaaaanaccgccnggggnnntcattantggcggnggcnggaaaanaaaggg
